United States Patent 8,937,215 (POLYNUCLEOTIDES AND POLYPEPTIDES FOR INCREASING DESIRABLE PLANT QUALITIES) - sequence listing, part 3

SEQ ID NO: 4583 - DNA, 1361 bp, Sorghum bicolor
agaagttgcaacaagggactcccttgtgggccttgtgggtgtcaaagccgccctcgtgactgcccaaccgccggccatatggcgtcttcggcggcggcgcccgccggcgaggcgtccacctcggagcccgcagcgaaggggaagcccatcgtcgtgcgggtcaagcgcaagccctcgcagacccgcccggacgctttctggctagagattaatgagaggccggcgaagaaggccatgctcgatttctccagcctctccatctccgacccaccctcctcttcctccgccgccagtgctaaagcttcagaggaaccacgagttaagaaacttcttgtccagcacatcgagacagtacaccattctgaggctgttgaagatgtgttacactcacttttgcttgctgacttgaattccaaggagataaagagcaagacaaaggagtggaatgacagaatcaagcaagacaaaaaaccagaggagctacgatcagcagccagacagaggcatgaggatatgggtagaaatgctcgctttgcacaaatatggaagagtcgaaaaggagaaaataatgatgctgatgactcattgagagaaatatgccatctttatgatgctgtccaagtagatcacgatgacgagaagcatccagcagaaccacggattacctctttcgaagagggtgctgttctatgcaactttcttccgcttatacgggagtacttgccatcagctgcagaggaaattgagtcagatataatttcactggcacaatcagaagattctgaagtttatgatatctatactgtcaaggaggtggatgatacaaacatggaggccacgtcagcagcttcatatccaaggctacaagtggacgatggagaagatgaatgttacgacgatgactatccatatgacacggatgattcaaatgccgaagacaatccactttttgattatcccgatgaattgtccgaggatgaggatgatggtagcaatgatgaggatccttttggagacgaagaaggttctgacactgagtatgagaaggaagaagtagaagcggaagaggatgaataatgatgactaggaattgcaatggagcgcgcgattgtagatgctggggagactagcctgtgaactgaatgtaatgtttgacgatgagataggttcggagctgactgatgaatgtctgttgctaatgctgaaaaaaaaagagaggagaaatggagctgtgtaacagttagcattgtacatcgcgtgcgtcacttgaaggaagaattcaaaaaatatttggatgtgctttcttatttgttcttgttaggttattgcgtagggcgtctttggtaaggcttttagagagg

SEQ ID NO: 4584 - DNA, 632 bp, Zea mays
tttgtggggccgtacctatcacttctcttgtttccgtatgcagggagcgtccatgctaatggctacagctccttcctgtttctggagataccaagcacgagtgcagcaatggcgcatcccatgcctcccctctcagcatcacagagcacaatcaccaccgttctgaagatccttccaaaacctcctgctgctccggagagcagaagcaataattgtgcttttggggccaaattcgacagtaggagggcacttctatgcggcttggtcgctgctgctgctgctgctggcaccatgctgggcgctgacatcgctggtgctgcttcgaagaggcggcctccaccgccagcgccggcagaggcgaagaaagacccgaacgtcagcggagtgcaggctaaagtgcttgctagcaggaagaggaaggaggccatgaaggaagctgtggccaagctgagggagaaaggtaagccggttgataagtgaaggccagaaccagtgacccttgatcaagaaatgtaacttattgttaaataatatactccctctattcttctaaagtaataagccattaatttgaatagtctactcactttatgtgtacagatgagaataaaaatacaactattttgcttgta

SEQ ID NO: 4585 - DNA, 1382 bp, Zea mays
acagctccttcctgttcctggagataccaagcacgagtgcagcaatggcgcatcccatgcctcccctctcagcatcacagagcacaatcaccaccgttctgaagatccttccaaaacctcctgctgctccggagagcagaagcaataattgtgcttttggggccaaattcgacagtaggagggcacttctatgcggcttggtcgctgctgctgctgctgctggcaccatgctgggcgctgacatcgctggtgctgcttcgaagaggcggcctccaccgccagcgccggcagaggcgaagaaagacccgaacgtcagcggagtgcaggctaaagtgcttgctagcaggaagaggaaggaggccatgaaggaagctgtggccaagctgagggagaaaggtaagccggttgataagtgaaggccagaaccagtgacccttgatcaagaaatgtaacttattgttaaataatatactccctctattcttctaaaaaaaacctcgtgttcgttcggagcgcacacacacacaaccagatctcccccaaatccacccgtcggcacctccgcttcaagatgcagatctttgtgaaaaccctgaccggcaagactatcaccctcgaggtggagtcgtctgacaccattgacaacgttaaggccaagatccaggacaaggagggcatccccccagaccagcagcggctcatcttcgctggcaaacagcttgaggacgggcgcacgcttgctgactacaacatccagaaggagagcaccctccaccttgtgctccgcctcaggggaggcatgcagatctttgtgaaaacccctgaccggcaagactatcaccctcgaggtggagtcctctgacaccattgacaacgtcaaggccaagatccaggacaaggagggcatcccctccagaccagcagcggctcaatctttgctggggaaacaacttgaaggacagggcgccacgcttgcccaactaacaacatccagaaaggaaatcacccctccaacttggtgcttgacgccttcaggggaaggcaattgcaagatctttcgttgaaaaaaccctggaccggggaaaaaaaaaatccacccctccaaaggtgggaagtacttcgggaacacccaagtggaacaaacggccaaggggctaagaaatatcaggtaaacagggagggggcatttcccaccaaataaatagcgagggaggcattaaatcctttggatggcgaaaggcaacctcgataaggaccgggggcctacacctagggcgagaagtaacaaagaaatcgtaaaaaggagaaggcaaaccattccgcagtggtctgccgcgatctccacgagggagggagagccagtgtacaaaccactctggcaa

SEQ ID NO: 4586 - DNA, 1810 bp, Zea mays
ccgcatcccattccgtgccaccgccgccgcgctgcgtctgcgtctgcctgcgtcgcccgcagtgtccgcagccagaaccagcgcacgcgctgctccgccgacgccgaagcctcgtccgcgagcgcgtggctaagcaagcactcgagctccctccagcggcgggtgcagtgcagccaggccgcgcgcgccgcagcatgaacggcgtcggcgacgcgcacgcggccgcggccgcggccgccatggtgcagcaaacgctggggatgtcgctgccgatggcggcgttcgtgcccgagcagggcagcgccaataggctgaccaggccgccggggctgccgccgctgccgcaggcgttcgcggcccagcagcgcggggacgtgtgcatggaggccgtcgaccccgcggctggcccgcgcaaggcgcaccggcgctcccgcagcgacgtcccgttcggctacttcccgccggcgggccaccaccagctcccgccgcccaaggtggaggccggctggggcggccacctccccgccggcggcggcggcggcggcgacgacgacctgttcaacgcgtacctcaacctggaggggctggacgggctcaactcctccgacgaccgcctcgacgacggggacagccgcggcagcagcatgaggaccaacggcgccgacagcagcgagaacgagtcggaggagtgcgccgccgacagccgcgccgggatccgcctctgcgccgccgctgccgacaggcgggaggggctcaagagggccgccgctgcgcccgtggcgcgccacgccaggagcctgtccatggatagcctcatcggcaagctcaacttctccgccggcgcgacgggcgccgctagcggcgtcattccgggacccaacaggttcagcctcgagttcggcaccggcgagttttcgccggtcgagatgaagaagatcatggccgacgagaagctggccgagatggcgctcgccgaccccaagcgcgtcaagagggtgctggccaacaggcagtcggcggcgcggtccaaggagcgcaagatgcgatacattggcgagctggagcacaaggtgcagatcctgcagacggaggccaccactctctccgcccagctcacgcttcttcagcgggactccgcggggatcgcgacgcagaacaacgagctcaagttccggctgcaggccatggagcagcaggcgcagctgcgtgacgcattgaatgaggcactgacagccgaggtccaacgcctgaaggtcgcgaccgcagagctcggggattcttgctcgtccagcaacctagcccagcagatccaaatcagcgttcaggaccagatgtttcaactgcatcagcagcaggcaacgcctataccgttctaccagctgcagcaggcgcagcagaatggcgcagggaagaagcatgagccgacggaatgatctcagacctgccattatccaccgctgcgtgagcaggggaaaaaaagatcggtttcgatggactgaaaacatttcttttcctaactcattggttaagtgtcgttaataagcaccgtgcatttttttccaggtgatgaacctgctgcttgtacctgtttatttattctttggatgattcagttgcttgagttgccaaactgatcaaattgtagccggttaatattcttttatagttgtagtgtttatggatgcttttgcactttggtaccttacgttgacttttattcttgagttatttttgacttttctatattatgtctgaatatatagaaaatcaactgtatataaaaagccaaatccttttatagtttgaagtc

SEQ ID NO: 4587 - DNA, 873 bp, Panicum virgatum
  misc_feature (788)..(788): n is a, c, g, or t
gcacgccacgccaggagcctgtccatggacagcctcatcgggaagctcaacttctcggcaggcgccatgcccagcggcggcgtcatgccggggcccaacaggtcagcctcgagttcggcagcggcgagttcacaccgtcgagatgaagaagatcatgccgacgagaagctggccgagatggcgctcgccgaccccaagcgcgtcaagagggtgctggccaacaggcagtcggcggcgcggtccaaggagaggaagatgcgctacattgcggagctggagcagaaggtgcagatcctgcagacggaggccaccactctctccgctcagctcacccttctccagcgcgactcggcagggatcgcgacgcagaacaatgagctcaagttccggctgcaggccatggagcagcaggcgcagctgcgtgacgcactgaatgaggctctgacagccgaggtccagcgcctgaaaatcgcgactgcagagctcggcgattcttgctcttccaacaatctggcccagcagctccaactcagtgctcaggaccagatgtttcaactgcagcagcagcagcagcaggttacaccgatcccgttttaccagctgcagcaggcacagcagaacggtgcagggaagaaccaggactcaacggaatgagctcagaggcatggtcgactgcttcatggggaaaaacaaatggagtatcgctctagatgaactgaaagaatttgatttcctaactcatggtttttaaatgtcgttataatcaccgtgtatttttcagtgatgancctgcttgtacttctctatgtttatttattctttggatgatacagctgttgtttgtgaccaaactgatcaaagagtagctgattc

SEQ ID NO: 4588 - DNA, 1546 bp, Oryza sativa
atgaacggtggcattggcgacgcgctgatgcagccgcagcacgtgcaggtcatgtcgtcgtcgttgccgatggtggcgtcgacgttcgtggcggagccggcggcggcggccaacaagccgagggccgcggggctgccgcccacgccgccgcaggtgttcgccgcccagcgcgcggcggcggcggcgggcggcgacgtgtgcatggaggagtcggcgcaggggggtggtggcgggctgccgccgcgcaaggcgcaccgccgctccagcagcgacgtgccgttcgggtacctggccgggcagcaccagctcctgccgcccaaggtggaggccgggtggggccacctcggcgccggcgccggcggcgcggcggccgccgatgacctgttcaacgcgtacctgaacctggaggggctggacgggctcaactcctccgacgaccgccacgacgaaggggacagccgcgggagcagcatcaagaccaacggcgccgacagcagcgagaacgagtcggaggagtgcgccgacgacacccgcggcgggatccgcctctggtccgccgacggcggcgagaggagggagggcgtcaagaggaacgccgcgggggagccggccaccgcgccgctggcccgtcacgccaggagcctctccatggacagcctcatcgggaagttcaacttcacggcggggacggcggcggctgcggggaacggtgtcgcgttggggccgaacaggttcagcctggaattcggcagcggcgagttcaccccctccgagatgaagaagatcatggccgacgagaagctggccgagatggcgctcgccgacccaaagcgcgtcaagagggtgctggcgaacaggcagtcggcggcgaggtccaaggagaggaagatgaggtacattgcggagctggagcagaaggtgcagatcctgcagtcggaggcgaccaatctgtccgcgcagctcacgatgatgcagcgcgactcggcggggctcgcgacgcagaacaacgagctcaagttcaggctgcatgccatggagcagcaggcgcagctgcgcgacgcgctgaatgaggccctgacaaccgaagtccaacgcctaaaactcgccaccgctgagctcggcgattcttgctcgtccagcagtctagctcagcagatccaactcaatgctcagaatcagatgtttcaactgcagcagcagcaggctacgcagataccattctatcaactgcagcagtcacaacagaacggtgcagcgaagaacaatgaatcaaaagaatgattccagaggcattttgggctggttcatggaaagagaatattggtttagatgagcgcaattcgcatattcctaactcatttgttttaatgttgttaataatcaccttgcatttttctagtaggtggtggttggtgaacctccttttacctttctatgttcattgattctttggatgatacagttgtcatttttaagttaccaaactgatgaagttgtaggtgattgttattcttttgtactaatatctatgtcgagtattttgagt

SEQ ID NO: 4589 - DNA, 1026 bp, Zea mays
ccgcccgcggtgtgcatggaggcgttcgcggcccagcatcagggggacgtgtgcatggaggccgtcggcgtcgacaccgcggcgcagcagggcccgcgcccgcgcacggcgcaccggcgctcccgcagcgacgtcccgtccgggtactacttcggcggcgaggggcaccagctgccgccgcccaaggtggaggccggatggggcgggcacctccacggcggcgggggcgacgacgacctcttcaacgcgtatctcaacctggaagggctggacgggctgaactcctccgacgaccgccggcagtactacgacggcgacagccgcgggagcagcgtgaggaccaacggcgccgacagcagcgagaacgattcggaggagtgcgccgccgcaggcccgcccgtggcccaccacgtcaggagcctgtccatggacagcagcctcatcggcaagctcaacttctccgccggcgcggctgcggccaacggcggcgtcattccggggcccaacaggttcagcctcgagttcggcagcggcgagttcacccccgtcgagatgaacaagatcatggccgacgagaagctggccgagatggcgctcgccgaccctaagcgcgccaagagggtgctggccaacaggcagtcggcggcgcggtccaaggagcggaagatgcgatacatcgcggagctggagcagaaggtgcagatcctgcagacggaggccaccgctctctccgcccacctcacgcttcttcagcgggactccgcggggatcgcgacgcagaacaacgagctccagttccggctgcaggccatggcgcagcaggcgcagctgcgtgacgcattgaatgaggcactgacagccgaggtccagcgcctgaaactcgcgactgcagagctcggcgactcttgctcgtccaacagtctagcccagcagatgcagatccaactcagcgcgcatgaccagacgttcgaactgcatcagcagcaggcgatgccgatagcgttctaccagctgcggcaggcgcag

SEQ ID NO: 4590 - DNA, 1395 bp, Glycine max
accatagttggtgttagtcttggtgtagtgtagctagggagggatatatatctgagtaagatggcatcagagcttgaattgcccccaggcttcagattccatccaacggacgaggagctggtgttgcactatctctgccgcaaatgcgcgtcgcagccaatcgccgttcccatcatcgccgaaatcgacctctacaaatacgacccctgggacttacccggattggctacttatggagagaaagagtggtacttcttttcaccacgggaccggaaatacccaaacggttcgaggccgaaccgggcggctggcaccggttactggaaggcaaccggggcggataagcccattggtcagcccaaaccggttgggattaaaaaagctttggtgttttacgcagggaaagctcctaaaggggacaaaagcaattggatcatgcacgagtatcgtctcgcagacgtagatcgctccgttcgcaaaaagaacaccctaaggttggatgattgggtgctttgccgtatttacaacaagaagggcacgatcgagaaactgcaaccaagcagcgatgttgctcatagccgaaatatcgaatcctcggagatcgaagacaggaagccggagattctgaaaagcggaggaggttgtcttccgccgcctgtgccggtgcctgcgccgccgcaagcgacggcgaagacggattacatgtacttcgacccgtcggattcaatcccgaagctgcacacggactcgagctgttcggagcaggtggtatcgccggaattcgcgagcgaggtgcaaagcgagcccaagtggaacgagtgggagaaaagcctcgaatttccatttaattacgtggatgccactctcaacaacagcttcatggcccaattccagggcaataatcagatgttgtcgccgctgcaggacatgttcatgtactggcccaacaagtccttttgagcacatcatgatggttttaaattacgatccgcaattgctcttaagattttctgactcaccatgcgaccacaatcgtaatttaaaaccatgtcacataaaatccacgcgcgccgcccattcgcatttgcacggtagcacgagactcaaggtccatgagtgtgcctgtgcgaccacacacatacgattattgatcaagttagcttagctaggccaaagtaagaaagaaagaaacattgaagctggaaacgcatgtgttggctccaccgtttgctttggtattttgctatgtgatgatgacgacgacgatccaacggtgcatgtgtgttgacctgttcctagtagtagtagtagcatgtgtacagctattgtagaatgtagataggtacactactacacgttgttgtcatgtgatcatagaaaggtctctcaccgtac

SEQ ID NO: 4591 - DNA, 1490 bp, Lotus japonicus
aagtttcaagcgccgccaccgttgttcttcttagtcttcttcaatcttcatcagagagagccaccaaaccaatctcagttgaaaaatggcatcagagcttcaattgccaccgggtttccgattccatccaacggatgaggagctcgtgctgcactatctctgccgcaaatgcgcgtcgcagccgatcgctgttccgatcatcgctgaaatcgatctctacaaatacgatccttgggaccttcctggtttggcttcgtacggagagaaagagtggtacttcttttcacctcgggaccggaaatatccaaacggttcaaggccgaaccgggctgcgggaaccgggtactggaaggcaaccggggcggataagcccattggtcaccctaaaccggttgggatcaagaaagccttagtgttttatgctgggaaagcacccaaaggtgacaaaaccaattggatcatgcatgagtatcgtcttgccgacgtagatcgctccattcgcaaaaagaacagtctaaggctggatgactgggtgctgtgccgcatttacaacaagaagggctcgatcgagagacaaccaagcggcgccgtttacagcgtcaagacggagtcatcggaactggaaaagcggaagccggagattctgacccgcgctgccgggtgccttccaccgccgcatccgccgcaagcgccggcggcgggcgtgacggattacatgtattttgacgcgtcggattcggtcccgaagctgcatactgactcgagctgctcggagcaggtggtgtcgccggagttcgcgacggaggtgcagagcgagccgaagtggaacgagtgggaaaagagcctcgagtttccttataattacgtggatgccactctcagcaataacaacagcaacaacaacggatttgggtcccagtttcagagtggtaatcagctgtcgccgctgcaggatatgttcctgtacatgcccaagccgttctaagcattgaaaatttgaaactcagaacacaatctatgccgcaagatgcatcgcacggtagcacgagactggaggtccatgagtgtgcctgtgcgagtgtgtaggtgataaatttagataaggcaaaggaggagaaagaaagaaaatgaagatgaaaatgcacatgttggtccaccgtttagcaccgatgggtttggttggtggcggtaggatgaggatgatccagcggtgcatgttggatctgtctgtgtctaggatttacatgtgtatagctagcttagcttagctactgtagaatgtagataaggtacaaaacactatgtcatgtcatcagatctaagtccgactttctaattaatatttgttgaattgaattaatactagtgtttgttccatcttattgatcgtagtttttttttctttttaattttctttgtttcttttttcttgtgatcaatcactttgatatgaaaattttgattcaccctagcagaatatgatataaatt

SEQ ID NO: 4592 - DNA, 1411 bp, Cicer arietinum
atggcatcagagcttcaattgccgccaggcttcagattccatccaacggatgaggagctcgtcatgcactatctctgccgcaaatgcacttcgcaacccatctctgttcccatcatcgccgaaattgacctctataagtacgatccttgggatcttcctggcatggcttcttatggagaaaaggagtggtattttttctcgccacgagacaggaaatatccgaacggttcgaggccgaaccgggcggctggatccggatattggaaggcaaccggggcggataaacccataggtcacccgaaaccggttgggattaagaaagcgttggtgttttacgcggggaaagcgccaaaaggtgataaaacaaattggattatgcacgagtatcgtttggctgacgtggatcgctccattcgaagaaagaacagcttaaggctggatgactgggtgctttgtcgtatttacaataagaaaggcacaatcgagaaacaaccgaacagcggtgttataaacaggaaaacagacccctcggaaatcgaagacaagaagccagagattctgacacgtggaagcggtcttccgccacaccctccaccgcaagcgacggcgggaatgagggattacatgtatttcgacacatcagattcaatcccgaagctgcacacggactcgagctgttcagaacacgtggtgtcgccggagtttgcaagcgaggtgcaaagcgagcctaaatggaacgaatgggaaaagcaccttgaatttccttataattacgtggataccactctgaacagtgttttcggttcccaattccagagcaataatcagatgtccccgttgcaggatatgttcatgtacttgccaaaaaccttttgagcatttgaaagatgaaactgaaatacatgtgacacccaatcaatcgctgtaacgcatcgcacggtagcacgagacgagagtccatgagtgtgcttgtgccaatgcgtacaatattatttgattaaatttcctaagcatgagtcgatagaaatttgagaagggaacatttaaaaaaatgcatgtgttgggcctactattatcaagtgtttatggtaccaccctattgaaccgttttacccatctctaggattagcatgtgcatagttattgtaggatttagatagataaggtacaaaacatgtttcatgtgatcatagaatagaatatcatttacgacaacctaaattaatacacagtcactttgtgcttctattctatatattcagcattagtatagtaggactgccccaccttatttagtattagtaggatgcatgtttttctggttgcttattccgacacctattatgtgtacttgtcaatttttcatattctgttttgataacaataaaatacaatgcagttaatagtttga

SEQ ID NO: 4593 - DNA, 1457 bp, Phaseolus coccineus
gagggatatagggagaaccagagatcaatctcagggtagaaataatattcttagagcaaaaacatggcatcagagcttcaactgcccccaggcttcagattccatccaactgacgaggagctcgtgatgcactatctctgccgcaaatgcgcctcgcagcccatcgccgttcccatcatcgccgaaatcgacctctacaaatacgacccttgggaccttcccggattggcttcttacggagagaaggagtggtacttcttttcaccgcgggaccggaagtacccgaacggttcgaggccgaaccgggcggcgggaagcggttactggaaggcaaccggggcggataagccaattggtcagccgaaagcggttgggataaagaaagcgttggtgttttacgctgggaaagctccgaaaggggacaaaagcaattggatcatgcacgagtatcgtctggctgatgtagatcgctccgttcgcaaaaagaacagcctaaggttggatgattgggtgctgtgccgtatttacaacaagaagggcacgatcgagaaattacaaccgagcaccgacgtagttgtgagccggaaaatcgaatcgccggagatcgaagagaagaagccggagattctgaaaggcggaggaggtcttccgccggcgatgacggattacatgtacttcgacccgtcggattcaatcccgaagctgcacacggactcgagctgttcggagcaggtggtttcgccggaattcgcgagcgaggtgcagagcgagccaaagtggaacgagtgggagaagagcctggagtttccgtattacatggataccagtctgagcaacggcttcagccaattctcgagcaataacaacaacaacattcagatgtcgccgcttcaggacatgttcatgtactggccaaagcccttttgattttcacacccccacaacagattcctacgtcgcccacggccacacacagcaccacgcattcgcattgcacggcagcacgagactgaaggtccatgagtgtgcctgtgcgatcacgcacacgattattgattaccggaggctttgggctgagaaaaatgtaaaaaaagtttggagggcatgtgttgggtccagcgttggggttgggtatgttggtatgcgatgaagacaatcgaacggcgcatgatggagttgtccctagtagtagcatgtgtacagctcttgtagaacatagataggtacactacaggttgtcttcatgtgatacaagctcctctcaccaaaacaccaaatgtgaaacctcaattcccaccttctaatttatatttctttaatcatatatatgttattattactatttcatatttggtcgcaatctcaagttttaacttcaagatgaaccaatccatgtgtggtgggactcgtagtttttatatgaaggctaaggtgtgacatttatttctcatttttcc

SEQ ID NO: 4594 - DNA, 1820 bp, Medicago truncatula
cacgtgtattctagaaaaaactagctactacaagcacgtgtcacctctattgttgcctataaatacacgtctctcccttatgtgataagtttcaagcgccgccaccgtagttcttcttagtattcttcatttcataaactagggagaaccatacatacaatatagattgattaaattcaaaaatcatcaaatcttattagcaagcaaattcagtttagcaattatagctgaaaaaacaatggcatccgagcttcaattgccaccgggcttcagattccatccaacggatgaggagctcgtgatgcactatctctgccgcaaatgcacgtcgcagcctatcgccgttccgatcatcgccgaaattgatctatataaatatgatccttgggacctcccaggtatggctacttatggagaaaaggagtggtactttttctcgccacgagacagaaaatacccaaacggttcaaggccgaaccgggcggctgggtctggatattggaaggcaactggggcggataaaccaataggtcatcctaaaccggttgggatcaaaaaagcgttggtgttttacgcgggtaaagcacctaaaggtgataaaaccaattggatcatgcacgagtatcgtttagctgatgtagatcgctccattcgaaaaaagaacagcttaaggttggatgattgggtgctttgccgtatttacaacaagaagggtacaattgagaaacaaccaagcaacagtgttgtcaaccgaaaaactgaacattctgaaattgaagacaggaagccggagattgtgacacgtgggggcggtcttccgccacatccaccgccgcaaactacggctggaattagggattacatgtattttgatacatcagattcgattcctaagctgcacaccgattcgagctgttcggaacaagtggtatcaccggagtttgcaagtgaggtgcagagtgagcctaagtggaacgagtgggacaagaatcttgagtttccttataattatattgatgccactctgaacactggttttggctcccaattccaaaatactaatccattgcaagatatgttcatgtacttgcccaaaaccttttgagcatttaaagataaagcacacttttgattggtcaggagtttgacaaaatcacgatatcatcttgattctgttaatcttgctatcaatccaacatgccgggtgccaccatgattctgtcaatcttatggtcaatccaaacatacacacagatgcattgcacggtagcacgagacgaatgtctatgagtgtgcctgtgcgagtgtgtgcatacaatattgttatggattaaattttcccaagtccaagccagagaaaattacaggaaagggaaagtttaagacaaaatgaagctgcaaatgcatgtgttggggctactattgtgcactgttttggtacgtccctatatgatctggatgaaccggtgcatatttcacctgtctctaggattagcatgtgcatatagttattgtaggatgtagatagggtacagagcatgttcatgtgatagaatgtcaattacgacattcttgattaatacatctcagtatgcattttctactctctataattagtagtaatggtcaagttaaagaaaatagcattagtaggactgcccctttcctctttttttttttttaggtcgtttattgcgacacttattatgttgtgtatttcttaatttcatatttgccttattactaccaggtttatgtttagctttttaataatactattatcttgctaaaaagagaaataaaacataaattttatattg

SEQ ID NO: 4595 - DNA, 1821 bp, Medicago truncatula
cacgtgtattctagaaaaaactagctactacaagcacgtgtcacctctattgttgcctataaatacaccgtctctcccttatgtgataagtttcaagcgccgccaccgtagttcttcttagtattcttcatttcataaactagggagaaccatacatacaatatagattgattaaattcaaaaatcatcaaatcttattagcaagcaaattcagtttagcaattatagctgaaaaaacaatggcatccgagcttcaattgccaccgggcttcagattccatccaacggatgaggagctcgtgatgcactatctctgccgcaaatgcacgtcgcagcctatcgccgttccgatcatcgccgaaattgatctatataaatatgatccttgggacctcccaggtatggctacttatggagaaaaggagtggtactttttctcgccacgagacagaaaatacccaaacggttcaaggccgaaccgggcggctgggtctggatattggaaggcaactggggcggataaaccaataggtcatcctaaaccggttgggatcaaaaaagcgttggtgttttacgcgggtaaagcacctaaaggtgataaaaccaattggatcatgcacgagtatcgtttagctgatgtagatcgctccattcgaaaaaagaacagcttaaggttggatgattgggtgctttgccgtatttacaacaagaagggtacaattgagaaacaaccaagcaacagtgttgtcaaccgaaaaactgaacattctgaaattgaagacaggaagccggagattgtgacacgtgggggcggtcttccgccacatccaccgccgcaaactacggctggaattagggattacatgtattttgatacatcagattcgattcctaagctgcacaccgattcgagctgttcggaacaagtggtatcaccggagtttgcaagtgaggtgcagagtgagcctaagtggaacgagtgggacaagaatcttgagtttccttataattatattgatgccactctgaacactggttttggctcccaattccaaaatactaatccattgcaagatatgttcatgtacttgcccaaaaccttttgagcatttaaagataaagcacacttttgattggtcaggagtttgacaaaatcacgatatcatcttgattctgttaatcttgctatcaatccaacatgccgggtgccaccatgattctgtcaatcttatggtcaatccaaacatacacacagatgcattgcacggtagcacgagacgaatgtctatgagtgtgcctgtgcgagtgtgtgcatacaatattgttatggattaaattttcccaagtccaagccagagaaaattacaggaaagggaaagtttaagacaaaatgaagctgcaaatgcatgtgttggggctactattgtgcactgttttggtacgtccctatatgatctggatgaaccggtgcatatttcacctgtctctaggattagcatgtgcatatagttattgtaggatgtagatagggtacagagcatgttcatgtgatagaatgtcaattacgacattcttgattaatacatctcagtatgcattttctactctctataattagtagtaatggtcaagttaaagaaaatagcattagtaggactgcccctttcctctttttttttttttaggtcgtttattgcgacacttattatgttgtgtatttcttaatttcatatttgccttattactaccaggtttatgtttagctttttaataatactattatcttgctaaaaagagaaataaaacataaattttatattg

SEQ ID NO: 4596 - DNA, 1505 bp, Arachis hypogaea
gaagcgcagccgtagttcttcttagtctttcagagaggcgaaaagcttcttatctaccttcaccagatctcactaaagtatctcagttctttcaaaaatggcatcggagcttcaattgccgcctggatttcgattccatccaacagatgaagaactcgtgttgcactatctctgccgtaaatgcacttcacaaccgattgctgttccgatcattgccgagatcgacctttataaatatgatccctgggaccttcctggtatggcttcttatggtgagaaggagtggtattttttttcacctagagatagaaaatatccgaatgggtctagaccgaatcgggctgcaggaactggttactggaaggcaaccggagccgataagcctattggacaacccaaaccagttgggattaagaaagctttggtcttttactctggaaaggctcccaaaggagataagaccaattggattatgcacgaatatcgtcttgcagacgtagatcgttctgttcgcaaaaagaatagcctcaggctggatgactgggtgctgtgtcgcatctacaataagaaaggatcaatcgagaagcaacaaccgagcagcggcgtcagtaccgtcgtgaaccagagggccgaatcttcggaagtcgaagacaagaagcccgatatagttccacgtggcggcggcgggggcgtacttccaccgcatcctcctacggctcaggcttcggcaggcggcgtgacgacagattatatgtacttcgacaactccgattcagttccgaagcttcacacggactcgagttgctcggagcaggtggtgtcgccggagtttgcgagcgaggttcagagcgagccaaagtggaacgagtgggataaaaacctcgaaagtgcgtataattacctcgatgccacactcacgaacggttttgggttcccgttccagggtaacaatcagatgtcgccgcttcaggatatgttcatgaaccttccgaaaccgttctgaacgcgctagtaatagtagaacaccagagaaagaatctttttatggaaaacctttgatatgcactatggtgcattccacggcagcacgagacgttaaggtccatgagtgtgcctgtgcgggtgcgagtccatggatgggtcaacgagatggaacagcaaggggagaatctgaagaagggaaaatgaaaaaaatgcatgcgttaggtgtgcagcattgtgcgcccattgatttgggtcgtgggattagaatatcgtttggggagtctgacggtggatgttgggtagtcgctaggttcgctaggttgggctgtgtatagtttattttgtacaatgtagagtgtaagaccggagggggtaaactatacggtggatggtggtgtatgtttccatctatttatgattagttaatataaatggttaattttattcaaaaaaaaaaaaaaaaaaaaaaaaaaaaaataaaaaataatatatatttttataattttttaattttttataat

SEQ ID NO: 4597 - DNA, 1975 bp, Glycine max
acacttctgaacagtattttgtctgaaactgaatagagcagaagaaagaaacacttgaaacttgcacgactcaactacaatcgcgttcgatttctcttattatgaacctctctctatgcaattcttcaaaccttaacacctcaagaaaaccattgatggcactccctcactccatctctgccttagccaccacactcacactctcctcgccaacaaccaaaccccagaaagttaacccctttccctttttctcgaaccaaaagacacgatttttaacgaaacaaacgcgacccagaagcagaagaagcctctccctaacccctgcacgcgttgcggcgccaccctcaactgttgaagccgatcaatcatacccggagaccgaaaataacgaaactgaggaagagtttaacgatgaaagctcttattctaaattcacttggagggatcactggtaccctgtttcgttgatcgaagatctgaaccctctcttgcccacaccgtttcagcttctgggtcgtgaaatcgtgctctggtacgacaagtccatttcccaatgggttgcttttgatgacaaatgcccccatcgtcttgcccctttgtctgaagggaggattgatgaagatgggaagttgcagtgttcttatcatgggtggtcttttgatgggtgtggatcttgtgttaagatacctcaggctgcatctgaaggccccgaagcacgtgctattggatctcctaaagcgtgtgccactaggttccctaccatggtgtctcagggcttgctcttcgtttggcctgatgagaatggttgggagaaagcaaaggcctccaagcctccaatgttgcctgatgactttgacaaaccggagtttgccacggtcaacattcagcgtgatctgttctatggttacgatactctcatggagaatgtctctgatccttctcacattgagtttgctcatcacaaggtcacaggaaggagagacagagccaagcctctgccattcaagatggattctcgtggttcatggggcttctctggagctaatgaagggaacccacagatcagtgccaagtttgttgcaccatgttatatgatgaacaagattcagattgataccaaactccctgtagttggtgaccagaaatgggtagtatggatatgttccttcaatgtccccatggcacccggtaagactcgctccatagtttgcagtgctcgaaacttcttccagttctcagtgccagggccagcctggtggcaagtcgttcctagatggtatgagcattggacttcaaacaaggtatatgatggagacatgattgttcttcaaggccaagagaaaatcttcctttcagaaaccaaggaaggtggagacattaacaaacagtatacaaacatcaccttcacaccaacacaggcagatcgctttgtcttggcatttcgaaactggctaaggcggcatggcaatggccaaccagaatggtttggcaacagcagcgaccaaccattgccatcaactgttttatcaaaacgtcagatgttggatagatttgaacagcacactctcaagtgttcatcatgtaaagcagcatatgagggattccaaacatggcagaaagtcctaattggtacaacagttgtgttttgtgcaacatcagggatcccatcagatgtccagttgcgtgtacttttggctggactcgcaattgtcagtgcagccataacttttgccctaaatcaactccaaaagaattttgaattcgtggattacgtgcatgccgaaattgattaaacacttccctccaaaggaacttctactagttagttgtaaatagagttgaagacaaaaatacatgtatactagtattttgatgaaagagctcaaatcttcctatccttggtgttactagtattttgatgaaaagagcaacaaagttgatcgtgagatatcctttttgaataaaaatttaatca

SEQ ID NO: 4598 - DNA, 1828 bp, Vigna unguiculata
acggggggtacaattcctcgaaccttaacgtctcagaaaaattaactacaaaaccattgatggcactcccgcactccatctctgcgttatcaaccacactcacgctttcctcctcagtgaacaaacccactaccaacaaagtgaattcctttcccttcttgtcgaacaagggcacgcaatttttcacgaaacaaactcgacccagaagcggaagaagccccttgcttacccctgcacgcgttgcggcgccaccctcaacggttgaaaccgatcaatcgttccctgaaacggaaaagggggagactgaagaagagtttaacgaggagagctcttcctcgaagttcacctggagggatcactggtaccctgtttcgttaattgaggatctgaaccctctcttacccactccgtttcagcttctgggtcgtgaaatcgtccgtacgacaagtccacttcccaaatgggttgcttttgatgacaaatgcccccatcgtcttgcccctttatcagaaggaaggattgatgaagatgggaagttgcagtgttcttaccatgggtggtcttttgatggttgtggatcttgtgtcaagattcctcaggctgcatctgaaggtccagaagcacgtgctgttggatctcctaaagcgtgtgccactaggttccctactctagtgtctcagggattgctctttgtttggcctgatgagaatggttgggagaaagcaagtgcctccaagcctccaatgttgcctgatgagtttgaaaaaccggagtttgccactgtcaatattcagcgtgatctgttctatggttacgatactctaatggagaatgtctctgatccttctcacattgagtttgctcatcacaaggtcacaggaaggagagacagagccaagcctctgccattcaagatggatgctcgtggttcatggggcttctctggggcaaatgaagggaaccctaagatcagtgccaaatttgttgcaccttgttactatatgaacaagattgagattgataccaaactccctgtagttggtgaccagaaatgggttgtgtggatatgttccttcaatgtccccatggcacctggtaagactcgctccatattcagtgctcgaaacttcttccagttcacagtgccagggcctgcctggtggcaagtagttcctagatggtatgagcattggacttcgaacaaggtatatgatggagacatgatagtccttcaaggccaagagaaaatcttcctttcaaaaaccaaggaaggagatgacattaacaaacagtacaccagcatcaccttcacaccaactcaggcagatcgctttgtcttggcatttcgaaactggctcaggcgacatggcaatggccaaccagaatggtttagcagcatccccgacctgccattgccatcaacagttttatccaaacgtgagatgttggatagattagaacagcatactctgaagtgttcatcgtgtaaagaagcttatgagggattccaaatatggcagaaagtcctaattggtgcaacagttatattttgtgcaacatcagggattccagcagatgtccagtttcgtgttcttttggctggacttgcaattgtcagcgccgccttagcttttaccctaaaccagctccaaaagaattttgaatttgtcgattacgtgcatgcagaaatcgaatgaacactgatttccacgttaattgtaaatagagttgaagaaaaattacatgtattcatactattttgatgaaagagctcaaatctacataaccttggttttacccttaaattcaatgaacaaacaattacagc

SEQ ID NO: 4599 - DNA, 1915 bp, Medicago truncatula
ttgcacgtctcaaacaattcttgttcatatatataaatttcttccacacttcacaaattcagaacttctaaacaaaaaaacaccattgatggcactttcacccacactttcacctttagcaacactttcatcatcaacaccaagaaacaaaccaccaaaaccgtttctcttttcatccttcacaaaaaagtcacaatttttaacaaattcaacaagacccagaaacagaaacagaagaaaccttttagtaacagttagaagtgttgcagcaccacccacaaaaactgaatcgtacccagaagctgaaaagaacgaaattgatgaagaatttgaagatgagagttcttcatcgaagttttcatggagagatcattggtacccagtttctttgattgaagatctggattctagtttgcctacgccgtttcagcttctgggtcgtgaaattgtgatttggtttgataaagctaattctcaatgggttgcttttgatgataaatgtcctcatcgtcttgctcctttgtctgaaggaaggatagatgaaagtggaaacttgcagtgttcttatcatgggtggtcttttgatggacgtggaggttgcactgtgatccctcaggcttcacctgaaggtcccgaagcacgtgctgttgggtctcctagagcttgtgctactaggtttcctaccttggtgtctcaggggttgctctttgtttggcctgatgagaatggttgggagaaagcaaatgcatccaaacctccaatgttgcctgatgactttgtaaaaccagagtttgcaacggtgaacattcagcgcgatcttttctacggctatgatactctcatggagaatgtttctgatccttctcacattgattttgctcatcacaaggttacaggaaggagagacagagccaagcctcttccattcaagatggattcacgtggttcatggggcttttcaggagctaatgaagggaacccacggatcagttccaaatttattgcaccatgttactatattaacaaggttgagatcgataccaaactccccgtcgttggtgaccagaaatgggtaatatggatatgttccttcaatgtccccatggcacctggtaagactcgctccatcgtttgcagtgcccgaaatttcttccagctcacggtgccagggcctgcctggtggcaagtggttcccagatggtatgaacattggacttcaaacaaggtatatgacggggacatgattgtacttcaaggtcaagagaaaatctttcttgcagaaacagagaatggcggtgacattaacaaacagtacacaagcctcaccttcacaccaacacaggccgatcgttttgtgttggcatttagaaattggctgaggcgacacggcaatggccaacctgaatggtttggtaagagcagcagccagccattgccttcaaccgtactatcaaaacgtcagatgttggatagatttgaacaacacacactgaagtgttcagcttgtaaaggagcttatgagggattccaaacatggcagaaaatcctgactggtgcaacagttgtgttttgcgcgacttctgggattccatcagatactcagctgcgcataattttggctgcactcgcgcttgtcagtgcagccttagctttttccataaaccaactgaaaaacaattttgttttcgtcgattatgtgcacgctgaaatcgattgaacgtgttattactccaaaggttttattactagttgcaaattgtaaatgttagagatgaggacaaataaccacgtgtatgttaatatgtgtatatattttcatcaacggagtttagatctaccttgatgttaatgttaacatgtgtataacaatgtgacattagactacaaatacacaatatgaaacttcttttttcat

SEQ ID NO: 4600 - DNA, 892 bp, Glycine max
gagagagatcattctagagacagagagaaattagcttcagtagatattagtggtgggtatgtgtgtgtgtgggtttgggtttcaagagaggagacatgcttaacttcaacccaacacttcaagtacttgcttcttcatacccttaccagatcccaaaggtcacgatctaattttaagtgattagtctgatgagcattttgaaggttacatgaagcaatttctctttttgaatcttcctgacaccgagatcaattgttcacaagttgattgcaatcactcaatggctcattcttcttatccctacggcgatccaattcttgcttatggaccacaagctattagtcatccccaaatggtaccccagatgctgggactagcatccaccagagtggcattaccacttgatcttgctgaagatggaccgatttatgtcaacgcgaaacaataccatggtatactgagaaggcgacagtcacgagcaaaacttgaggctcagaacaaacttatcaaaagtcgtaagccatatcttcatgagtctcggcaccgccatgctttgaatagggttaggggatctgggggtcgatttctgagtaccaaacagcttgcacagtctaatgcagaatttgtcaccggtgcacattctggttctgaccctaccaacatatatcagaaagaacatccattagaggtggaaagtcattcctcaaaagatggagataatgcatcattcataacaacctactccgaccggccatgtttatctggcaacaacctcaattttcggcagcaggagtgcatgtttctggggaattctgcaaacatgagtggagcaccacagtgcagtgggggactcacctttggcggagcaaagcaacgcacttcagttgtccgg

SEQ ID NO: 4601 - DNA, 1403 bp, Lactuca sativa
  misc_feature (1118)..(1118): n is a, c, g, or t
  misc_feature (1359)..(1359): n is a, c, g, or t
  misc_feature (1383)..(1383): n is a, c, g, or t
acttcaatttcagtttggtttcactttcagtttctctccaatgaagttcaatcttctcaacgtttatacacttttttctctagcgctggtggcaactcatgcagtgactcctgatgtttactggaagtctgtattgccaaacagtcctatgcccaaaacaatccaggatttagtacacactgcagaatggtcggaagagatgaacactgcagtcggagttgggaaaggcggtgtagccgtgcacactggaaaaccagggaaaagaacaaatgtaggtgttcgaaaaggcggagtgactgttaacaccggaaaaggaacaaacgtaggggttggaaaaggtggtgtgggtgtgcataccggaaaaccagggaaacggacagatgttggtgttggaaaaggtggtgtcggtgtgcatactggaaaaccagggaaacggacgaatgttggtgttggaaaaggtggtgtagccgtgcatacaggtcacaaaggtaagccagtttatgtgggtgtaggtaaaggaccaaatccattcgtgtacaactatgctgcctccgcagatcaactcaaggataacccaaacgtagcgttttttttcttggaaaacgacttgcatcaaggtacggagatgaagttgcacttcactaaagacgaccaaaaagccacgttcttacctagacaggtagctgactcaataccattttcatcaaacaagcttcctcaaatctacaatgagttctcgataaaatccgactccgtggaagcccaagacatgaaacaaacactaagtgaatgcgagaacaaaggcattgaaggggaggaaaagtattgtgctacctcgttagagtccatggtcgattttagtacgagcaagttaggtaaaaacgttaaagcgatatcaacagaggtaaacgctaaagaaagtactccgttacaaaagtacacgattgaaggagccaagaaacttgcagcagataaagctgtggtttgccacaagcaaaactacgcatatgctgtcttttattgccacaaaactgttaacactcgagcgtattctgtttctttggtgggagctgatggtacgaaagctaaagctgtggctgtttgccatacagacactncgaagtggaatccaaaacatttggcgtttcaagtgctcaaagtcaaaccaggaactgttccagtttgccatttcttacccgaagatcatattgtttgggttccatactaataaacactgcaggaagaacatgttacacctatacatgtagtgcgtgtgtgtgtctttttctggacaatctataaggtttagtaatgaaactattttattaaggatttgctgcatctttctatatgttcggnttatgatcagtgtttgtaaagttnagtaataaatactgcttttt

SEQ ID NO: 4602 - DNA, 1401 bp, Lactuca sativa
cgcgggataacgctacttcaatttcagtttggtttcactttcagtttctctccaatgaagttcaatcttctcaacgtttatacacttttttctctagcgctggtggcaagtcatgcagtgactcctgatgtttactggaagtctgtattgccaaacagtcctatgcccaaaacaatcaaggatcttgtacacactgcagaatggtcggaagagatgaacactgcagtcggagttgggaaaggcggtgtagccgtgcacactggaaaaccagggaaaagaacaaatgtaggtgttcgaaaaggcggagtgactgttaacaccggaaaaggaacaaacgtaggggttggaaaaggtggtgtgggtgtgcataccggaaaaccagggaaacggacagatgttggtgttggaaaaggtggtgtcggtgtgcataccggaaaaccagggaaacggacgaatgttggtgttggaaaaggtggtgtagccgtgcatacaggtcacaaaggtaagccagtttatgtgggtgtaggtaaaggaccaaatccattcgtgtacaactatgctgcctccgcagatcaactcaaggataacccaaacgtagcgttttttttcttggaaaacgacttgcatcaaggtacggagatgaagttgcacttcattaaagacgaccaaaaagccacgttcttacctagacaggtagctgactctataccattttcatcaaacaagcttcctcaaatctacaatgagttctcgataaaatccgactccgtggaagcccaagacatgaaacaaacactaagtgaatgcgagaacaaaggcattgaaggggaggaaaagtattgtgctacctcgttagagtccatggtcgattttagtacgagcaagttaggtaaaaacgttaaagcgatatcaacagaggtaaacgctaaagaaagtactccgttacaaaagtacacgattgaaggagccaagaaacttgcagcagataaagctgtggtttgccacaagcaaaactacgcatatgctgtcttttattgccacaaaactgttaacactcgagcgtattctgtttctttggtgggagctgatggtacgaaagctaaagcggtgaccgtttgtcacacagacacttcgaagtggaatccgaaacatttggcgtttcaagtgctcaaagtcaaaccaggaagtgttccagtttgccatttcttacccgaagatcatgtcgtttgggttccatattaataaacactgcaggaagaatatgttacacctatatatgtagtgtgtgtcatgtgtcttttttggacaatctgtaaggtttacaaatgacgtacactagtttttacggatgtgctgcatctttctgtttgtaaggttaaataataaatactactttttcta

SEQ ID NO: 4603 - DNA, 1523 bp, Lactuca sativa
  misc_feature (879)..(879): n is a, c, g, or t
  misc_feature (891)..(891): n is a, c, g, or t
  misc_feature (894)..(894): n is a, c, g, or t
cgggggggcatggcatacatgatatttgcagttggtggttgggataattataacatgttgtccttcttgtttggtttcactttcagtttctctccaatgaagttcaatcttctcaacgtttatacacttttttcactagcgctggtggcatgtcatgccctgactcctgatgtttactggaagtctgtattgccaaacagtcctatgcccaaatcaatcaaggatcttgtacacactgcagaatggtctgaagaaaagaacactgcagtcgtagttgggaagggcggtgtagccgttcacaccggaaaaccaggcaaaagaacagatgtaggcgttcgaaagggcggagtgactgttaacaccggaaaaggaacaaacgtaggggttggaaaaggtggtgtaggtgtgcatactggaaaaccaggaaaacggacaaatgttggtgttggaaaaggtggtgtcggcgtgcataccggaaaaccagggaaacgaacgaatgtaggtgttggaaaaggtggtgtggccgttcatactggccacaagggtaagccagtttacgtgggggtgggtaaaggaccaaatccattcgtgtacaactatgcagcctccgcagatcaactcaaggataacccaaacgtagcgttttttttcttggaaaacgatttgcatcaaggcacagaaatgaagttacacttcattaaagacgaccaaaaagccacgttcttacctcgacaggtagctgactctataccattttcatcaaacaaacttcctcaaatctacaacgaattctcagtaaaccccgactcagtggaagctcaagacatgaagcaaacactaagcgaatgcgagaacaaaggcatagaaggcgaggaaaantattgtgctacntcnttagagtccatggtcgattttagtacgagcaagttaggtaaaaacgttaaagcgatatcaacagaggtaaacgctaaagaaagtactccgttacaaaagtacacgattaaaggagccaagaaacttgcagcagataaagctgtggtttgccataagcaaaagtacgcctatgctgtcttttattgccacaaaactgtcagcactcgagcatattctgtttctttggtgggagctgatggtaccaaagctaaagcggtgaccgtttgtcatacagacacttcgatgtggaatccgaaacatttggcatttcaagtgctcaaagtcaaaccaggaagtgttccagtttgccattttttacccgaagatcatgttgtttgggttccatactaatagacactacaggaagatcatgttacacctatatatgtagtgcgtgtcatgtgtcgtttctggacaatctataaggtttattgatcacaattgttttttccgagttgctgcatctttctgtgtgttctgtctttcaatgtttgtaaggttaagtaataaatattcctttttttttctaattagagcatgtctttattgattcatagtattgcaatacaaacattttcatacattaaaaa

SEQ ID NO: 4604 - DNA, 1406 bp, Lactuca sativa
  misc_feature (9)..(9): n is a, c, g, or t
  misc_feature (90)..(90): n is a, c, g, or t
ctaacttcnaattcagtttggtttcactttcagtttctctccaatgaagttcaatcttctcaacgtttatacacttttttctctagcgcnggtggcaagtcatgcagtgactcctgatgtttactggaagtctgtattgccaaacagtcctatgcccaaaacaatcaaggatcttgtacacactgcagaatggtcggaagagaagaacactgcagtcgtagttgggaaaggcggtgtagccgtgcacactgaaaaaccagggaaaaaaacaaatgtaggtgttcgaaaaggcggagtgactgttaacaccggaaaaggaacaaacgtaggggttggaaaaggtggtgtgggtgtgcataccggaaaaccagggaaacggacggatgttggtgttggaaaaggtggtgtcggtgtgcataccggaaaaccagggaaacggacgaatgttggtgttgcaaaaggtggtgtagccgtgcatactggtcacaaaggtaagccagtttacgtgggggtaggtaaaggagcaaatccattcgtgtacaactatgctgcctccgcagatcaactcaaggataacccaaacgtagcgttttttttcttggaaaacgacttgcatcaaggcacggagatgaagttgcacttcattaaagacgaccaaaaagccacgttcttacctagacaggtagctgactctataccattttcatcaaacaaacttcctcaaatctacaatgagttctcgataaaatccggctccgtggaagcccaagacatgaaacaaacactaagtgaatgcgagaacaaaggcattgaaggcgaggaaaggtattgtgctacctcgttagagtccatggtcgattttagtacgagcaagttaggtaaaaacgttaaagcgatatcaacagaggtaaacgctaaagaaagtactccgttacaaaagtacacgattgaaggagccaagaaacttgcagcagataaagctgtggtttgccacaagcaaaactacgcatatgctgtcttttattgccacaaaactgttaacactcgagcgtattctgtttctttggtgggagctgatggtacgaaagctaaagctgtggctgtttgccatacagacactgcgaagtggaatccaaaacatttggcgtttcaagtgctcaaggtcaaaccaggaagtgttccagtttgccatttcttacccgaagatcatgttgtttgggttccatactaataaacactgcaggaagttcatgttacacctatacatgtagtgcgtgtgtgtgtctttttctggacaatctataaggtttagtaatgaaactattttattaaggatttgctgcatctttctatatgttcggtttatgatcagtatttgtaaagttaagtaataaatactacttttt

SEQ ID NO: 4605 - DNA, 1409 bp, Cichorium intybus
cgctagcttcatatttagtttcgatttcactttcagtttttctcaaatgatgttcaatattctcaacgtttttacaattttttctctggcgttggttgcaagccatgcagtgactcctgaagtttactggaagtctgtgttgccaaacagtcctatgccaaaagcaatcaatgaccttctttaccctgcagaatggtccgaagagaagaacaccgcagtgggagtagggaaaggcggtgtggcagtgaacaccggaaaaccaggaaaaagaacaaatgtaggcgttcaaaaaggaggtgtgactgttaacaccggcaaaccagggaagggaacgaacgtaggagttggaaaaggcggggtcggcgtgcataccggaaaaccagggaagcggacggatgttggtgttggaaaaggtggtgtagccgtgcatactggaaaaaaggggaagccagtttacgtaggggtaaataaaggaccaaacccattcgtttacaactatgctgcctcggcggatcaactcaaagataacccaaacgtagcgttctttttcttggaaaatgacttgcatcaaggcacagaaatgaagttacacttcacgaaagatgaccaaaaagcaacctttttacctcgacaagtagctgactctatacccttttcatcaaacaaacttcctaaaatctacaacgagttctcagtcaaagccgactcagtggaagctgaggacatgaagcaaacactgagtgaatgcgagaacaaaggcatcgaaggggaggaaaaatattgtgcaacttcattagagtccatgatcgattttagtactaccactttaggtaaaaaagtgaaagcgatctctacggaggtaaataaagaaagtaccccgttacagaagtacaagattgagggtgctaaaaaactcgcagcagataaagctgtggtttgccataagcaaaactacgcatatgctgtcttttattgccacaaaactgttagcactagagcatatgctgtttctttgataggcatgaatggtacgaaagtgaatgctgtggcggtttgccatacagacactgcgaaatggaacccgaaacatttggcgtttcaagtccttaaagtgaaaccagggagtgtcccggtttgccatttcttacccgaagatcacgttgtttgggttccatactaataaagacagaaggaaaaacatcgtcacgacgcagatgtatgcgggggttgtgtgtgtgtcttttctggacatctacaaggtttagtaatcatactatttattaaggagttgctagatctttatgtatggcttatcaatgtttgtaaagtctggcaataaaaacttagttataggcaacaaaaataaaattaaaaggccgcctccgccccatcgaatctagactcgagca

SEQ ID NO: 4606 - DNA, 1450 bp, Lactuca sativa
  misc_feature (756)..(756): n is a, c, g, or t
gtttggtttcactttcagtttctctccaatgaagttcaatcattctcaacgttttatacactatttttctctagcgctggtggcaactcatgcagtgactcctgatgtttactggaagtctgtattgccaaatagtcctatgcccaaaacaatccattatttagtacacactgcagaatggtcggaagagatgaacactgcagtcggagttgggaaaggcggtgtagccgtgcacactggaaaaccagggaaaagaacaaatgtaggtgttcgaaaaggcggagtgactgttaacaccggaaaaggaacaaacgtaggggttggaaaaggtggtgtgggtgtgcataccggaaaaccagggaaacggacagatgttggtgttggaaaaggtggtgtcggtgtgcataccggaaaaccagggaaacggacgaatgttggtgttggaaaaggtggtgtagccgtgcatacaggtcacaaaggtaagccagtttatgtgggagtaggtaaaggaccaagtccattcgtgtacaactatgctgcctccgcagatcaactcaaggataacccaaacgtagcgttttttttcttggaaaacaacttgcatcaaggtacggagatgaagttgcacttcattaaagacgaccaaaaagccacgttcttacctagacaggtagctgactctataccattttcatcaaacaagcttccacaaatctacaatgagttctcgataaaatccgactccgtggaagcccnagacatgaaacaaacactaagtgaatgcgagaacaaaggcattgaaggggaggaaaagtattgtgctacctcgttagagtccatggtcgattttagtacgagcaagttaggtaaaaacgttaaagcgatatcaacagaggtaaacgctaaagaaagtactccgttacaaaagtacacgattgaaggagccaagaaacttgcagcagataaagctgtggtttgccacaagcaaaactacgcatatgctgtcttttattgccacaaaactgttagcactcgagcgtattctgtttctttggtgggagctgatggtaccaaagctaaagcggtgaccgtttgtcatacagacacttcgatgtggaatccgaaacatttggcatttcaagtgctcaaagtcaaaccaggaagtgttccagtttgccattttttacccgaagatcatgttgtttgggttccatactaatagacactacaggaagatcatgttacacctatatatgtagtgcgtgtcatgtgtcgtttctggacaatctataaggtttattgatcacaattgttttttccgagttgctgcatctttctgtgtgttctgtctttcaatgtttgtaaggttaagtaataaatattacttttttttttctaattagagcatgtctttattgattcatagtattgcaatataaacattttcata

SEQ ID NO: 4607 - DNA, 1279 bp, Solanum tuberosum
gctgaatccacattttatgtccccacgtatatacttgaaattgtacacacactatagttttgactcataaataattcaacacacaacacattctcaagaaagaaagaaaaaaatgtctagtcttaaagttccagcatcagttccagatccttatgaagatgctgagcaactgaaaaaagcttttaaaggatggggaacaaatgaggatcttattattcagattctggcacataggaatgcagcacagcgcaagttaatccgagattcttatgctgctgcttatggagaggatcttctcaaggacttggattctgaactgtcaagtgattttcagcgtgtagtgcttctctggactttgagtcctgctgagcgtgacgcctacttggttaatgaagctaccaaacgtctgactgctagcaattgggttatcatggaaactgcttgtaccaggtcttctgatgatctttttaaggcaaggcaggcctaccatgctcgatacaagaaatcacttgaagaagatgttgcttatcacacaagtggggatttccgtaagcttttggttcctcttataactgcattcagatatgaaggagatgaggtgaacatgacattggcaagaaaggaagcaaatatactgcatgagaagatctctgacaaggcttacaatgacgaggagatcatccgaattatttctactaggagtaaagcacagctgagtgcaacgttcaaccactacaatgatcaccatggccatgaaatcatcaaggatctggaagctgatgatgatgatgatgagtacctgaaattactcagagcagcaatagaatgcttgaaaaccccagagaaatactttgagaaagttcttcgattggctatcaagaagctgggcacagacgaatgggatcttactagagttgtcgccactcgggctgaagttgacatggagcgtatcaaagaagagtaccataggaggaacagtgttacattggaccgtgcaattgctgcagacacttcaggagactatgaaaaaatgcttctggctttgattgggcacggagatgcttgaattacatgtgctgaaaccttgagataataaaaactctttacttgttttctgaagtttgaatttgcttttatgatgtgtggtgtgtactctccgggtttggtttttgcattatatgaactaaaacattaaggtgttgtgttttgttttctcctttcggacttctactggttttgcctgctaaataagcatagctccaacttcggagcgagcaca

SEQ ID NO: 4608 - DNA, 1286 bp, Solanum phureja
cataaaagtcatgttcagttacaaaaataataaaaaacgtgtatcccaatgacttttgcgatcgcaaaaaatgtctgaatccacattttatgtccccacgtatattcttgaaattgtacacacactatagttttgactcataaataattcaacacacaacacattctcaagaaagaaagaaaaaaatgtctagtcttaaagttccagcatcagttccagatccttatgaagatgctgagcaactgaaaaaagcttttaaaggatggggaacaaatgaggatcttattattcagattctggcacataggaatgcagcacagcgcaagttaatccgagattcttatgctgctgcttatggagaggatcttctcaaggacttggattctgaactgtcaagtgattttcagcgtgtagtgcttctctggactttgagtcctgctgagcgtgacgcctacttggttaatgaagctaccaaacgtctgactgctagcaattgggttatcatggaaactgcttgtaccaggtcttctgatgatctttttaaggcaaggcaggcctaccatgctcgatacaagaaatcacttgaagaagatgttgcttatcacacaagtggggatttccgtaagcttttgattcctcttataactgcattcagatatgaaggagatgaggtgaacatgacattggcaagaaaggaagcaaatatactgcatgagaagatctctgacaaggcttacaatgacgaggagatcatccgaattatttctactaggagtaaagcacagctgagtgcaacgttcaaccactacaatgatcaccatggccatgaaatcatcaaggatctggaagctgatgatgatgatgatgagtacctgaaattactcagagcagcaatagaatgcttgaaaaccccagagaaatactttgagaaagttcttcgattggctatcaagaagctgggcacagacgaatgggatcttactagagttgtcgccactcgggctgaagttgacatggagcgtatcaaagaagagtaccataggaggaacagtgttacattggaccgtgcaattgctgcagacacttcaggagactatgaaaaaatgcttctggctttgattgggcacggagatgcttgaattacatgtgctgaaaccttgagataataaaaactctttacttgttttctgaagtttgaatttgcttttatgatgtgtggtgtgtactctccgggtttggtttttgcattatatgaactaaaacattaaggtgttgtgttttgtttt

SEQ ID NO: 4609 - DNA, 1240 bp, Solanum tuberosum
agaaagaaaaaatgtctagtcttaaagtgccagcatcagttccagatccttatgaagatgctgagcaactcaaaaaagcttttaaaggatggggaacaaatgaggatcttattattcagattctggcacataggaatgcagcacagcgcaagttaatccgagattcttatgctgctgcttatggagaggatcttctcaaggacttggattctgaactgtcaagtgattttcagcgtgtagtgcttctctggactttgagtcctgctgagcgtgacgcctacttggttaatgaagctaccaaacgtctgactgctagcaattgggttatcatggaaactgcttgtaccaggtcttctgatgatctttttaaggcgaggcaggcctaccatgctcgatacaagaaatcacttgaagaagatgttgcttatcacacaagtggggatttccgtaagcttttggttcctcttataactgcattcagatatgaaggagttgaggtgaacatgacattggcaagaaaggaagcaaatatactgcatgagaagatctctgacaaggcttacaatgacgaggagatcatccgaattatttctactaggagtaaagcacagctgagtgcaacgttcaaccactacaatgatcaccatggccatgaaatcatcaaggatttggaagctgatgatgatgatgatgagtacctgaaattactcagagcagcaatagaatgcttgaaaaccccagagaaatactttgagaaagttcttcgattggctatcaagaagctgggcacagacgaatgggatcttactagagttgtcgccactcgggctgaagttgacatggagcgtatcaaagaagagtaccataggaggaacagtgttacattggaccgtgcaattgctgcagacacttcaggagactatgaaaaaatgcttctggctttgattgggcacggagatgcttgaattacatgtgctgatgaaaccttaagataataaaaactctttacttattttctgaagtttgaatttgcttttatgatgtgtggtgtgtactctccgggtttggttttgcattatatgaactaaaacattaaggtgttgtgttttgttttctcctttcggacttctactggttttgcctgctaaataagcatagactccaactttcggagacgagcacagaaaaaaaacatataaaagataacaaatgatccagaatactcatagaaaatagaaaa

SEQ ID NO: 4610 - DNA, 1107 bp, Solanum melongena
acggtaaaagaaaaaaatgtctagtctgaaagttccaggatcagttccagatccttatgaggatgctgagcaactcaaaaaagcttttaaaggatggggtacaaatgagaaacttattattcagattctggcacataggaatgcagcacagcgcaagttaatccgagattcctatgctgctgcttatggagaggatcttctcaaggacttggattctgaactgagtaatgattttcagcgtgtagtgcttctctggactttgagccctgctgagcgtgatgcctacttggttaatgaagctaccaaacgtcttactgctagcaattgggttatcatggaaattgcttgtaccaggtcttctgatgaactttttaaggcgaggcaggcttaccatgctcgatacaagaaatcacttgaagaagatgttgcttatcacacaactggggatttccgtaagcttttggttcctctagtaactgcattcagatacgagggagaagaggtgaacatgacattagcaagaaaggaagcaaatatactgcacgagaagatctctgacaaggcttacaatgacgatgagcttatccgaattatttctactaggagtaaagcacagctgaatgcaacattcaaccactacaatgatcaccacggccatgaaatcgtcaaggatctggaagctgatgatgatgatgagtacctgaaattactcagagcagcaatcgaatgcttgaaaaccccagagaaatactttgagaaagttgttcgattggctatcaagaggctgggtacagatgaatgggatcttactagagttgttgcctctcgggctgaagttgacatggagcgtatcaaagaagagtaccataggaggaacagtgttacattggaccatgcaattgctgcagacacttcaggagactatgaaaaaatgcttctggctttgattgggcacggagatatttgaatacgtgttgtaagttttggataataaaaccatttcctattgtctgatgtttcaatttggttttatcatgtgtgtttttatgatgtgtgttgagagtttggttttgcattatatgaaataaaatattctggttttgcatt

SEQ ID NO: 4611 - DNA, 1154 bp, Capsicum annuum
ggcacgaggcgcctacttctaatttctacacaccacaaagaaggaaaaaaaaaaaaagaaatggcgagtctgaaggtgccagcatcagttccagatccttgtgaggatgctgagcaactcaaaaaagcttttaaaggatggggtacaaatgaggaacttattattcagattttggcccataggaatgcagcacagcgcaagttaatccgtgattcttatgctgctgcttatggagaggatcttctcaaggacttggattctgaactgacaagtgattttcagcgtatagtgcttctctggactttgagtcctgctgagcgcgacgcctacttggctaatgaggctaccaaacggctgactgctagcaattgggttatcatggaaattgcttgcaccaggtcttctgatgaactctttaaggcgaggcaggcctaccatactcgatacaagaaatcttttgaagaggatgttgcttatcacacaactggggatttccgtaagcttttggttcctcttataactgccttcagatacgagggagaagaggtgaacatgacattggcaagaaaggaagcaaatatactgcatgagaaggtctctggcaaggcttacaatgatgaggagcttatccgaattatttctactaggagtaaaacacagctgaatgcaactttcaaccactacaatgatcagcatggccatgaaatcatcaaggatctggaagctgatgacgatgatgagtatctgaaattacttagagcagcaatagaatgcttgaaaaccccagagaaatactttgagaaagttcttcgagtggctatcaaggggctggggacagacgaatgggatcttactagagttgttgccactcgggctgaggttgatatggagcgtatcaaagaagagtacaataggaggaacagtgttacattggaccgtgcaatcactggagacacttcaggagactacgaaagaatgcttctggctttgattgggcatggtgatgcttgagtacatgtgttgtaacgtacggatagtaaaactatttcctgttgtctgaagtttgaatttgcttttataatatgtggcgtgtactctcagagtttggttttgcattatatgaactaaaataaaaaagagaaatggttttgtat

SEQ ID NO: 4612 - DNA, 1228 bp, Nicotiana tabacum
ggccattacggccggggaactcaacaatacatccacaattctccacagtacaagaaaacaaaaaaatggcgagtcttaaagttccaacatctgttccagaaccttatgaagatgctgagcaactcaaaaaagcttttgctggatggggtacaaatgaggcacttattattcagattctggcacatagaaatgcagcacaacgcaagttaatccgagaaacttatgctgcagcttatggagaggatcttctcaaggacttggatgctgaactgacaagtgattttcagcgtgcagtgcttctgtggactttgagtcctgctgagcgcgacgcctacttggttaatgaagctaccaaacgtctgacttctagcaattgggttatcttggaaattgcttgtacaaggtcttctgatgatctctttaaggcgaggcaggcctaccatgctcgatacaagaaatcacttgaagaagatgttgcttatcacacaactggggatttccgtaagcttttggttcctcttttaactgcattcagatacgaaggagaagaggcgaacatgacattggcaagaaaggaggcaaatatactacacgagaagatctctgacaaggcttacaatgatgaggagctcatccgaattatttctactaggagtaaagcacagctgaatgcaacattcaaccactaccttgaccaacatggcagtgaaatcaacaaggatctggaaactgattctgatgatgagtacctgaaattactcagcgcagcaatagaatgcttgaaaaccccagagaaacactttgagaaagttcttcgattggctatcaagggtacaggcacagacgaatgggaccttactagagttgtcactactcgggctgaagttgacatggaacgtatcaaagaagagtaccataagaggaacagtgttccattggaccgtgcaattgctggagacacttcaggagactatgaaaggatgcttctggctttgattgggcatggagatgcttgaatggaatatgtgttctaagattggataagaaactatttcctaatgtctgaagtttgaatttgtttgaatgatgtgtggcatgtatgcccagagtttggtttgcattatatggatttaaataatccaggtgttgtgttttgtttttttcttcacttgtcatagtttggttctatatattcggacttcctcaaccagtgatcttattgtttatc

SEQ ID NO: 4613 - DNA, 1136 bp, Solanum tuberosum
tgaggatcttattattcagattctggcacataggaatgcagcacagcgcaagttaatccgagattcttatgctgctgcttatggagaggatcttctcaaggacttggattctgaactgtcaagtgattttcagcgtgtagtgcttctctggactttgagtcctgctgagcgtgacgcctacttggttaatgaagctaccaaacgtctgactgctagcaattgggttatcatggaaactgcttgtaccaggtcttctgatgatctttttaaggcaaggcaggcctaccatgctcgatacaagaaatcacttgaagaagatgttgcttatcacacaagtggggatttccgtaagcttttggttcctcttataactgcattcagatatgaaggagatgaggtgaacatgacattggcaagaaaggaagcaaatatactgcatgagaagatctctgacaaggcttacaatgacgaggagatcatccgaattatttctactaggagtaaagcacagctgagtgcaacgttcaaccactacaatgatcaccatggccatgaaatcatcaaggatctggaagctgatgatgatgatgatgagtacctgaaattactcagagcagcaatagaatgcttgaaaaccccagagaaatactttgagaaagttcttcgattggctatcaagaagctgggcacagacgaatgggatcttactagagttgtcgccactcgggctgaagttgacatggagcgtatcaaagaagagtaccataggaggaacagtgttacattggaccgtgcaattgctgcagacacttcaggagactatgaaaaaatgcttctggctttgattgggcacggagatgcttgaattacatgtgctgaaaccttaagataataaaaactctttacttattttctgaagtttgaatttgcttttatgatgtgtggtgtgtactctccgggtttggttttgcattatatgaactaaaacattaaggtgttgtgttttgttttctcctttcggacttctactggttttgcctgctaaataagcatagctccaactttcggagacgagcacagaaaaaaaacatataaaagataacaaatgatccagaatactcatagaaaatagaaaa

SEQ ID NO: 4614 - DNA, 1416 bp, Populus trichocarpa
caaattcattattgtctttgtcgctgataaaataatgaaaagctagataatgacgagcgggaatttcgatgatttttttacacaatcacatttttggcaatgaaataacttttatttaattttctttccttttcatgcgctataaaacaagttcggagatcttaatatcagccatcgtttccgattcttggcaaacaataaaacagagagtgaaaacagagtgaagagtgaaaacaatggcgtcccttaaagttcctgcttctgttcctcctccttatgaggatgctgagcagcttaataaagcttttaaaggatggggtacaaacgagggattgattatctccatcttggctcataggaatgctgcacaacgcaacttaatccgacaggtttatgctgaagcttatgggcaagatctccttaaagatttggacaaggaactgtctagtgacttcgagagggtcgtattgctatggacactggatcttgcggagcgtgatgcatatttggccaatgaagccacaaagaggttcacttcaagcaactgggttttaatggaaatagcttgtactaggtcctcacatgacctttttaaggcgaggcaagcataccatgctcgttacaagaaatctcttgaggaagatgttgcatatcacacaactggagacttccgcaagctgttggttccccttgtaagtgcattccgatacgagggagaagaggtgaacacgatgttggcaaaatcagaggctaagatacttcatgagaagatctcagataaagcttacagtgatgatgaaatcatcaggattctgactacaagaagtaaggcacagcttaatgcaacacttaatcactacaacaatgcatttggaaatgccatcaacaagaacttgaaggaagatgccgataacgagttccttaaattactgagagcaacaattaagtgcttgacctaccctgaaaaatactttgagaagcttctgcggctggccatcaagaagatagggacagatgaatgggctcttactagagttgtaaccaccagggcagaggttgacatggaacgtattaaggaggaataccatcgccgaaatagtgttactcttgatcatgacattgctggagaggcttctggagattatgagcgaatgcttcttgccttgattggccatggagatgcttgagccatttcttgtggatgcggaagagttgtgctttgtatgaatgttgtttgtgttgcttttgccggacacaatcttcctgacgtgagctatcatctttacttctttgtattgcttattttgagtatcttcctgaaatgttctgtgcatctctgctggcttaataaatctttgaaatggaccaggttggtgtttcatatcttggtatatgagtgttgactgttgctttcta

SEQ ID NO: 4615 - DNA, 1306 bp, Populus trichocarpa
taccttcacccaccgtttccgattcttggcaaacacaaaacacagagagtgtgaaacagagtgaagagtgaaaacaatggcgtcccttaaagttccagcttctgttcctcctccatatgaggatgctgagcaacttcataaagcttttgaaggatggggtacaaatgagggattgatcatctccatcctggctcataggaatgctgcacaacgcaacttaattcgaaaggtttatgctgaagcttacggccaagatctccttaaagatttggacaaggaactttctagtgacttcgagagggctgtgttgctatggacactggatcctgctgagcgtgatgcatatctggctaatgaagcgacgaagaggttcacttcaagcaactgggttctaatggaaatagcttgtactaggtcctcacatgacctttttaaggtgaggcaggcatatcatgctcgttacaagaaatccctcgaggaagatgttgcataccacacaactggagacttccgcaagctgttggttccccttgtaagtgcattccgatatgagggagaagaggtgaacacgattttggcaaaatcagaggctaagatacttcatgagaagatctcagataaagcttatagtgatgaagagatcatcaggattctgactacaaggagcaaggcacaacttaatgcaacacttaatcactacaacaacgcatttggaaatgccatcaacaagaatttgaaggaagaggcggataacgatttcctcaaattactgagagcaacgattaagtgcttgacctaccctgaaaaatactttgagaagcttttgcggctgtccatcaaaaagctaggaacagatgaaagggctcttactagagttgtaaccaccagggctgaggttgacatggaacgtatcaaggaggaatatcatcgccgaaatagtgttactcttgaacgtgacattgctggagacacttccggagattatgaacgaatgcttcttgccttgattggccatggcgatgcttgatctattgcttgtggattcagaagagttttgctttgtatgaatgttgttattgttgttgttgttgtattgcttttgctagacataatcttcctgacgtgagctatcatctttgcttgtattgcttatattaagtatctctgaaatgttttgtgcatcttttctggcttaataaaatctttgaaatggaccaagagatcgtttcataatgtatcaacattattaaaaagatgggagcataaagatgatgttcgaataaatcctttcaagggacttgttgaa

SEQ ID NO: 4616 - DNA, 1425 bp, Populus trichocarpa
caaattcattattgtctttgtcgctgataaaataatgaaaagctagataatgacgagcgggaatttcgatgattgttttacacaatcacatttttggcaatgaaataacttttatttaattttctttccttttcatgcgctataaaacaagttcggagatcttaatatcagccatcgtttccgattcttggcaaacaataaaacagagagtgaaaacagagtgaagagagaaaacaatggcgtcccttaaagttcctgcttctgttcctcctccttacgaggatgctgagcagcttaataaagcttttaaaggatggggtacaaatgagggattgattatgtccatcttggctcataggaatgctgcacaacgcaacctaatccgacaggtttatgctgaagcttatgggcaagatctccttaaagatttggacaaggaactgtctagtgacttcgagagggtcgtattgctatggacactggatcttgctgagcgtgatgcatatttggccaatgaagccacaaagaggttcacttcaagcaactgggttttaatggaaatagcttgtactaggtcctcacatgacctttttaaggcgaggcaagcataccatgctcgttacaagaaatctcttgaggaagatgttgcatatcacacaactggagacttccgcaagctgttggttccccttgtaagtgcattccgatacgagggagaagaggtgaacacgatgttggcaaaatcagaggctaagatacttcatgagaagatctcagataaagcttacagtgatgatgaaatcatcaggattctgactacaagaagtaaggcacagcttaatgcaacacttaatcactacaacaatgcatttggaaatgccatcaacaagaacttgaaggaagatgccgataacgaattccttaaattactgagagcaacaattaagtgcttgacctaccctgaaaaatactttgagaagcttctgcggctggccatcaagaagatagggacagatgaaggggctcttactagagttgtaaccaccagggcagaggttgacatggaacgtattaaggaggaataccatcgccgaaatagtgttactcttgatcatgacattgctggagaggcttctggagattatgagcgaatgcttcttgccttgattggccatggagatgcttgacatttcttgtggttgcggaagagttgtgctttgtgtgaatgttgtttgtgttgcttttgctggacacaatcttcccgacgtgagctatcatctttacttctttgtattgcttattttgagtatctccgtgaaatgttctgtgcatctctgctggcttaataaatctttgaaatggaccaggttgatgtttcatatcttggtatatgagtgttgactgttgcattctatatgtgtatac

SEQ ID NO: 4617 - DNA, 1329 bp, Solanum phureja
ggcaccacaaattggaagtgaaaattgaagaggctattagagccactagtcacaatcctttagcatcaacacaaaatcttgaatgatcactttgttgaaggagaaaattcaagaataggcaaaaccaaaatcaagaatcaatggcttccaccattagctacacttcactttgttctttacttaaactcaaccaaaacaaccaaaaaaccccattttccccttcgtcttcttcttcttctttgattaaaatcaagaatcaattatgttttagcagcaatttttgtagccatttaggtaaagcttcaatctttatggttaaagcttcagaaacagaggcaactcagtcagaaaaagaagaagacaagtatgaagagtatgaagttgagattgttcagccttttggacttaaatttactaaaggtagagatggaggaacttacattgatgctattgctcctggtggttcagctgataagactgggaaatttactgttggagatagagtcattgccaccagtgcagtgtttggagaggaaatatggcctgctgctgaatatggaagaacaatgtacactatcagacagagaattggacctttgctcatgaagatgcaaaagagatatgggaaggtggaagaagtaggtgaattgacagaaaaggaaattatcagagctgagaggaatgctggtttcattagtgacagagttagggaaattcaagtaacgaatgctcagaggaagaaagaacaaaaggagcaacgagaaagagatcttcgtgaaggactaaaactttctaagaatggcaaatacgaagaagcactcgaaaagtttgagtctgtgttaggatcaagaccaactggagatgaagctgctgtggcaagttacaatgttgcctgttgttattccaagcttaatcagcttcaagcaggattatctgctttggaggatgcaatggaagcaggatttgaagatttcaagagaatcaggacagaccccgatcttgctaatctaagaacgtctgaggatttcgagacactcatgaaaaagtttgatgaatcgttcatcaatgagaatgccatcaacgcgattaagtccctttttggcttcaacaagaaatagaagcagcagcacattcataaactgaaatggcaatacattgactatgctcccttttttggattttgtttataggtgagttatagatatgaaattacttctgatcattaatttttttttcattttaattgtattacactatggtcaatctcgtgtaattataaggttcgtattttgaatatgaaaagatcttcaatttgaaacctacatatct

SEQ ID NO: 4618 - DNA, 1241 bp, Solanum tuberosum
tcaacacaaaatcttgaatgatcactttgtttgaaggagagaattcaagaataggctaaaccaaaatcaagaatcaatggcttccaccattagctacacttcactttgttctttacttaaactcaaccaaaacaaccaaaaaaccccattttccccttcttcttctttgattaaaatcaagaatcagttatgttttagcagcaatttttgtagccatttaggtaaagcttcaatctttatggttaaagcttcagaaacagaggcaactcagtcagaaaaagaagaagacaagtatgaagagtatgaagttgagattgttcagccttttggacttaaatttactaaaggtagagatggaggaacttacattgatgctattgctcctggtggttcagctgataagactgggaaatttactgttggagatagagtcattgccaccagtgcagtgtttggagaggaaatatggcctgctgctgaatatggaagaacaatgtacactattagacagagaattggacctttactcatgaagatgcaaaagagatatgggaaggtggaagaagtaggtgaattgacagaaaaggaaattatcagagctgagaggaatgctggtttcattagtgacagagttagagaaattcaagtaacgaatgctcggaggaagaaagaacaaaaggagcaacgagaaagagatcttcgtgaaggactaaaactttctaagaatggcaaatacgaagaagcactcgaaaagtttgagtctgtgttaggatcaagaccaactggagatgaagctgctgtggcaagttacaatgttgcctgttgttattccaagcttaatcagattcaagcaggattatctgccttggaggatgcaatggaagcaggatttgaagatttcaagagaatcaggacagaccccgatcttgctaatctaagaacgtctgaggatttcgaaacactcatgaaaaagtttgatgaatcgttcatcaatgagaatgccatcaacgcaattaagtccctttttggcttcaacaagaaatagaagcagcagcacattcataaactgaaatgtcaatacattgactatgctcccttttttggattttgtttataggtgagttatagatatgaaattacttctgatcattaattttttcttcatttcaattgtattacactatggtcaatctcgtgtaattataaggttcgtattctgaatatgaaaagatcttcaattg

SEQ ID NO: 4619 - DNA, 1200 bp, Solanum tuberosum
gcaagaataggctaaaccaaaatcaagaatcaatggcttccaccattagctacacttcactttgttctttacttaaacttaaccaaaacaaccaaaaaaccccattttccccttcttcttcttctttgattaagatcaagaatcagttatgttttagcagcaatttttgtagccatttaggtaaagcttcaatctttatggttaaagcttcagaaacagaggcaactcagtcagaaaaagaagaagacaagtatgaagagtatgaagttgagattgttcagccttttggacttaaatttactaaaggtagagatggaggaacttacattgatgctattgctcctggtggttcagctgataagactgggaaatttactgttggagatagagtcattgccaccagtgcagtgtttggagaggaaatatggcctgctgctgaatatggaagaacaatgtacactattagacagagaattggacctttactcatgaagatgcaaaagagatatgggaaggtggaagaagtaggtgaattgacagaaaaggaaattatcagagctgagaggaatgctggtttcattagtgacagagttagagaaattcaagtaacgaatgctcggaggaagaaagaacaaaaggagcaacgagaaagagatcttcgtgaaggactaaaactttctaagaatggcaaatacgaagaagcactcgaaaagtttgagtctgtgttaggatcaagaccaactggagatgaagctgctgtggcaagttacaatgttgcctgttgttattccaagcttaatcagattcaagcaggattatctgccttggaggatgcaatggaagcaggatttgaagatttcaagagaatcaggacagaccccgatcttgctaatctaagaacgtctgaggatttcgaaacactcatgaaaaagtttgatgaatcgttcatcaatgagaatgccatcaacgcaattaagtccctttttggcttcaacaagaaatagaagcagcagcacattcataaactgaaatgtcaatacattgactatgctcccttttttggattttgtttataggtgagttatagatatgaaattacttctgatcattaattttttcttcatttcaattgtattacactatggtcaatctcgtgtaattataaggttcgtattctgaatatgaaaagatcttcaattg

SEQ ID NO: 4620 - DNA, 1286 bp, Nicotiana tabacum
  misc_feature (410)..(410): n is a, c, g, or t
  misc_feature (772)..(772): n is a, c, g, or t
  misc_feature (1231)..(1231): n is a, c, g, or t
  misc_feature (1235)..(1235): n is a, c, g, or t
gcatttgaaaagcaaattaaattcattttttcatggcttctaccactagcagctacacctcactctgttctttgctcaagctcaatcaaaccaagcaaaaccatcttcctgttctttgcttaaggtcaagaatcatctgccagtttttaggagtttctgcagtagccatttgggaaaagcttcaatcttggtggttaaagctcaggctgcaaaagcagaggggggaaaagaagaggaggaagagaagtacgaagagtatgaagtagagattgtgcagccttacgggctgaaatttaccaaaggcagagatgggggtacttacattgacgccattgcccctggaggttttgctgacaagactggcatgttctctgtcggagataaagtccttgccaccagtgcagtgtttngagaagaaatatggcccgctgctgaatatggaagaacaatgtacactatcagacagagaattggacctttgctcatgaagatgcaaaagagatatgggaaggtggaagaagcaggtgaattgacagaaaaggaaattatcagagcagaaaggaatgctggtttcattagtgatagagttagggagattcaattgacaaatgctcggaggaagaaagagcaaaaggagcaaagagaaaaggatcttcgtgaaggactgcaactctctaagaatggcaaatatgaagaagcactagaaaaatttgagtctgtgttaggatcaagaccaactggaaatgaagctgctgtggcaagttacaatgtngcctgttgttattccaagcttaatcagcttcaagcggggttatctgccttggaggatgcaatggatgcaggatttgatgattttaagagaatcaggacagaccctgatcttgccaatctaaggacgtctgaggattttgagcctctcctgaagaagttcgatgaatctttcattaacgagaacgccatcaatgcgatcaagtccctattcggcttcaacaagaaatagaggcagcagcatgtctgtaaactgaattgccaatagcccaacattcggatttcgggtagcttactttgagatccatgcacatataaggcaaaaggtatggatctgcaacaaactatgctcccgttttggattttgtttataaggtgagttagagatatcaaattactatctgattattaattgtttatttcaattgtattacactatggtcaatcccttgtaattataagnttcncattctgaatatgaaaagatttcaatttgaaaagcggccgcatgaggggta

SEQ ID NO: 4621 - DNA, 863 bp, Solanum tuberosum
cccgggacgaggctataataagagaatagatccaacatgtcatttaggcaactttcttcattagatagtgagaaatcccatttgatgaagacttgtaatttgttgactcaatatttcaatggaaaagcagacctcaaagatctaaatcttacaattagtaacaatggagaagccaaagcctcagcaaccaaggatttgttgaccaacatggaagaatcatcaactaagacaacagagcaagaccagaaattaatagatcatgttcctaaaagtgcaataaataaagccagcagcagcaaagaaataccaaataaggagcaaaagctagcgcaattatctatattctatgggggtaaagtggtggtttttgatgattttccagcagagaaagccagagcagtgatgttattagctagcaaaggaatctctaacaactcttgtgccatttttcaaaccaccaccaccactcagactaatggagccaacaactttgatttacctattgcaaggagatcttcactttataggtttcttgagaagaggaaagatagggacacggctagagcgccataccaaatgcataatccattgcaatcatcttcaaggactcgtgaagatcattttgatctcaatttctagttataatcaacttttcgaacggagatattgtcggaaaagttaatagttagtaactaggacaacttgatataagacattatttatatattgttgcaagtcattttatttgatgataccaaaaaggtatatgttattagtatagaaactttaacattctcattatgcaggtaatcttcaagttggatggtattgtatctacatcatatggcagaaaaaaaaaaaaa

SEQ ID NO: 4622 - DNA, 850 bp, Solanum tuberosum
cccgggacgaggctataataagagaatagatccaacatgtcatttaggcaactttcttcattagatagtgagaaatcccatttgatgaagacttgtaatttgttgactcaatatttcaatggaaaagcagacctcaaagatctaaatcttacaattagtaacaatggagaagccaaagcctcagcaaccaaggatttgttgaccaacatggaagaatcatcaactaagacaacagagcaagaccagaaattaatagatcatgttcctaaaagtgcaataaataaagccagcagcagcaaagaaataccaaataaggagcaaaagctagcgcaattatctatattctatgggggtaaagtggtggtttttgatgattttccagcagagaaagccagagcagtgatgttattagctagcaaaggaatctctaacaactcttgtgccatttttcaaaccaccaccaccactcagactaatggagccaacaactttgatttacctattgcaaggagatcttcactttataggtttcttgagaagaggaaagatagggacacggctagagcgccataccaaatgcataatccattgcaatcatcttcaaggactcgtgaagatcattttgatctcaatttctagttataatcaacttttcgaacggagatattgtcggaaaagttaatagttagtaactaggacaacttgatataagacattatttatatattgttgcaagtcattttatttgatgataccaaaaaggtatatgttattagtatagaaactttaacattctcattatgcaggtaatcttcaagttggatggtattgtatctacatcatatggcag

SEQ ID NO: 4623 - DNA, 724 bp, Solanum phureja
tcaagatatatttattcccctactcatgaagagtagtcatcatttttcttcaagctaaagaagagaatagatccaacatgtcaaataggccactttcttcattagatagtgagaaatcccatttgatgaagacttgtaatttgttgactcaatatttcaatggaaaagcagacctcaaaaatctaaatcttacaattagtaacaatggagaagccaaagcctcagcaaccaaggatttgttgaccaacatggaagaatcatcaactaagacaacagagcaagaccagaaattaatagatcatgttcctaaaagtgcaataaataaagccagcagcagcaaagaaataccaaataaggagcaaaagctagcgcaattgtctatattctatgggggtaaagtggtggtttttgatgattttccagcagagaaagccagagcagtgatgttattagctagcaaaggaatatctaacaactcttgtgccatttttcaaaccaccaccaccactcagactaatggagccaacaactttgatttacctattgcgaggagatcttcactttataggtttcttgagaagaggaaagatagggacacggctagagcgccataccaaatgcataatccattgcaatcatcttcaaggactcgtgaagatcattttgatctcaatttctagttataatcaacttttcgatcggagaaattgttgaaaaagttaat

SEQ ID NO: 4624 - DNA, 1387 bp, Solanum tuberosum
aagcagtggtatcaacgcagagtggccattacggccggggatggtgaagaaaaagcagtagagataaacactagtactaaaaaccctccaaaaaaatgatgatgatcggccgatcaactccgaccgtccaaatccctccttgggacgtcaccgatgatccaacggttgatgtttactccccattttccgttagccctgattctgctttcgatgctttgacggcgttgcagcgttacctgccgtcgaatggtaacgacgtgatttttgactctgatgggttggatattccggtggatgctttttcatgtgataacttccggatgtatgagtttaaggtgaggaagtgtgcccgtggaaggtcacatgactggacggagtgtccgtacgctcatcccggtgagaaagctcgccggagggatccgaggaagtatcattactcaggtacttcttgtcctgattttcgtaaaggtcagtgtaaaaaaggtgatgcatgtgagtacgctcacggcgtatttgagtgttggctacaccctgctcgctatcgtacgcagccttgtaaagatgggacccactgccgccggcgcgtgtgcttcttcgctcacacgccggagcaactccgtgttttgcctcagaacagtccgagaagcttcaacgagtcgtctgattcgtttgatgggtctccgggtcgggtcgggtttgaatcgttttcgtcgtctccgccgcttgaatctcctccgatgactccgcgtgggctggcggaatcgatgcgtaatatgcagattgggatggtgagaggtatgcgtagtatgcaaatgggttcacctgggtttggttcacctcggagcccttcaatgctccgacccggattcatgagtgtgccaacaactccgacccggagtggagtgtcggtgttcgatcactgcgaagaagagccggcgatggagagggtagaatccgggcgagatctccgagcaagaatttatgctaaactaagcatggagaactctcttgatgattccggtgcaccggatgttggatgggtttccgaactgctgaaatgaatccgggttcgggttattggtaatgggtttacggatctgaggcctctgacttttgtaaatattgaagattattgttattggttgtaaatagttagtagtttgggctggagagattagcctattaatctctattttgtgtttgcttatttgggtattagggggaagttttgaatattttgtacataaagaagaagatttagggttcttaattgccaggggctgcatatgtatatatgattatcaaatttgtatctcatttcttgccatttttgctaatgtttcttgatttgaataatgttttgagtgtttaaaatcttgaattcttc

SEQ ID NO: 4625 - DNA, 1322 bp, Solanum tuberosum
gaaaaagcagtagagataaacactagtactaaaaaccctccaaaaaaatgatgatgatcggccgatcaactccgaccgtccaaatccctccttgggacgtcaccgatgatccaacggttgatgtttactccccattttccgttagccctgattctgctttcgatgctttgacggcgttgcagcgttacctgccgtcgaatggtaacgacgtgatttttgactctgatgggttggatattccggtggatgctttttcatgtgataacttccggatgtatgagtttaaggtgaggaagtgtgcccgtggaaggtcacatgactggacggagtgtccgtacgctcatcccggtgagaaagctcgccggagggatccgaggaagtatcattactcaggtacttcttgtcctgattttcgtaaaggtcagtgtaaaaaaggtgatgcatgtgagtacgctcacggcgtatttgagtgttggctacaccctgctcgctatcgtacgcagccttgtaaagatgggacccactgccgccggcgcgtgtgcttcttcgctcacacgccggagcaactccgtgttttgcctcagaacagtccgagaagcttcaacgagtcgtctgattcgtttgatgggtctccgggtcgggtcgggtttgaatcgttttcgtcgtctccgccgcttgaatctcctccgatgactccgcgtgggctggcggaatcgatgcgtaatatgcagattgggatggtgagaggtatgcgtagtatgcaaatgggttcacctgggtttggttcacctcggagcccttcaatgctccgacccggattcatgagtgtgccaacaactccgacccggagtggagtgtcggtgttcgatcactgcgaagaagagccggcgatggagagggtagaatccgggcgagatctccgagcaagaatttatgctaaactaagcatggagaactctcttgatgattccggtgcaccggatgttggatgggtttccgaactgctgaaatgaatccgggttcgggttattggtaatgggtttacggatctgaggcctctgacttttgtaaatattgaagattattgttattggttgtaaatagttagtagtttgggctggagagattagcctattaatctctattttgtgtttgcttatttgggtattagggggaagttttgaatattttgtacataaagaagaagatttagggttcttaattgccaggggctgcatatgtatatatgattatcaaatttgtatctcatttcttgccatttttgctaatgtttcttgatttgaataatgttttgagtgttt

SEQ ID NO: 4626 - DNA, 1596 bp, Solanum melongena
aaggcatggtgagaaaaaagcagtagagatagacactagtacacaacacaaagcttccgaaaatgatgatgatcggccgatcccctccgaccgttcaaatacctccttggaatgttatggatgatccgacggttgatgtttactccccattttccggtactagtcctgattctgctgccttgaaggcgttgcagcgttacctgccgtcgaatgctaacgatgccatcttcgactctgatggcttggacattccggtggatgccttctcatgtgataacttccgtatgtatgagttcaaggtcaggaagtgtgcacgtggaaggtcacatgactggaccgagtgtccgtacgctcatcccggtgagaaggctcgccggagggatcctcggaagtatcattactccggtacttcttgtcccgattttcgtaaaggtcagtgtaagaaaggtgatgcatgtgagtacgctcacggcgtattcgagtgttggctacaccctgctcgctatcgtacgcagccttgtaaggacgggacccactgccgccggcgcgtgtgcttcttcgctcacacgccagagcaactccgtgttctccctcagaacagcccgagaagccatgccgagtcgtgtgactcgttcgacggctctccgagtcgactggggttcgaatctttctcgacgtctcctccgtttgactcgcccccgatgactccgcgtggggttaatgggctggctgaatcgatgcgtaatatgcagattgggatggcgaggggtggtatgcgtgctatgcaaatgggttctcctgggtttggttcaccccggagcccatcgatactccggcccggtttcatgagcctgccaacaactccgacccggagtggactttcggtgttcgatcagaattgtgaagaagagccagcaatggagagggtagaatctggaagggatctccgagcaaggatttatgcgaaactaagcatagagaactctcttgactcgggtgctccggatgttggatgggtttccgaactgctgaaatgaatccgggttcgggttatgatgtcctttttcccggttttgctgctaatggatttccagatctgaggcctctgatgtttgtaaatagtgaagattattggtgtaaatacttttaggaacaatttggggtggagagattaggctattaatctctattttgtcgttttgcttatttgggtatatttatgtaaggcaagagggagtttgaatattttgtacataagaaaaagatccagagacaagggatctttctttattgcaggggctgcagatgtatatatggattatcgttttctttacctcatttttgcagctatctcaagtgatttcttgatttgaatagtgtttctagctttagttactaaagggaaactagaatctatatcaatggcatgtaaatcttgaatttcatttcatatgtattggagataatcttgaatcaatgtctggccagtcatcatggaatgaaaagttaggttttgttcttgagtgggtatggaccacaatgccagcttgattgatgtaatttttttttattctataaagatcattatcctggttc

SEQ ID NO: 4627 - DNA, 1351 bp, Solanum phureja
agccatggtgaagaaaaagcagtagagataaacactagtactaaaaaccctccaaaaaaatgatgatgatcggccgatcaactccgaccgtccaaatccctccttgggacgtcaccgatgatccaacggttgatgtttactccccattttccgttagccctgattctgctttcgatgctttgacggcgttgcagcgttacctgccgtcgaatggtaacgacgtgatttttgactctgatgggttggatattccggtggatgctttttcatgtgataacttccggatgtatgagtttaaggtgaggaagtgtgcccgtggaaggtcacatgactggacggagtgtccgtacgctcatcccggtgagaaagctcgccggagggatccgaggaagtatcattactcaggtacttcttgtcctgattttcgtaaaggtcagtgtaaaaaaggtgatgcatgtgagtacgctcacggcgtatttgagtgttggctacaccctgcacgctatcgtacgcagccttgtaaagatgggacccactgccgccggcgcgtgtgcttcttcgctcacacgccggagcaactccgtgttttgcctcagaacagtccgagaagcttcaacgagtcgtctgattcgtttgatgggtctccgggtcgggtcgggtttgaatcgttttcgtcgtctccgccgcttgaatctcctccgatgactccgcgtgggctggcggaatcgatgcgtaatatgcagattgggatggtgagaggtatgcgtagtatgcaaatgggttcacctgggtttggttcacctcggagcccttcaatactccgacccggattcatgagtgtgccaacaactccgacccggagtggagtgtcggtgttcgatcactgcgaagaagagccggcgatggagagggtagaatccgggagagatctccgagcaagaatttatgctaaactaagcatggagaactctcttgatgattccggtgcaccggatgttggatgggtttccgaactgctgaatggaatccgggttcgggttattggtaatgggtttacggatctgaggcctctgacttttgtaaatattgaagattattgttattggttgtaaatagttagtagtttgggctggagagattagcctattaatctctattttgtgtttgcttatttgggtattagggggaagttttgaatattttgtacataaagaagaagatttagggttcttaattgccaggggctgcatatgtatatatgattatcaaatttgtatttcatttcttgccatttttgctaatgtttcttgatttgaataatgttttgagtgtttaaaatcttgaattcttc

SEQ ID NO: 4628 - DNA, 1279 bp, Capsicum annuum
ggaagcagtagtgagagactcaaaaaatgatgatgattggccgatcacctcactcacatccgaccgtccaagtgcctccttgggatgttatggatgatcagacggttgatgttcactccccattctccgttagtcctgattctgctttcgacgccttgacggcgttgcagcgttacctgccgtcgaatgtaaatgatgtcatgtttgattctgatgggttggacattccggtggacgctttctcatgtgataacttccgtatgtatgagttcaaggtgaggaagtgtgcacgtggaaggtcacatgactggacggagtgtccgtacgctcatcccggcgagaaggctcgccggagagatcctcgtaagtatcattactccggcacttcttgtcctgagtttcgtaaaggtcaatgtaagaaaggtgatgcatgtgagtacgcgcatggcgtattcgagtgttggcttcaccctgctcgctatcgtacgcagccttgtaaggatgggacccactgccaccggcgcgtgtgcttttttgctcacacgccggagcagctccgtgttcttcctcagaacagtccacgaagccatgctgagttgcttgactcgttcgacgggtctccgagtcgactcggatttgaatcgttctcgtcgtctccgctatatgactcgcctccggtgactccacgtggatcactgagtcttaactctgttaatggattggctgaatccatgcgtaatatgcaaattgggatggtgagaggtatgagtagtactcctacccctacatgggggttacaaatgggttctccagtgtttggttcaccacggagcccatcagtgctccgacccgggttcatgagcctgccaacaacgccgacccggaatccgatcggcttaggactggcagtgttcgaccagtgggagaagagttgcgaagaagagccagctatggagagggtagaatctggaagggatctcagagccaaaatttatgctaaactgagcatggagaactctcttgactctggtgctccggatgttggatgggtttccaaactgttgaagtgattcgggttcgggttatgatttgttttgctggtaataaattttgggatttgaggcctcttgacttttattgtaaatatacatggtcattactgaagattactggttgtaaatagcagtttcggctgggggagagattacccttttaatctctattttgtcttttttttatttgggtatttttttaatctctatcgatttgcatcttaaaa

SEQ ID NO: 4629 - DNA, 1692 bp, Nicotiana benthamiana
  misc_feature (1162)..(1162): n is a, c, g, or t
  misc_feature (1185)..(1185): n is a, c, g, or t
  misc_feature (1216)..(1216): n is a, c, g, or t
  misc_feature (1233)..(1233): n is a, c, g, or t
  misc_feature (1247)..(1247): n is a, c, g, or t
  misc_feature (1255)..(1255): n is a, c, g, or t
  misc_feature (1282)..(1282): n is a, c, g, or t
  misc_feature (1297)..(1297): n is a, c, g, or t
  misc_feature (1321)..(1321): n is a, c, g, or t
  misc_feature (1336)..(1336): n is a, c, g, or t
  misc_feature (1351)..(1351): n is a, c, g, or t
  misc_feature (1573)..(1573): n is a, c, g, or t
  misc_feature (1587)..(1587): n is a, c, g, or t
  misc_feature (1594)..(1594): n is a, c, g, or t
  misc_feature (1598)..(1598): n is a, c, g, or t
  misc_feature (1606)..(1606): n is a, c, g, or t
  misc_feature (1621)..(1621): n is a, c, g, or t
  misc_feature (1632)..(1632): n is a, c, g, or t
  misc_feature (1690)..(1690): n is a, c, g, or t
aaatagttaaaaataggtggtactaatataaacctgtccttgtataacactatagtaaacctcgtaatccgcatcaaatgagttgctatctaaatttactgcttgtttgcttagtttagtttttaccctagtaaagttagtaaaaaatagtgggacagtgtaaactgaggatactttaacctaaccatggttagcccagccttttaaccatggttaatatagcagtttataaggctgcaaccatcagcttctttgaaaggcatgcttctaaagagaggcactattgttgttctatacacgaagatccaaaaaaatgatgatgatcggaagatcacctcactcacatccgaccgtccaagtccctccttgggacgttatggatgatccaacggttgatgttccttccccattttccgttacacacaactactccactagtcctgattctggtttcgacgccttaacggcgttgcagcgttacctgccgtcgaatggtaacgacgttttgttcgactctgacggcttggacattcccgtggatgcgttctcatgtgataatttccgcatgtatgagttcaaagtgaggaagtgtgcacgtggaaggtcacatgactggacggaatgtccgtacgctcatcccggcgaaaaggctcgccgtcgggatccgcggaagtatcattactccggcactgcttgtccagattttcgtaaaggcctgtgtaagaaaggtgatgcatgtgagtacgcgcacggcgtattcgagtgttggcttcaccctgctcgctatcgcacgcagccttgtaaggatgggacccactgtcgccggcgcgtgtgcttctttgctcacacgctggagcaactgcgtgttctccctcagaacagtccgcgaagccatgctgctgagtcttgtgactcgttcgacggatcgccgagtcgactcggttttgactcgttttcttcatctcccccgtttgactcgcctccgatgaccccgagtggatcactgagtctcaactcggttaccggactcgctgagtcgatgtgtaatatgcagattgggatggttaggggtatggttagccctacatggggattgcaaatgggttctcccgggttcggttcaccacggagcccatcaacattccgacccggattcatgagncttccaacaactccgacccgaantccgacccgctctggactggctgtgttcgancagtgggagaagacttncgaagaggagccancgatgganagggtagaatctggaagggatctccgngccagaatttatgcnaaactcagcatggaaaactcgctngactcgggtgctccngatgttggatgggtntcagaactcgtgaaatgattcgttttgctgtgatggttttattggatctgcggcttctgacttgtaaatacatgctgctgcttattactgaagattattggtgtaaatagcctgtttcggctggagagattagccttttaatctccattttgtgtttccttatttgggtaatttttattaggtcagtaaactgaaaaaaggaggagtttgaatattttgtanataagaaaaagatntaggaanaagngatctttntttattgcaggagcngcagatgtatntgattatcgatttgtattctcatttcagtcattttttgctaatgtttaaagctttttngt

SEQ ID NO: 4630 - DNA, 1657 bp, Solanum phureja
aaattccaaatacaagaaccccacaaagaacacagtgaaaaatccctcaccttccccactcccaccactttttctctatgatacaaaaataaataaataaattaggcctagatatctacttctatatatatgtagatacagatgtatgtataatcttgagaatctttagtgaaaaaaactttctttttagcttaagcatatgtatgtaataaatacaagctaaatttgtgagtttttcttgaaagggggttttctttaactgctgtcatccccagaaaaagaaagatcgtaattacttggggcaagtctaataatgcctactattgctaaacatgatggtcggcagctggagactgggctgcgaattacctcacaatcaactacccaaatgcagccatggtggcagggttatggtgataatactatgcctttggcaagtgagaatgccgttgcccaggggaagtctgaaggtggcaatgaggaaaaagaaacaaaggcgctagccctggaatctggatcagatggaaataatgagcaatacaagcagcacctcaagcattttgctcccacaactgctgccatcatggctgagcagcagaaggaactcacaggtcattcagctatgttggcgtcatatccatatccagatatgcagtatggcggaatgatgacttatggggcacctgtacatcctcacttatttgaaattcatcatgcccgaatgcctttgcctcttgatatggaagaggaacctgtctatgtgaacgcgaaacagtaccatggaatattaaggcgaagacaaataagagctaaagcagagcttgaaaggaaagctattaaagcgagaaagccatatttgcatgaatctcggcatcagcacgctatgagaagggcaaggggatctgggggccgctttctgaatactaaaaagggcaatgacatggactgtacaccagaggagacgaaaaaatatggggcaaccattccaactcactctggcaactcgtcaggttccgggagttctgatcaagggggaaaggaaggatctacagttcaagacatgcacaaaggacacagccacagtttcgcaactggcaatggccatggttcatctgtgtattttgcccagagcactggaagtgagcaagggaatggccactacggtcgcggaagttggaacctgctggtcaatcaggcttctcagggggcagcttccagcaattaagaagctacactccactgatggaggggtcagcccagcattttcttgtgccatgggtccatttcttgcatcgttcatgcaggcaatgctgaacatacatgcaaggtggcatggggctatgctcaggcaattcattcttggcttggttacttgtactatatgagcgtcgatgaggaagagaatagcatatggcgagtatgatacgttacaaattcgccatttatttgtctttcctctcaccctgtatgtaaataaagaaaaatatatgtcggaatgtaagattagaagcagtttggaatctgatacttcaaagtactgcagcatcttgaatgtgtttggctatttgtaggatgggtttgtaaaattgacacacactgaagttgcttttatgctgtttgcttgattttccaatgaggatctgcaatcctctcatcc

SEQ ID NO: 4631 - DNA, 1584 bp, Solanum tuberosum
tccctcaccttccccactcccaccactttttctctatgatacaaaaataaataaataaattaggcctagatatctacttctatatatatgtagatacagatgtatgtataatcttaagaatctttagtgaaaaaaactttctttttagcttaagcatatgtatgtaataaatacaagctaaatttgtgagtttttcttgaaagggggttttctttaactgctgtcatccccagaaaaagaaagatcgtaattacttggggcaagtctaataatgcctactattgctaaacatgatggtcggcagctggagactgggctgcgaattacctcacaatcaactacccaaatgcagccatggtggcagggttatggtgataatactatgcctttggcaagtgagaatgccgttgcccaggggaagtctgaaggtggcaatgaggaaaaagaaacaaaggcgctagccctggaatctggatcagatggaaataatgagcaatacaagcagcacctcaagcattttgctcccacaactgctgccatcatggctgagcagcagaaggaactcacaggtcattcagctatgttggcgtcatatccatatccagatatgcagtatggcggaatgatgacttatggggcacctgtacatcctcacttatttgaaattcatcatgcccgaatgcctttgcctcttgatatggaagaggaacctgtctatgtgaacgcgaaacagtaccatggaatattaaggcgaagacaaataagagctaaagcagagcttgaaaggaaagctattaaagcgagaaagccatatttgcatgaatctcggcatcagcacgctatgagaagggcaaggggatctggaggccgctttctgaatactaaaaagggcaatgacatggactgtacaccagaggagacgaaaaaatatggggcaaccattccaactcactctggcaactcgtcaggttccgggagttctgatcaagggggaaaggaaggatctacagttcaagacatgcacaaaggacacagccacagtttcgcaactggcaatggccatggttcatctgtgtattttgcccagagcactggaagtgagcaagggaatggccactacggtcgcggaagttggaacctgctggtcaatcaggcttctcagggggcagcttccagcaattaagaagctacactccactgatggaggggtcagcccagcattttcttgtgccatgggtccatttcttgcatcgttcatgcaggcaatgctgaacatacatgcaaggtggcatggggctatgctcaggcaattcattcttggcttggttacttgtactatatgagcgtcgatgaggaagaaaatagcatatggcgagtatgatacgttacaaattcgccatttatttgtctttcctctcaccctgtatgtaaataaagaaaaatatatgtcggaatgtaagattagaagcagtttggaatctgatacttcaaagtactgcagcatcttgaatgtgtttggctatttgtaggatgggtttgtaaaattgacacacactgaagttgctttaatgctgtttgcttgaa

SEQ ID NO: 4632 - DNA, 1584 bp, Solanum tuberosum
tccctcaccttccccactcccaccactttttctctatgatacaaaaataaataaataaattaggcctagatatctacttctatatatatgtagatacagatgtatgtataatcttaagaatctttagtgaaaaaaactttctttttagcttaagcatatgtatgtaataaatacaagctaaatttgtgagtttttcttgaaagggggttttctttaactgctgtcatccccagaaaaagaaagatcgtaattacttggggcaagtctaataatgcctactattgctaaacatgatggtcggcagctggagactgggctgcgaattacctcacaatcaactacccaaatgcagccatggtggcagggttatggtgataatactatgcctttggcaagtgagaatgccgttgcccaggggaagtctgaaggtggcaatgaggaaaaagaaacaaaggcgctagccctggaatctggatcagatggaaataatgagcaatacaagcagcacctcaagcattttgctcccacaactgctgccatcatggctgagcagcagaaggaactcacaggtcattcagctatgttggcgtcatatccatatccagatatgcagtatggcggaatgatgacttatggggcacctgtacatcctcacttatttgaaattcatcatgcccgaatgcctttgcctcttgatatggaagaggaacctgtctatgtgaacgcgaaacagtaccatggaatattaaggcgaagacaaataagagctaaagcagagcttgaaaggaaagctattaaagcgagaaagccatatttgcatgaatctcggcatcagcacgctatgagaagggcaaggggatctgggggccgctttctgaatactaaaaagggcaatgacatggactgtacaccagaggagacgaaaaaatatggggcaaccattccaactcactctggcaactcgtcaggttccgggagttctgatcaagggggaaaggaaggatctacagttcaagacatgcacaaaggacacagccacagtttcgcaactggcaatggccatggttcatctgtgtattttgcccagagcactggaagtgagcaagggaatggccactacggtcgcggaagttggaacctgctggtcaatcaggcttctcagggggcagcttccagcaattaagaagctacactccactgatggaggggtcagcccagcattttcttgtgccatgggtccatttcttgcatcgttcatgcaggcaatgctgaacatacatgcaaggtggcatggggctatgctcaggcaattcattcttggcttggttacttgtactatatgagcgtcgatgaggaagaaaatagcatatggcgagtatgatacgttacaaattcgccatttatttgtctttcctctcaccctgtatgtaaataaagaaaaatatatgtcggaatgtaagattagaagcagtttggaatctgatacttcaaagtactgcagcatcttgaatgtgtttggctatttgtaggatgggtttgtaaaattgacacacactgaagttgctttaatgctgtttgcttgaa

SEQ ID NO: 4633 - DNA, 1601 bp, Nicotiana tabacum
  misc_feature (494)..(494): n is a, c, g, or t
  misc_feature (586)..(586): n is a, c, g, or t
  misc_feature (616)..(616): n is a, c, g, or t
  misc_feature (943)..(943): n is a, c, g, or t
  misc_feature (1002)..(1003): n is a, c, g, or t
  misc_feature (1021)..(1021): n is a, c, g, or t
  misc_feature (1031)..(1031): n is a, c, g, or t
  misc_feature (1033)..(1033): n is a, c, g, or t
  misc_feature (1359)..(1359): n is a, c, g, or t
  misc_feature (1361)..(1361): n is a, c, g, or t
  misc_feature (1365)..(1365): n is a, c, g, or t
  misc_feature (1375)..(1376): n is a, c, g, or t
  misc_feature (1380)..(1380): n is a, c, g, or t
  misc_feature (1384)..(1384): n is a, c, g, or t
  misc_feature (1389)..(1389): n is a, c, g, or t
  misc_feature (1404)..(1404): n is a, c, g, or t
  misc_feature (1415)..(1415): n is a, c, g, or t
ggccattacggccggggaccacaaagaagaaagaacacagtgaaatctctcaccctccactccccctttctctccatataattataaattatacatatattctatatatacatgcatgtataatcttctttaaaatattttgttatcaagaacttgctttttagctttctagatttatgtatagacacaagtgagatttctgagcttttctttaagtgctctcatccccagagaagaagatcgtaattacttggggcagagtctaataatgcctactattgctaaacatgatggccggcagctgcagactgcgctgcgtactacctcacaaccagctatccaaatgcaatcatggtggcagggttatggtgataatactatgcctttggcaagtgaaaatactattgcccaggggaatgctgaaggtggcaatgaagaaaaagaaacaaatgctcaagccacagaatctggatcaaaaggaaataacatgcaanacaagcagcacctcaagcatattacatccacaactgctgccatcatgggtgagcatcagaaggaactcacaggtcattcagctatgttgacntcatatccatatccagatctgcagtatggnggaatgatgacttatggagcgcctgtacatcctcacttatttgaaattcatcatgcccgaatgcctttgcctcttgacatggaagaggaacctgtctatgtgaatgcaaaacagtaccatggaattttaaggcgaagacagataagagctaaagcagagctggaaaagaaagctattaaagcgagaaagccatatttgcatgaatctcggcatcaacacgctatgagacgggcaaggggaactggaggccgttttctgaatactaaaaagctcaatgacatggactgtacaacagaggagcctaaaaaatatggggctactattccnactcactctggcaactcgtcaggttctgggagttctgatcaacgggaaaaggaaggatnnacagttcaagacatgcanaaaggacagngnagtttctcaactggcaatggccatggttcatctgtgtatttttcccagtacgctggaaatgagcaacagaatggccattatagtcatggaagttggagcctgcttgtcagccaggcttctcgtggggcagcacccaacaattaaaacgctactctccagtgatggaggtgtcagcccagcatttgctcgtgccatggttatgtttcttgcatcgtttgtgctttaagtttagctacacctaaacccactgacatgcgaggacttcactgtggtatggctatgctcaggcaattcattcttggcttggttacttgtacttgatgacncnatgnggaagaaagnntatntggngaagnatgatatgttacaanttcgccatttntttatctttcccctcaccctttatgtaaataaagaaaaatatatgtcagactgtaggattagaagcagtttggaaaatctgatactacaaattactgcagcatcttgaatgtgtggctatttgttgggtgggtttgttttgtaaactgacatactatgaagttgttgcttttgtgctgtttgcttg

SEQ ID NO: 4634 - DNA, 1445 bp, Petunia hybrida
tacacaaaaaaatgggattttgagcccttcttgaagggacggagagaaaaagatcgtaattactggggcagagtctaataatgcctactattgctaaacatgatggccggcagctggagactggactgcggattacctctcaatcaactacccaaatgcaaccatggtggcagggttatggcgaaaatactatgcctttggcaagtgaaaatactattgcccaggggaatgctgatggtggcaaccaggaaaaagaaacaaaagctctggccattgaatctggatcaaatggaaataacgtgccataccagcagaacctaaagcatattgcatccacagctgcgaccgttatgggtgaacagcagaaggaacatgcgggtcattcaactatgttggcgtcatatccatatccagatctgcagtatggggcaatgatgacttatgcagcacctgtacatcctcacttatttgaaattcatcacggcagaatgcctttgccacttgacacggaagaggaacctgtctacgtgaatgcaaaacagtaccatggaatcttaaggcgaagacagataagagctaaagcagagctggaaaagaaagctattaaagcgagaaagccatatttgcacgaatcccggcaccaacatgctatgagaagggcaaggggaactggaggtcgttttctgaatactaaaaagctcaacgacatggactgtacatcggaggacccaaaaaaatctggggccactattcctacacactctggcaactcatctggttctgggagttatgatcaacaggaaaaagacatgcacaaaggacacagccatagtttcttaactggaaacaaccacggttcatctgtgtatttatcccagaacactggaaatgagcaagggaatggccactacggtcgtgtaagttggagcctgctggtcaaccaggcttctcggggggctgtttccaacaattaagaagctactctcgtgtgatggaggagtcagccctgcaatttccttgctatcgctccatttcttgcatcacttgaagtttagcctcatgtaggcaatgctggttcgctgatatccgcttgcacacgaggtaacttgactgtggcatgcatggctatgcccaggcaattcattcttggcttggttacttgtactttatgatgcgacgggaaagaagaggacatggtaggtatgatatgtttcaaatttgccatttgtttctttccttcccctcaccctttatgtaaataaagaaaaatatgtctgaatgtagctatgaggtagtttggaatctgatacaattactgcagcattttgattgtgtggctatttgtggattggcttgtttgtaaaacaacacactattaaagtagttgcttttgtgctgtttgcttaattttccaatcgaggatctgcagttctctcgaccctttc

SEQ ID NO: 4635 - DNA, 1593 bp, Solanum phureja
aggctatatttcattggtcattgccaagtaattccaaattattttccacttgtaaatcatcctgtcgccctctctctctctctctctctctcttttctctctttctctctgcttgaaattgtactgacatggctactaactaaatggggtttctctaattgaccgtacaatcacacaaagcttaaatttttcttcttcaacgtacaactattacttcactaggaacttaattccttcagattttcaagaaaaaaggtgtgaattgctcttttataaccatgcatactactgtattttccaaaggaaatgagggggttgtccagaatcaatctgttgcaacattgtgcactgctccttggtggagtagtggttttatgtctcaatctgtggcttttgctgagccttttggacaattgaaatctgcatctgtggagcagcagcctaaggggaatgcaacagagttcactatttcctctggtgattgcaaatcttcagcaaatgggcaaaaactttcaaacgttcaggctgctacctctgttcgcgcagctaatatggactaccgaggtcactttgatctaggttttggtcagtccctgatttctgcaaaatatccttatggagagcaatgcattgggttattttcagcttatgctcctcaactttcgggccgcattatgctaccattgaatttggcttctgatgaaggtccgatattcgtaaatgccaagcagtatcatgggatactaaggcgtcgaaagacccgggctaaggaaatggagaaaaaagctcttaaaccacgcaagccgtacttgcacctctctcgccatctccatgctttgcgccgacctaggggctgtggtggtcgcttcttgaacacaaggaatatgaatggaactatgaagggtggaaaaaaccccgatatgttcaagacaggcgatgttcaaaacttttaccctaccggatcccagaattctgaagtgctgcagtctgatagcagcaatttgagctcaccaaaagaaacatctggaagtaggttctttgattcatcaggggtcactaacatgtactctagtggcaatcttgatcctcttctgttccaaaacctgaggcctccggtccaggcaataccggacatgatgaatactggacacggtattttcatgtctggtaagtgggttggcacagcagatagctgttgcaacctcaaagtttgatagccttggcttgagaacgaggtcaggtgtcacgagttgagcctcacctcatccgtgctacaacctaatgcatacacatttggttgctgacaattgtcggatcatccttggctatcatgggcagttcatccttggcttagcattaacgcggtgcctctatcgttctattgctatcaagcaacgtggatggtaagaggcactaaagccttaatgctactttattttcagctctttgtaggataaataaacttgtttttgataagatgatgacgatgatgaccctgtcgatcggggtctctgatgttgcagtgtgtttggattactgttttgtgattttggtttgtgaaaaatacaatgatgtatgattgaacttgatcca

SEQ ID NO: 4636 - DNA, 995 bp, Solanum phureja
ggggttttgtgcttttgtgagtttgagaaagagaaagagaaaaataaaaatgggaaggggtagggttgagctaaagagaatagagaacaagatcaacaggcaagtgacctttgctaagagaagaaatggacttttgaagaaagcttatgagctttctgttctttgtgatgctgaggttgctctcatcatcttctctaataggggaaaactctatgagttctgcagtagctctagcatgctaaagacgttggagaggtaccagaagtgcaactatggagcacctgaaccgaatatatccacacgagaagcactggaaattagtagccagcaggagtacttgaagcttaaaggacgttacgaagcattgcagcgatcacagaggaatcttcttggtgaagatcttggtcctttgaacagcaaagaacttgaatcacttgagaggcaacttgatatgtcgctcaaacagatcagatcaactcggactcagttaatgttggatcaacttacagatcatcagagaaaggaacatgcattgaacgaagccaacagaaccctgaaacaaaggttgatggaaggaagccaactaaatctgcagtggcagccaaatgcacaagatgtgggctacggccggcaaacaactcaaaatcagggcgatggcttctttcatcctttggattgtgaacctactttgcaaattgggtatcagaatgatccaataacagtaggaggagcaggtccgagtgtgaataactacatggctggctggttgccttgaaagctcatgattctgatcataacattattattataaatatgctcaatggttttcctatcatcataaacattgaatctctcctaattaatttctgtatgttgtttgagaaaacgcttcatcctggactaaacgggggaatccataagacaatcccattattgttagtaaatcataaactagacttccttgagtgcttaatcagttaacttatgttcctcca

SEQ ID NO: 4637 - DNA, 1059 bp, Solanum melongena
agatctgagaagaaaaagggggtttgtggttgtgggagagagaaaaaaaatgggaaggggtagggttgagctaaagagaatagagaacaagatcaacaggcaagtgaccttcgctaagagaagaaatggacttctgaaaaaagcttatgagctttctgttctttgtgatgctgaggttgctctcatcatcttctccaataggggaaaactctatgagttctgcagtagctctagcatgcttaagacgttagaaaggtaccagaagtgcaactatggagcaccagaaacgaatatctccacaagagaagcactggaaattagtagccagcaggagtacttgaagcttaaaggacgttacgaagcattacagcgatcacagaggaatcttcttggtgaggatcttggtcctttgaacagcaaggaacttgaatcacttgagaggcagcttgacatggcgctcaaacagatcagatcaactcggactcagttaatgttggatcaacttacagatcttcagagaaaggaacatgcattgaacgaggccaacagaaccttaaaacaaaggttgatggaaggaagccaactaaatctgcagtggcagccgaatgcacaagatgttggctacggccggcaaacaactcaaactcagggcgatggcttctttcaccctttggaatgtgaacccactttgcaaattgggtttcagaatgatcaaataacagtaggaggagcagggccaagtgtgaataactacatggctggctggttgccttgaaaagctcgtgattctgataacattaatattatatatatgctcaatggatttgctatcataaacattaaatctcctaatttctgtgtgtttgagaaaacgtttcattctggactaattgggaatccataagacaaaccgttattattagtaaattgtattctagatttccttgagtgcttaatcagtgaagttattttcctttattggacattctactttgtttgggtcttggctttcaaaagcaagagacaagtgcagtatacaattgtctcaagtgcacacac

SEQ ID NO: 4638 - DNA, 953 bp, Nicotiana tabacum
gagttgttggagaaagaagaaaaaatgggaaggggtagggttgagcttaagagaatagagaacaagatcaacaggcaagtgaccttcgctaagagaagaaatggacttttgaaaaaagcttatgagctttctgttctttgtgatgctgaggttgctctcatcatcttctccaataggggaaaactgtacgagttctgcagtagctctagcatgctcaagacattagagaggtaccagaagtgcaactacggagcaccagagaccaatatatccacacgagaagcactggaaataagtagccaacaagaatacttgaagcttaaagcacgttacgaagcattacagcgatcacagagaaatcttcttggtgaagatcttggccctttgaatagcaaggaacttgaatcacttgagaggcagcttgatatgtcactgaaacagattcgatcaactcggactcagttaatgttggatcaacttacagatcttcagagaaaggaacatgcattaaacgaagcaaacagaaccttgaaacaaaggttgatggaaggaagccaactaaatctgcagtggcaacaaaatgcacaagatatgggctacggccggcaaacaactcaaactcagggcgatggcttttttcatcctttggaatgtgaacccactttgcaaattgggtatcagaatgatccaataacagtaggaggagcagggcccagtgtgaataactacatggctggctggttgccttgaaattaagctcatttccgataagattgattatataaacatatgctcaatgtttttcctatcataaacactctcctaatttgtgttatatgttgtttgccgaattctggactaatttgggatccataagacagacccgttattgttacttaatcataaactagatttccctgagtgcttaatcactaaagattattactttcctc

SEQ ID NO: 4639 - DNA, 992 bp, Capsicum annuum
aaaagattgatataaagaaaggtctgagaacaaaaaggggttttgtgtttttgagagtttgagttgtgggagaggaaaaaaatatgggaaggggtagggttgagctaaagagaatagagaacaagatcaaccggcaagtgacctttgctaagagaagaaatggacttttgaaaaaagcttatgagctttctgttctttgtgatgccgaggtcgctctgatcatcttctccaataggggaaaactgtacgagttttgcagtagctctagcatgctaaagacgttggagaggtaccagaaatgcaactacggggcaccagagacgaatatatccacacgagaagcactggaaataagtagccagcaagagtacttgaagcttaaaggacgttacgaggcactacagcgatcacagaggaatcttcttggtgaagatcttggtcctttgaacggcaaagatcttgaatcacttgagaggcagcttgatatgtcactgaagcagatcagatcaactcggactcagttgatgttggatcaacttacagatcttcagagaaaggaacatgcattgaacgaagccaacagaaccttgaaacaaaggttgatggaaggaagccagctaaatctgcagtggcagccaaatgcacaagatgtggactacggcaggcaaacaactcaaactcacggagatggcttctttcatcctttggaatgtgaacccactttgcaaatcgggtaccagaatgatcccataacagtaggaggagcaggccccagtgtgaataactacatggctggctggttgccttgatagctcatgattctgataagatcattatatatatgcccaatggttttcctatcatatacattaaatctcataatttctgtatgtttgagaagacgtttcattctgaactaactggggatccataagacaatcccgttattgttattagtaaatcataaactagatttaaaaaaaacctcgtgc

SEQ ID NO: 4640 - DNA, 1029 bp, Petunia hybrida
gggttttgtgcttttgtgagtttcagttttcttagcaagaaaaaaaaaatatgggaagaggtagagttgagcttaagagaatagagaacaaaatcaatagacaagttacctttgctaagagaagaaatggactattgaaaaaagcttatgaactttctgttctttgtgatgctgaagttgctcttattattttctctaataggggaaaattgtacgagttttgcagtagctctagcatgctcaagaccttagagaggtaccagaagtgtaactatggagcaccagagactaatatatccacacgagaagcactggaaataagcagccaacaagagtacttgaagcttaaagcacgttacgaagcattacagcgatcacagaggaatcttcttggtgaagatcttggccctttgaacagcaaagaacttgaatcacttgaaaggcagcttgatatgtcactgaaacaaatcagatcaactcggactcagctgatgttggatcaacttcaagatcttcagagaaaggaacatgcattaaacgaagcaaacagaaccttgaaacaaaggttgatggaaggaagcacactaaatctgcagtggcagcaaaatgcacaagatgtgggctacggcagacaagcaactcaaactcagggagatggcttctttcatcctttggaatgtgaacccactttacaaatagggtatcaaaatgatccaataacagtaggaggagcagggccaagtgtgaataactacatggctggctggttgccttgaaagctcattctgataaagtatatgctcaatgcttttaatttcctatcataaaaaattgtcctaatttctgtattttgttttgacaaatacttttaattctggactaattaattggggacccataaggtaggcccattgttgttagtaaatcataaactagatttccttgagtgcttaatcagtgaagttcttttcttcatttatttggttaagttgccagactcttttcgtatatagtttcatttaaaatctt

SEQ ID NO: 4641 - DNA, 1205 bp, Coffea canephora
aaggttctcattttgtttgagagtgggaaattgtgtatctgtctcaaggcccgcccttaaataatttttctcatctaaactgtggggatgtataaacaggaccgaatagttatctagtatatgtgtaaaagattacatgtattgtgggatgtgcatataaaaagagggaaacaaaagggaaggagcagttttgagggggaaacaagactctgttgttgtggttgtaatttgtgagtttcagtggtaataagaacggaaagagaggtaggagagaggatgggaagaggtagggtggagctaaagaggatagagaacaagatcaataggcaagtaacttttgctaagcgaagaaatgggctattgaagaaagcttatgagctctcagttctatgtgatgctgaggttgctttgatcatcttctccaatagaggaaagctctatgagttttgcagtagctctagcatgctcaagacgctagagaggtatcagaaatgcaactatggagcacctgagcccaacatatccaccagggaagcactggagctgagtagtcagcaggagtatttgaagcttaaagcacgttacgaagctctacaaagatcacaaaggaatcttttgggcgaggaccttggtcctttaaacagcaaggaacttgaatcattggaaaggcagcttgatatgtctctgaagcaaatcagatcaacacggactcaagtaatgctggatcagctcactgatctccagagaaaggaacatgctttgaacgaggcaaacaaaactctaaaacaaaggctgatggaaggaaaccaagtaaatctccagtggaatccgaatgcacaggatgttgggtacggccgacaaccagctcatgctcagggtgatggtttttttcatccattggattgtgaaccgacattacagattggataccagaatgatccaataacagtggcagcggcaggcccgagtgtgaataactacatggcaggttggttaccatgatcagaagaaaaaattgcctgtcatgctaatgattcctttcataagactcgatgcaattgatgttctatgtatttttattttgactaaagaacttgtgtaatagcgtgaattttcataagacactattattataatctcctaatgtggacgaaccttaagtcatgtttgcctgctctaggacttgatctcgtcatatttttttt

SEQ ID NO: 4642 - DNA, 1050 bp, Coffea canephora
  misc_feature (29)..(29): n is a, c, g, or t
ggaaggagcagttttgagggggaaacaanactctgttgttgtggttgtaatttgtgagtttcagtggtaataagaacggaaagagaggtaggagagaggatgggaagaggtagggtggagctaaagaggatagagaacaagatcaataggcaagtaacttttgctaagcgaagaaatgggctattgaagaaagcttatgagctctcagttctatgtgatgctgaggttgctttgatcatcttctccaatagaggaaagctctatgagttttgcagtagctctagcatgctcaagacgctagagaggtatcagaaatgcaactatggagcacctgagcccaacatatccaccagggaagcactggagctgagtagtcagcaggagtatttgaagcttaaagcacgttacgaagctctacaaagatcacaaaggaatcttttgggcgaggaccttggtcctttaaacagcaaggaacttgaatcattggaaaggcagcttgatatgtctctgaagcaaatcagatcaacacggactcaagtaatgctggatcagctcactgatctccagagaaaggaacatgctttgaacgaggcaaacaaaactctaaaacaaaggctgatggaaggaaaccaagtaaatctccagtggaacccgaatgcacaggatgttgggtacggccgacaaccagctcatgctcagggtgatggtttttttcatccattggattgtgaaccgacattacagattggataccagaatgatccaataacagtggcagcggcaggcccgagtgtgaataactacatggcaggttggttaccatgatcagaagaaaaaattgcctgtcatgctaatgattccttttcataagactcgatgcaattgatgttctatgtatttttattttgactaaagaacttgtgtaatagcgtgaattttcataagacactattattataatctcctaatgtggacgaaccttaagtcatgtttgcctgctctaggacttgatctcgtcatattttttttttcttcatcaaaaaaaaaaaa

SEQ ID NO: 4643 - DNA, 988 bp, Unknown
  Sequence found in Organisms: Ipomoea nil, Ipomoea nil
gtgaaaaaaacagaaacttagaaagagagaatgggaaggggtagggttgagctgaagagaatagagaacaagatcaataggcaagtcacctttgctaagcgaaggaatgggctgctgaaaaaagcatatgaactctctgttctttgcgatgctgaggttgctctgatcatcttctccaataggggaaagctgtacgagttctgcagtagctctagcatgctcaagacattagagaggtaccagaagtgcaactatggagcaccagagacaaatatatccacaagggacgctttggagataagtagtcagcaggagtatctgaagctgaaagcgcgatatgaagcgttgcagagatcacaaaggaatcttctaggcgaagatctcggcccgttgaatagcaaggaacttgaatctctggagaggcagcttgatatgtctctgaagcagatcagatcaacaaggactcaaatgatgttagatcaactcacagatttgcagagaaaggagcatgcactaaatgaagcaaacaagagtttgaaacaaaggttgatggaaggaaaccaactaaatctgcactggaatccaaacgcacaagacatgggatatggccgtcagacagctcatcattctcagggtgatgtcttctttcatcctctggaatgtgagcccacattacagattgggtacccaactgatccaataacagtagcaggtccgagtgtgaataactacatgcctgggtggttgccatgaaagctttcatgttgagcagaaggttctgaaaatctcactcttttgtatgcttgatcataaaaaagacatgttttcatcgttttgtacccatgtataagactgtcataagatcattaaattcgagtgtctttaatttgttcctctgcagactcaactcctttagctctgcagcttcagcttgtatgtagatcagagtgaacatatctttgtttctctctgtttcaagatttgacat

SEQ ID NO: 4644 - DNA, 1042 bp, Vitis vinifera
ttgagttgagttgaggggtgaggaaaaatctgttttgcattttgtgtttgttgttgtttggtcggagagaaagctagaggcttttccttttgttcttttcttcatttttcctgagaaaatggggagaggtagggttgagttgaagaggattgagaacaagatcaacaggcaagtgaccttcgctaagagaagaaatggccttctcaagaaggcgtacgaactttcggtgctctgcgacgccgaggttgctctcatcatcttctccaatagaggaaaactctacgagttctgcagtagctcgagcatgctcaaaacccttgagaggtatcagaagtgcaattatggagcaccggagacaaatgtatccacaagggaggccctggagttaagtagtcagcaggaatatttgaaacttaaagcacgttatgaagccctacaacgatcccagaggaatcttcttggggaggatcttggccctttgagcacgaaggaacttgagtcactggaaaggcagcttgatgtatcactgaagcagatcaggtcaacgcgaacacagtacatgctggatcaactcaccgatcttcagagaaaggaacacatgctcaatgaagcaaacaagaccctgaagcaaaggttgttggaaggaacacaggtaaaccagctccagtggaatccaaatgcacaagacgtgggctatggtcggcaacaagctcagcctcagggcgatggcttcttccatcccttagagtgtgagcccacgttacaaatcggataccagcccgatccaataacggttgcagcagcaggccccagtgtgaataactacatgccgggatggttgccatgaccataataagaggaaggccaaccctcacggtatgcatgcattcctttgacaaatgggtataatttctgtgttgtaagttacatgacagaaactgaagaacatgtgtaatattatgggtatccacgtttcccctaatacaccataaaaacagattctattattataactctccatccttagggagaactgtaagta

SEQ ID NO: 4645 - DNA, 1029 bp, Actinidia deliciosa
  misc_feature (230)..(230): n is a, c, g, or t
  misc_feature (289)..(290): n is a, c, g, or t
  misc_feature (298)..(298): n is a, c, g, or t
  misc_feature (325)..(325): n is a, c, g, or t
gagagagagagagagagaaagtcacgcagacaaatagggcactccctcagtgtatgtgcgtctctcaccatgtatctatatatgtgtatatatatatgtacatataacgaaaagccagaaagcatagtgaggaggagctgaagattttgtccagtgtgtattttcgtgatacacacgcagagagagagagagagagagagagagagagagtagaagtatggggagaggtngggttgagctgaagaggatagagaacaaaatcaaccggcaagtgaccttcgccaagcgnngaaacggncttctcaagaaggcctacgagctctcngttctctgcgacgccgaggtcgctctcatcgtcttctccaatcggggaaagctccacgagttctgcagtacgtcgagcatgctcaaaacccttgaaaggtaccaaaagtgcaactatggagcaccagaaccaaatgtatctgcaagagaggccctggagctgagtagtcagcaagagtatttgaaacttaaaggacgctacgaagccctccaacgatcccaaaggaatcttctgggcgaggatcttggccccctaaatagcaaggagcttgagtcgctagaaaggcagcttgacatgtcattgaagcagatcagatctacacggacccagtacatgcttgatcagctcacagatcttcaaagaaaggaacatgcacttaatgaagcaaacaagactctcaaacaaaggctgtggggagatagtcaagtaaactcactccagtggcatccaaatgcacaagatcatgtggactacagcagacaaccagctcaacctcagggtggtgaagccttctttcaccccttggattgtgaaccctcattacaaatcgggtaccagcagaatgatccaataacagtgggaggagcaggtcccagtttgaataattacatgccagggtggttgccatgaacataagaaccacaagccagccaagccatggtatgcattgattcagtccacttagccttttgtatctttgtttt

SEQ ID NO: 4646 - DNA, 1114 bp, Antirrhinum majus
tagtttcgttaatctcaatcatgggataatgcgcatactcagctcgtactattctctgctgactttaagtatgcatacgtgacttcaaatgtgtacatacaaaaacatttataaggaacaagaaagataaagaggatttcgtgttttttgtcaattttgagtgattgagaagagagagagagagagagagatgggaagagggagagttgagttgaagagaatagagaacaagatcaacaggcaagtgacttttgctaaacgaaggaatgggcttttgaagaaagcttatgagctatctgttctttgtgatgctgaggttgctctcatcatcttctccaatagaggaaagctgtacgagttttgcagtaactctggcaccatgctcaaaacactggaaaggtatcagaagtgcaactatggagctcctgaggctaatgtatccaccagggaggcactggaactgagtagtcagcaggagtatttgaagcttaaagcacgctatgaagccctgcagcgttcacaaaggaaccttcttggtgaggatctaggtccattgaacagcaaggagcttgaatcattggagaggcagcttgatatgtccctcaaacagatccgatcaacacggacccaggcaatgctggacaccctcacagatcttcagcgaaaggagcatgccctcaatgaagctaacaggagtctaaaacaccggttgatggagggaagtcagataagtcttcagtggaacccaaatgcacatgatatgggttatggaagacaagctgcagctcaacctcagggtgatggattctttcatcctctggaatgtgaacctactctacaaatggggttccagtctgaaataacagttggagcagcagggcctagtgtgaataactacaacatgacggggtggctgccctgataaaataacatctcgaccaacaatgcaagccttgtttctgcttgtccaacctcataaaaaaccctaaacccaattttaatattctgcttgtcatttcataaaagacaaacttgtttaatttagtatgaacttttatcagacaacgttataattgttcctgttgatggaattactgatataagctattttatt

SEQ ID NO: 4647 - DNA, 734 bp, Ricinus communis
aaatggggagaggtagggttgagttgaagagaatagagaacaagatcaacaggcaagtgacctttgcaaagagaagaaatggactattgaagaaagcatatgagctttctgttctttgtgatgctgaggttgctctcatcatcttctctaatagaggaaagctgtacgagttttgcagtagttcaagcatgctcaaaactcttgagaggtaccagaaatgcaactatggagcaccagagccaaatgtgtctgcaagggaggctttggagctaagtagtcagcaggagtatttgaagcttaaagctcgctatgaagccctgcaacgatctcaaaggaatcttcttggagaagatcttggccctctcagcagcaaggaccttgagtcacttgaaaggcagcttgatatgtcattaaagcagatcaggtcaacacggactcagtatatgctagatcagctcactgatctacaacgcaaggaacacatgctgaacgaagcaaataagaccctgaaacaaaggttggtggaaggataccaagtaaatgcaatgcagctgaatccaagtgcagaagatgtagggtttggccgccaagcagctcagcctcagggtgatggcttctttcatcccttagattgtgaacccactttacaaattggataccaccctgatcaaatagtagtcactgctggcccaagtgtgaataattatatgtcaggatggttaccttgataaaga

SEQ ID NO: 4648 - DNA, 1259 bp, Prunus persica
atcagagagggcttgaggcaatagaaacagaaaaatagaaaaatagaaaagaaaaaaattaaaatatatataaaagaggcaggcagcttagctttgtttcctcggttgttcttgttcttgtttgctgtggtatagtgaggaagggaaataaataataataataagaagaagaagaagaagaaaattaaatagttttggagagagagagagatggggagggggagagtggagctgaagaggattgagaacaagatcaacaggcaggtgacctttgcgaagcgaaggaacgggcttttgaagaaagcctacgagctttccgttctttgcgaggctgaggttgctctcatcatcttctccaatagaggaaagctgtacgagttttgcagtagctcaagcatgctcaaaactcttgagaggtaccagaagtgcaactatggagcaccagagacaaatgtatctgcaagggaggccttggaattgagtagccagcaggagtatttgaagctcaaggcacgttatgaagccctacaacgaaaccaaaggaatcttcttggagaagatcttggccctttaagcagcaaagagcttgaatcacttgaaaggcagctggatatgtctctgaagcagatcagatcgacacggacccaatgcatgctggatcagctcacagatcttcagcgaaaggagcacatgctaaatgaagcaaataagaccctgaaacaaaggttgtttgagggataccatgtaaattcactccaaatgaatccaaatgctgacgagtacggccggcaacaaactcaagctcatggcgatggcttcttccatcccttagactgcgagccgacgttacagattggataccagaacgatccaatatcagtggtcacagcaggtccaagcgtgagtaattacatggcaggatggttgccatgataatagaaagtgtgtatggagagcagccagccatgaatggtgatgcatattttcttttgataagaagagacagtatgttcctttatgtttcttcttcttttttttctttttttaaatttgaccaaaaaaggaccatattgtaattgtatggacttatgccataactctggacctgaagagttgtgtgtgcatgctctcaagcaactgtgctttctttcttttagcttcgcaagctttgctttggaattaataatatatctttctaatattagactctgtatgattttggtgtgtgtaatgtatgccttgcggccctttgccatctt

SEQ ID NO: 4649 - DNA, 783 bp, Cucumis sativus
gggggaaaatagggaaataatagaaataattagaagaatgggaagagggagagtagaactgaagagaatagagaacaagatcaatagacaagtgacattcgctaaacgaagaaatggtctattgaagaaagcatatgaactttcagttctatgtgatgctgaagttgctctcatcatcttctctaatagaggcaaactctatgagttttgcagcagttcaagcatgctcaaaactctagagagataccagaaatgcaactatggagcaccagagcccaatgtctccacaagagaagccttggaactgagcagccagcaggagtatttgaaacttaaagctcgctatgaagctctgcaacgatcccaaaggaaccttttgggagaagaccttggcccattgagtagcaaagaacttgaatctcttgaaaggcaacttgatatgtcactcaagcaaatcagatcaacaaggactcagtatatgttagatcagctcactgatcttcaacgtaaggaacatcttcttaatgaagcaaacaagactctgaaacaaaggttagtagaagggtatcaagtaaatgctcttcaattgaaccaaagtgctgatgatatgatgtatggaagacagcaagctcagccacctggtgatgccttcttccatcctctagattgtgaacccaccctacaaattgggtatcaaccagatcccataacagtggtcactgctgggccaagcatgaataatttcctgccaggatggttgccttgaaaaaccaaaatgaaaaa

SEQ ID NO: 4650 - DNA, 1065 bp, Carica papaya
aaggaattgtggatcgatttgaagtgtgagaaaagagaaaaaaggaaaagaaagaaaaagaaagagagaaaaaaaaaaaatggggagaggtagggttgagttgaagaggatagagaacaagatcaacaggcaagtaacgtttgcaaagagaagaaatggtctgttgaagaaagcttatgaactttccgttctttgcgatgcggaggttgctctcatcatcttctctaatagaggaaagctgtacgagttttgcagtagttcaagcatgctcaaaacacttgagaggtaccagaagtgcaattatggagcaccggagactaatgtgtccacaagagaagcactggagctaagtagtcagcaggaatacttgaagctgaaagcacgttatgaagccctacaaagatcccaaaagaatcttcttggggaagatcttggtcctttaagcagcaaggagcttgagtcactagaaaggcagctcgatatgtcactgaaacaaataagatcgacgcggacccagtacatgctggatcagctcactgacctccaacgtagagaacacatgctcaatgaagctaataaaacgttgaaacaaaggttagtggagggttaccaagttagttcactccaactgaatccaaatgcagaagatgttgggtatggcagacaagcagctccagtacctcagcctgatcctttctttcatcccttagactgtgagcctacattacaaatcggatatcaaccagatccaatatcagtggtgactgcagggccaagtgtgaataattacatgccaggttggttgccatgataataacaattatcagccatggtatgcgatatttcctttttaagagaaatatcagaaaattttatatctttgtacgttagtattaattaatatttaacagcgagaaaaagaaaaacaatgtatgtaatgctctcaattacctcatgactctgcatcgtaagtatcttggagacagtataagtaatttgtttgtgtgtctgcgtgctcaagcaccgcccctcttcttattagtagttgccagctctcttcacaaa

SEQ ID NO: 4651 - DNA, 1263 bp, Theobroma cacao
ccataattaaattagaaatggttttattatatgatctgggattctaatgaagttgttagctaagaccatctaaagaactgagagtataaatagagaaagggttattaaaggtgagcaggagacagaaggaggtatccttgtgtttggctttagcttattggaacggaggagaagaggtttggttgatttgttggagttaagagggaagggtaagaaaggaggaaggagaaaaacaaatggggagaggtagggttgagttgaagaggattgaaaacaagatcaacaggcaagtaacttttgctaagagaaggaatggacttttgaagaaagcctatgagctttccgttctttgtgatgccgaggttgctctcatcatcttctccaatagaggaaagctgtacgagttttgcagcagttcaagcatgatcaaaactttggagaggtaccaaaagtgcaactatggagctccagagacaaatgtgtcaactagggaggctctggagttaagcagtcagcaggagtatctgaagcttaaagcccgttatgaagccctacaaaggtcccaaaggaatttactaggagaagatctgggccctttaagcagcaaagagcttgagtctcttgagaggcagctcgattcatcattgaagcagatcagatcgacgcggacccaatacatgctggatcagctcactgatctccaacggaaggaacatctacttaatgaagccaataagaccctaaaacaaagggctggtgctctgcagttggtggaaggctaccaagtaaattcactccaactgaatccgaatgcagaagatgtgggctatgggcgacaaccagctcagcctcagggcgatggcttttttcatcccttggagtgtgagccaacattacaaattggatatcagcctgatccaatatcagtggtcaacgcggggccaagtgtgaataattacatgacaggatggctaccatgataaagaaggaagcatgggagaatgatgcatgcatggtatgcattccctcataagagtcagcaagcacattttatcatctgttgtatgttatcttgatgaagcaaaacgtgtggatttatattatgacttaatttgtgtcttaattaggatgcactgtaagtaacgcctgtgtgagcgctcaagcactgcgcatctttatttcagcactttttatttgtttgaaataattgttaattgtctgctttggtttgcatcaataaattagctcatgcatccacttttg

SEQ ID NO: 4652 - DNA, 1075 bp, Antirrhinum majus
aagagtttgaggagagagagagatgggaagagggagagttgagctgaagagaatagagaacaagatcaacaggcaagtgacttttgcaaaacgaaggaatgggcttttgaagaaagcttatgagctatctgttctatgtgatgctgaggttgccctcatcatcttctccaatagaggaaagctgtacgagttttgcagtagcactagcatgctgaatacactggaaaggtatcaaaagtgcaactatggacctccagagactaatgtatccacaagggaagcactggaactgagtagtcagcaggagtatttgaaacttaaagcacgctatgaagctctacagcgttcacaaaggaatcttcttggtgaggatcttggtcctctgaacagcaaagagcttgaatcacttgagaggcagcttgatatgtcactcaagcaaattcgatcaacacggactcaagcaatgctggataccctcacagatcttcagagaaaggaacacgccctcaatgaagctaacagaagtttgaaacatcggttgatggatggaagtcaaataagtctccaatggaacccaaatgctgaagatcatgtgggctatggaagacaaccatctcaaccgtcggctgatggattttatcatcctctggaatgtgaacccactctgcatattgggttccagtctgatcaaataacggttgcaggagctgggcctagtgtgaataactacatctcaggctggcttccatgataaattcgagcgaaatgcgagtcttggcttgcattgctctctcataaatttcggaaatttaaaatcttctgtgtgttttttaacaaagacctatatatttgtttaattaatagtatggatctttataaaacaaatgttcttaccatttctctttgtggaatggaatcacttgtgtaatttcttgtgtttgtgcctttcctctcttactttatttcaaatgcaaactttgtaaaggacacctataggtttcatttatactgtcaaggactcatagatgtgaaattttgctattttgaatataaggaaggagaaattgtttcaagc

SEQ ID NO: 4653 - DNA, 757 bp, Antirrhinum majus
  misc_feature (90)..(90): n is a, c, g, or t
  misc_feature (99)..(99): n is a, c, g, or t
gagtgattgagaagagagatgggaagagggagagttgagttgaagagaatagagaacaagatcaacaggcaagtgacttttgctaaacgnaggaatggncttttgaagaaagcttatgagctatctgttctttgtgatgctgaggttgctctcatcatcttctccaatagaggaaagctgtacgagttttgcagtagctctagcagcatgctcacaaccttggaaaggtatcaaaagtgtaactatggagctccagatcacgcaaacatatcaacaagggaggcaatggaactgagcagtcagcaggagtatttgaaacttaaagcacgctatgaagccctacagcgctcacaaaggaatcttcttggtgaggaacttggtccattgaacagcaaggaactggaatcacttgaaaggcagcttgatatgtcgctgaagcagatccgatcaacacggacccaagcaatgctggataccctcacagatcttcagcgaaaggagcatgccctcaatgaagcaaacaggaatttgaaacatcggttgatggaaggaagtcaaataggtcttcaatggaacctaaatgcccaagatatgggctatggaagacaaccaactcaacctcagggtgatggattttttcatcccctggaatgtgaacccactctacaaatggggttccatagtgatcaaataagtgtggcagcagcagcagggccaagtgtgaataacaactacatgtcagggtggttgccgtgat

SEQ ID NO: 4654 - DNA, 1518 bp, Fragaria vesca
gaaagagagagattctgaaacaaggtggtaatggaaattgggagtgtttagaattatttatatgataatttgagaaaaatataattatcgtcgtcatatataaaaggaaggggaggttctgcttttagggtattggggttgggttagtgaggaaagtactgatattgttgtacagagagagagagagaggagaagagagagagagagaaatggggagggggagagtagagctgaagaggatagagaacaagatcaacaggcaggtgacctttgcaaagagaaggaacggactattgaagaaagcctacgagctttccgttctttgcgatgccgaggttgctctcatcatcttctccaatagaggaaagctgtacgagttttgcagtagttcaagcatgctcaaaacactggagaggtaccagaagtgcaactatggagcaccagagacaaatgtatctacaagggaggccttggaattgagtagccaacaggagtatttgaagctcaaggcacgttatgaagccctacaaagaaaccaaaggaatcttcttggagaagatcttggccctttgagcagcaaggagctcgaatcacttgaaaggcagctggatatgtcactgaagcagatcagatcaacacggacccaatgcatgctggatcagctcacagatcttcagcgaaaggaacacttgcttaacgaggcaaacaggacactgaaacaaaggttgtttgagggataccatcatcaactccaactgaatgcaaatgctgaggaagtggcatatggccggcaagaagctcatcagcctcagggcgatggcttcttccaagccttagagtgcgagcccacattacaaattgggtatcaccagaatgatccgattcaagtcgtgacggccgggccgagcgtgaattacatgggaggatggttgccatgataaggactaataataagaacacagcgagcagcaagcaactgtgtatggtgaaaagccatgcatgcatgcacgctatgatgtatgtatgcagctgtatgatttatatgtttgtttcattgtgttttcatttctgttctgagcaaaacaaaacgatcatccaatttgtaatagtatggacttataagtaactctgaacattagagttgtgagtgtttcttttagcttggcgagcttgcttagcaaaattaataagtactagtaccccctttgcatatacagtgtaaaaactttgctgtctggtccatttgaggcaagctttggtactaataatatgttataacatgcttcaaggttgggccttgcccgccaaaaaagaccccgagccaaaaaaaatcggccgccccgccccaaaaaataataaaaaaaccttggggccgggcccgccgtaagaaaaaggcaatccggtcctaggaaccggccagacaatgtgggttccccaaaaaaaccggcgaccggcgctgaaaaacaaagatccgggccacggccataaagaccaggacccaacaaaaccccccccccc

SEQ ID NO: 4655 - DNA, 959 bp, Triphysaria pusilla
gagaaaataaagtttgtgtttttatgtgatagttttagagagagaaattaagacatgggtagaggacgagttgagctgaagagaattgaaaacaagatcaataggcaagtcacttttgccaaacgcagaaatggtttgttaaagaaagcttatgagctttctgttctttgtgatgctgaggttgctttgatcatcttctccaatagaggaaagctgtacgagttttgcagtagccctagcatgctgaaaactcttgaaaggtatcagaaatgcaactatggagcacctgagccaaatatatctgcccgagaggccctggaattgagcagtcagcaagagtatctaaagcttaaagctcgctacgaagccttacagcgtacacaaaggaatctacttggagaggatcttggtcctttgaacagcaaagaactcgaatcactcgaacgccagctcgacatgtcacttaagcaaatccgatcgacacgtacacaaacaatgcttgatacactgacagagcttcagagtaaggagcatgctctcaatgaagctaacaagaatttgaaacaacggttgattgaagggagccaaataagtctgcaatggaacccgaatggtcaagaacatcatcatcatcataatctcgggctgggctatggacaaaggcaacctcagcccgacgggttttttcatcctctcgattgtgaacccactctacaaatcgggtaccagaatgacccgataacggtaggtggggccgggccaagtgtgaacaactacatgtcgggatggttaccatgatcgatcgggttaagttatcgataaataatcccgggggatttgtttgtgtacttgttttgtttgagcagttgatttatatgttgtaaaacactattgtaatgtttgtttttgatgttattttcatgaatgacaatttaattcatgtgcatgtttgtttatta

SEQ ID NO: 4656 - DNA, 751 bp, Manihot esculenta
aaatggggagaggtagggttgaattgaagaggattgagaacaagattaacaggcaagtgacctttgcaaagagaagaaatgggcttttgaagaaagcctatgagctttctgttctttgtgatgccgaggttgctctcatcatcttctctaatagaggaaagctgtacgagttttgcagtagttcaagcatgctcaaaacacttgagaggtaccagaaatgcaactatggagctccagaaacaaatgtatctgccagggaggctctggagctaagtagtcagcaagaatatctgaagcttaaagctcgctacgaagccttgcaacgatcccagagaaatcttctgggagaagatcttggccctttaagcagcaaggagcttgagtcacttgaaaggcagcttgatatgtcattgaagcagatcagatcaacgcgaacccaatacatgctagatcagctcactgacctacaacgcaaggaacaaatgctgaacgaagcaaataagaccctgaaacaaaggctggtggaaggatatcaaataaatactatgcagttgaatccaagtgcagaagaagtggaagcctttggccgccaagcacctcaacatcatggtgatgtcttctttcatccactggagtgtgaacccactttacaaattggataccagcctgatccaataacagtagtgactgctggcccaagtgtgaataattacatgccaggatggttaccctgataattagaagactactt

SEQ ID NO: 4657 - DNA, 1291 bp, Gossypium hirsutum
tttgtttagtgcgtaaaacaaagcaaaaggtttaagtgttttttttttgtttgttggggggggcgggggggttaattctgattacatgatggatgaagttgttagcgaaagcgtatcatccatgacagaataaatagagagaaaagcaagaagaagaacaaaagtgttaaagagagtgtgtttgggggtattgcaaagataatatttttattggggaaaaaaaagaatggggagaggtagggttgagttgaagagaattgagaacaagattaacaggcaagtaacttttgctaagagaaggaatgggcttttgaagaaagcctatgagctttccgttctttgtgatgcagaggttgctctcatcatcttctccaataggggaaaactgtacgagttttgcagtagttcaagcatgatgaaaacattggagaggtaccagaagtgcagccatggagcaccagagacaaatgtttcaactagggaggctctggagctaagcagccagcaggaatatctgaagcttaaagcacgttatgaagccttacaaaggtcccaaaggaatttacttggagaagatctggggcctttgagcagcaaagagcttgagtcacttgagaggcagcttgattcttcattaaagctgataagatcaacgcggacccaatacatgcttgatcagctcactgatctgcaacgaaaggaacatctacttaatgaagctaataagaacctaaaacaaaggttgatggaaggctaccaagtacattcactccagctgaatccaaatgccgatgacgtcggctacggccgacaaccaacccatcagcctcagggtgatgtcttcttccatccattggactgcgagccaacgttacaaatcggatatcagcccgatacgatatcggcggtcaccgggtgcccgagtgtgaataattacatgacgggatggctaccatgactatgatacataaaggaaaatagaagcaaaagcatgaagtggcaaatgcatgcatgcatggtgtccgcattccttcataagaacatcatcagcacattttatcatctgtttgcatgttatttgatgaaacaaaatgtgtgtaatgtgtcatggatttaatattaactttcttgtctttaattctgtaagcactgcgcagcactctttgaaataatgtggtggtgttgtttgcttgtaagagggattccaactctgaccatcatctgctttatttagttttaaatcaacaaaaacaagcatttgttgttgctataacattaatatctttttatc

SEQ ID NO: 4658 - DNA, 1098 bp, Malus domestica
cttttctttgttaacccaactagagagagaagagaaggagaaagagactgagagaattgaagatggtaataatgttaagctcataaccatgaaaatacatagaattatataaaaaaggaaaaaagaaaaataaaagtatataaaaaaagcaaaagaggaagctttttgcaacgattgttgttgtagttgttttttgatcgaaagagagagagagagagagagagagagagagagagagagatgggaagagggagggtggaattgaagaggatagagaacaagatcaacagacaggtgacctttgcgaagagaaggaacggactattgaagaaagcctacgagctttccgttctttgcgatgccgaggttgctctcatcatcttctccaatagaggaaagctgtacgagttttgcagtagttcaagcacgctcaaaactcttgagaggtaccagaagtgcaactatggagcaccggagacaaatatatcaacaagggaggccttggagttgagtagccagcaggagtatttgaagctcaaggcacgttttgaagccctacaacgaaaccaaaggaatctccttggagaagatcttggccctctaagcagcaaagatcttgaatcacttgaaaggcagctggatatgtcgctgaagcagatcagatccacacggacccaatgtatgctggatcagctcacagatcttcagcgaaaggagcacatgctaaacgaagcaaataagaccctgaaagaaaggttgttcgagggataccatgcactccaactgaatgcaaatgccgacgagtacggccgccaacaagctcaggcggcccagggtgatgtcttcttccatcccttagactgcgagccgactttacagattggatatcagaatgatccaatatcggtggtgacagcaggtccaagcgtgagtaattacatgggaggatggttgccatgagtatgcatgcatggtcatcaacaacaacagcagcagctatagtcatgcatgttatttgcagttaatattgataagcaagatacaatctatgcatgttttgtttttatgtttgatttttatttgacctaaaaggatcaa

SEQ ID NO: 4659 - DNA, 1170 bp, Tropaeolum majus
aagtgaagaaagaaaatatatttttgggtattgatttaagcttttcattgtttttcttagtgttgagcaaaaaaaggcaaaaccaaaatgggaagaggtagagttgagttgaagaggatagagaacaagatcaacaggcaagttacctttgcaaagagaagaaatggtcttttgaagaaagcctatgagctttctgttctttgtgatgcagaagttgctctcatcatcttctccaatagaggaaaactgtacgagttttgcagtagttcaagcatgctccgaacacttgagaggtatcagaaatgcaactatggggcaccggagccaaatgtgtcaacaagagaagctatgcaagagtttagtagccagcaggaatatctgaagcttaaagcacgttatgaagccctacaaagatcccaaaggaacttaatgggagaggatttgggtccattgagtagcaaagagcttgaatcacttgaaagacagcttgatatgtcattgaaacagatcagatcaactcggactcagttcatgctggatcaactcactgatcttcaacgtaaggagcatatgcttaatgaagccaataaaaccttgaaacataggctgatggaaggttaccagttgagttcactgcaattgaatccaaatccagaagatgtttgttatggaagacaagctcaacctcttactgatcatcatttcttccctcatgttgactgtgaacccactctgcaaatcggatatcaacatgatccgatgacagtgttgaacgctgggccaagtgtgagtaattacatggcaggttggttaccttgatatcatcatcatcatcttcatcagtttcaccattaataacaaaccattttcatcgaagctttttcaatctcaaccgtcaatttcatccatctatctatctatccattcaatccatccaaaatgttgtttacgctcttttctatgtttgtttactagttaatgtttaacagacaacaacatgtaatggggttattggttaaagttgagtctctttgcaacttattagtaatttttactgaacagtcaaaaagtaaaattgtcttttgtgtatgtatgtatttattatgtgtgtgcgcccgcttcctttttactgaggcttttgttttgaagaataattatgtttgctgattt

SEQ ID NO: 4660 - DNA, 767 bp, Cucumis melo
  misc_feature (220)..(220): n is a, c, g, or t
  misc_feature (351)..(351): n is a, c, g, or t
  misc_feature (383)..(383): n is a, c, g, or t
  misc_feature (425)..(426): n is a, c, g, or t
aaatagggaaataatagaaataattagaagaatgggaagagggagagtagaactgaagagaatagagaacaagatcaatagacaagtgacattcgctaaacgaagaaatggtctattgaagaaagcttatgaactttctgttctatgtgatgctgaagttgctctcatcatcttctctaatagaggcaaactctatgagttttgcagcagttcaagcatnctcaaaactctagagagataccaaaaatgcaactatggagcaccagagcctaatgtctccacaagagaagccttggaactgagcagccagcaggagtatttgaaacttaaagctcgctatgaagctctccnacgatcccaaaggaaccttttgggagaagacnttggcccattgagtagcaaagaacttgaaaatcttgaaaggnnacttgatatgtcactcaagcaaatcagatcaacaaggactcagtatatgttagatcagctcactgatcttcaacgtaaggagcatcttcttaatgaagcaaacaagactctgaaacaaaggttagtagaagggtatcaagtaaatgctcttcaattgaaccaaagtgctgatgatatgatgtatggaagacagcaagctcagccacctggtgatgccttcttccatcctctagattgtgaacccaccctacaaattgggtatcaaccagatcccataacagtggtcactgctgggccgagcatgaataagttcctcccaggatggttgccttgagaaaccc

SEQ ID NO: 4661 - DNA, 1696 bp, Gossypium hirsutum
  misc_feature (96)..(96): n is a, c, g, or t
  misc_feature (866)..(866): n is a, c, g, or t
  misc_feature (875)..(875): n is a, c, g, or t
  misc_feature (1179)..(1179): n is a, c, g, or t
  misc_feature (1221)..(1221): n is a, c, g, or t
  misc_feature (1320)..(1320): n is a, c, g, or t
  misc_feature (1324)..(1324): n is a, c, g, or t
  misc_feature (1344)..(1344): n is a, c, g, or t
  misc_feature (1355)..(1355): n is a, c, g, or t
  misc_feature (1361)..(1361): n is a, c, g, or t
  misc_feature (1373)..(1373): n is a, c, g, or t
  misc_feature (1376)..(1376): n is a, c, g, or t
  misc_feature (1380)..(1380): n is a, c, g, or t
  misc_feature (1383)..(1383): n is a, c, g, or t
  misc_feature (1395)..(1395): n is a, c, g, or t
tagatcacaaaccagtactattttttttccttttttaaatttcatttcattttcattttcccataattattttagaatgttttttagataatcctngattctaatgaagttcttagctcaagaatatcttaaaaaaaaaactctccaaagaagataaatagagaaaaaaaagtatcattaaacaccttcaccaacaagaaccaaaaaaaaaaaaaaaaacaggtgaaatccctttttcttttggtctcaaaacaattcaaaagggaaagattgttggttttagggtttgggttctcattgatttttagtgaaaaaattataaaaaaaaaattatgggaagaggtagggttgaacttaagaggattgaaaacaagatcaacaggcaagtcacttttgcaaagagaagaaatggtcttttgaagaaagcttatgagctttctgttctttgtgatgctgaagttgctctcatcatcttctccaatagaggaaagttgtacgaattttgcagcagctcaagcatgatcaaaacattggagaggtaccaaaaatgcaactatggagctcctgagccaaatgtgtcatctagggaggctgctttggaattaagcagtcgacaggaatatttgaagcttaaagcacgttacgatgccttacaaaggtcccaaaggaatttactaggagaagatttgggacctttgagcagcaaggagctcgagtcacttgagaaacaacttgattcatcattgaagctaatcagatcaacacggacccaatacatgcttgatcagctcaatgatctccaaagaaaggaacatcttcttaatgaagccaataagaccctaaaacaaaggttggtggaagggtancaagtaaantcgttacaattgaatccaaatgcaacggaagacgtcggctatggccgtcaacaggttcatcatcagcctcatggcgatgccttcttccatccactggactgtgagccaactttacaaatcggatatcagcatgatccaatgtcagtggtgactgcagggccaagtgtgaataattatatgacaggttggttaccatagcatatatatctctatatatctatataaagaagaagaaaccatgggtatggatttcttcataagaaacttattttatgttgttgtatgaaacaaaagaaatatgtantgccatggatttattattattattattattgtaactttgtgnttttaattaggatgcactataacaaactccatctgtgtgagctataaagtgcatctttctttgaacaagttaatttgttgttaagagactaatgttttntttngcttatttattacttataantaatcctttcnttaganggaagaattacnatnatangangagggatttacntgtaaaaaaaaaaaaagaaaaaaacgtcgagagtactttctaaggggggccggcggggccattcggttttcccccgggggggggggtaccaggggaaaggggtccccaaattccgccatgaaaggggggggggtattacaagttcgcggggccggggttttaaaacggtcatggacggggggaaaacccggggggttgccccaacctaaataggcccttggggggcaaatcgccccctgtgtgcccggggtggggggagaggggggaggaggggcgccccccccgcagtgcccccctcccc

SEQ ID NO: 4662 - DNA, 1349 bp, Gossypium hirsutum
gacgatgttgttttactttagatcacaaaccagtactattttttttctttttttaaatttcatttcattttcattttcccataattattttagaatgtttttttagataatcctagattctaatgaagttcttagctcaagaatatcattaaaaaaaaaaactctccaagaagataaatagagaaaaaaaagtatcattaaacaccttcaccaacaagaacaaaaaaaacaggtgaaaccccgttttcttttggtctcaaaacgattcaaaagggcaagattcttggttttagggtttgggttttcattgatttttagtgaaaaaattataaaaaaaattatgggaagaggtagggttgaacttaagaggattgaaaacaagatcaacaggcaagtcacttttgcaaagagaagaaatggtcttttgaagaaagcttatgagctttccgttctttgtgatgctgaagttgctctcatcatcttctccaatagaggaaagttgtacgaattttgcagcagctcaagcatgatcaaaacattggagaggtaccaaaaatgcaactatggagctcctgagccaaatgtgtcatcgagggaggctgctttggaattaagcagtcggcaggaatatttgaagcttaaagcacgttacgatgccttacaaaggtcccaaaggaatttactgggagaagatttgggacctttgagcagcaaggaactcgagtcacttgagaaacagcttgattcatcattgaagctaattagatcgacgcggacccaatacatgcttgatcagctcaatgatcttcaaagaaaggaacatcttcttaatgaagccaataagaccctaaaacaaaggttggtggaagggtatcaagtaaattcgttacaattgaatccaaatgcaacggaagacgtcggctatggccgtcaacaggttcatcatcagcctcatggcgatgccttcttccatccattggattgtgagccgactttacaaatcggatatcagcatgatccaatgtcagtggtgactgcagggccaagtgtgaataattatatgacaggttggttaccatagtatatatatatctatatatctatatgaagaagaagaaaccatgggtatggatttcttcataagaaacttattttatgttattatatgaaacaaaagaaatgtgtaatgccatggatttattattattattattattattgtaactttgtgtttttaattaggatgcactataacaaactccatctgtgtgagctataatgtgcatctttctttgaacaatttaatttgtttttaagggattaatattttgttttgcttatttattact

SEQ ID NO: 4663 - DNA, 1081 bp, Citrus sinensis
aagaagcaatagcggaggcaatataatataatactagaagtgatagattataaatagatatatgaatatatagtgatagaagaagaaagaaaggagaagaaaatgggaaggggtagggttgagttgaagaggatagagaacaagatcaacaggcaagtgacctttgcaaagagaagaaatggccttttgaagaaagcttatgagctttccgttctttgtgatgctgaggttgctctcatcattttctccaatagaggaaagctgtacgagttttgcagtagttcaagcatgctcaaaacgcttgagaggtaccagaagtgcaactatggagcaccagaaccgaatgtgtccgcaagggaggccctggagctaagtagccagcaagaatatctgaagcttaaagcacgatatgaagccctacagagatcccaaaggaatctccttggagaagaacttggccctctaaacagcaaagagcttgagtcacttgaaaggcagcttgatatgtcattgaagcagatcagatcaacaagaactcagtacatgctggatacccttactgaactgcaacataaggaacagttgctgagcgaagcaaataagaccctcaaacaaaggttgatggagggataccaagtgaacacacttcaattgaatcctagtgcagaagattgtggttatgggcttaaaccagctcaacctcagggcgataccttctttcacgccttggaatgtgaacccacattgcaaattggataccagcctgcggacccaatatcggttgtcacagcaggcccgagtctgaataattacatgcaaggatggctaccatgctaagagagcggcgggcattaccagtcaatgtattgcagttgatccataagaatcagcaactttgtatccctttgtaagcaaccctattcagtgactaggaacacgcaatcataaggatttattataataactctacagtgatcctgcactttagggaaactgatgacgatatatagctatgttgtgtgtgcgtgtattttcaatcaccgcgcttatctttatttaacaaagccttgtttgagaataa

SEQ ID NO: 4664 - DNA, 1155 bp, Lotus japonicus
ggtgagaaagagagagaagaagaagaagaagaagaagaagagagagatggggagaggaagagtggagctgaagagaattgagaacaagatcaacaggcaagtgaccttcgctaaacgcaggaacggactattgaagaaagcttatgaactttccgttctttgcgatgcggaggttgctctcatcatcttctccaatagaggaaaactgtacgagttttgcagcagttcaagcatgctgaaaacgctagaaaggtaccagaaatgtaactatggtgcgccggaagctaatgtgtctacacgggaagccttggagttaagcagccaacaggaatacttgaagctgaaagcacgttatgaagccctacaacgctcccagaggaaccttatgggggaagatctaggccctctaaacagcaaagagctggagtcacttgagaggcagctagattcatccttgaagcaaataagatctacaaggacccaattcatgctggatcagctctctgatcttcaacgtaaggaacacatgctaagcgaggctaacaggtctctcagacaaaggcagctggaagggtaccaactaaactcactgcaactgaatcccggtgttgaagacatgggatatggccgccatccagctcaaactcatggtgatgccttctatcatccaatagaatgtgagccgaccttacaaattggttaccagcctgatccagtgtcagtggtgacggcaggcccgagcatgaataataattacatggcaggatggctgccatagcggctggggaagctattgtgatgtttccggcgaaagatcaatccactccacgagcaaattcaccgttccattttaatttgaagacaggaaaaggaagaaacaaaaatgaagaaatttgctttggcatgtaatggacttgtagtaagtgtctaatttgtaggagcaactgtctgtgtctgtgtgcatgtgtgcttttcataaaactgcagttctagttcttccctttattattatgatagaagaataataacaataattgctttcacccagttatgattgctctgaatttgacaccaatgacctgtaggggttgttattattaataattataattgttattttgagacattagattcattctgttttatttatttttg

SEQ ID NO: 4665 - DNA, 1153 bp, Lotus japonicus
ggtgagaaagagagagaagaaaagaagaagaagaagaagagagagatggggagaggaagagtggagctgaagagaattgagaacaagatcaacaggcaagtgaccttcgctaaacgcaggaacggactattgaagaaagcttatgaactttccgttctttgcgatgcggaggttgctctcatcatcttctccaatagaggaaaactgtacgagttttgcagcagttcaagcatgctgaaaacgctagaaaggtaccagaaatgtaactatggtgcgccggaagctaatgtgtctacacgggaagccttggagttaagcagccaacaggaatacttgaagctgaaagcacgttatgaagccctacaacgctcccagaggaaccttatgggggaagatctaggccctctaaacagcaaagagctggagtcacttgagaggcagctagattcatccttgaagcaaataagatctacaaggacccaattcatgctggatcagctctctgatcttcaacgtaaggaacacatgctaagcgaggctaacaggtctctcagacaaaggcagctggaagggtaccaactaaactcactgcaactgaatcccggtgttgaagacatgggatatggccgccatccagctcaaactcatggtgatgccttctatcatccaatagaatgtgagccgaccttacaaattggttaccagcctgatccagtgtcagtggtgacggcaggcccgagcatgaataataattacatggcaggatggctgccatagcggctggggaagctattgtgatgtttccggcgaaagatcaatccactccacgagcaaattcaccgttccattttaatttgaagacaggaaaaggaagaaacaaaaatgaagaaatttgctttggcatgtaatggacttgtagtaagtgtctaatttgtaggagcaactgtctgtgtctgtgtgcatgtgtgcttttcataaaactgcagttctagttcttccctttattattatgatagaagaataataacaataattgctttcacccagttatgattgctctgaatttgacaccatgacctgtaggggttgttattattaataattataattgttattttgagacattagattcattctgttttatttatttttg

SEQ ID NO: 4666 - DNA, 938 bp, Tropaeolum majus
aaatgggtagaggtagagtagagttgaagaggatagagaacaagatcaacaggcaagttacttttgcaaagagaaggaatggccttttgaagaaagcttatgagctttctgttctttgtgatgcagaagttgctcttatcatcttctccaatagaggaaagctgtacgagttttgcagtacttcaagcatgctcaaaactcttgaaaggtaccaaaagtgtaactatggagcaccagagccaaatgtgtcaacaagagaggccatgcaagagttaagcagccaacaagagtatttgaagcttaaagcacgttatgaatccctacaaagatctcaaaggaatctccttggagaggatctggggcctttaaacagcaaagaacttgaatcacttgagaaacaacttgatatgtctctaaagcaaatcagatcaacaaggactcagtccatgctggatcagctgagtgatcttcaacgtaaagagcatatgcttaatgaagcaaataaaacattgaaaaataggttaatggaaggatatcaaatgagttcacttcaattaagtcaaggtggagaagaagttggttatggtagacaaacaactcaacctcatcatcatcatacattctttcatcctctagactgtgagcctacattacaaatggggtaccaacatgatccaataacagtggtgaatacaggagcaagtgtgagtaatttcatgccaggatggttaccatgatcatgtcatgcaagtaagcaacatttcgattgatcaaaaacattttcaataaaaaaaaaattaaaaatgtattttgtattttagttacttgttaactttaacggtaagaaaaaaaacaatgtattagtttggtaattctcccagtttatgtaacttagtagtatttggggtatgttgtgaatgccttttggcagaaggctc

SEQ ID NO: 4667 - DNA, 1143 bp, Cichorium intybus
tgggaaagctgaaaggagagagattgtgttaccgctgaatctttgtgtgttttttctgatagattcagtgaacgtgagaatgggaagagggagagtagaattgaagaggatagagaacaaaatcaaccggcaagtcaccttcgccaagcgcagaaatggactgttgaagaaagcttacgagctctccgttctctgtgatgctgaagttgcgttgatcatcttctccaacaggggaaaactgtatgagttttgtagcagctcaagcatgctcaaaacacttgaaaggtatcaaaaatgcaactatggtgcaccagagtcaaatgtttctgcaagggaggcattagagctaagtagtcagcaggagtatttgaaactgaagacacgatatgaagccctacaacgatcccaaaggaatctcctaggtgaagatcttggccctttaaactgcaaggaacttgaacagctagaaaaacagctcgatacatctcttaagcacatcagatcagcccggacgcagctgatgttggacacactttcagatcttcaaaaaaaggagcatgccttaaatgaagcaaacaggactttgaagcaaaggctgatggaaggaaatcaagtaaactcactccaatggtatccacacgcccaacaagaagtctgttacgacagacaacccgcacctcaacaccaaaacgatgaagccttctttcatccactggactgtgggcccactttgcaaatcgggtatcaaacggatccactaacggcggcagcagggccaagtatgagtaattacatgcaaggatggttgccatgttaaaaaataataacggaataatctgttaatttgtgggcatgctatatagcctacccataaaaagatccaggtgtgtttaattaatttttattgtaacttatttggaacaaaatttatgttaacagatttatatatatttctgaaaactgttgcgctgatgacaattttatgttcgtcgaacagtttcactatatatctatttacatgttcttgtatcaaatattcaagtgtaattatgccctaagatagatggcgtagatctagttaactttgtatcaactctaaaagttttttgtattatttttaactataacgtagttttcggaagc

SEQ ID NO: 4668 - DNA, 739 bp, Medicago truncatula
aaaaaaatgggaagaggaagagttgagttgaagagaattgagaacaaaatcaacagacaagttaccttcgctaaacgaaggaacggtcttttgaaaaaagcttatgaactttctgttctttgtgatgctgaagttgctcttatcatcttctccaacagaggaaaactctatgagttttgtagcagttcaagcatgctgaaaacgctagagaggtatcagaaatgcaactatggtgcgcctgagactaatgtgtctgcacgagaagccttggagttaagcagtcaacaagaatatttgaagctgaaggcacgttatgaagcattgcaacgatcccagaggaaccttatgggagaagatcttggccctctgagcagcaaagagctcgagtcgcttgaaaggcagctagattcatccttgaagcaaataagatccacaaggacccaattcatgctggaccagctctctgatcttcaacgcaaggaacatatgctaagtgaggctaacaggtctctcagacaaaggctggaagggtatcaattgaatcaactccaaatgaatgcatgtgttgaagaaatgggctatggtcggcatccaagtcaaactcagggtgatggtctctatcaacagttggagtgtgagccaactttacaaattggctatcagccggatccagggtcagtctgtacggcaggaccaagcatgagtaattacatgggaggatggttaccatagcgacgct

SEQ ID NO: 4669 - DNA, 1171 bp, Populus trichocarpa
gagtgctaaaattaaagaaaggtttttcttgaagagagagagagggagaagatatggggagaggtagggttgagttgaagagaattgagaacaagatcaacaggcaagtaacatttgcaaagagaaggaatggacttttgaagaaagcctatgagctttccgttctttgtgatgcagaggttgctctcatcatcttctccaatagaggaaagctgtacgagttttgcagtagttcaagcatgctcaaaactcttgagaggtaccagaagtgcaattatggagcaccagagccaaatgtgtctgcaagggaggccctggaactgagtagtcagcaggaatatctgaagcttaaagcacgttatgaagccctgcaaagaacccaaaggaatcttttgggagaagaacttggccctctaagcagcaaagagctagaatcacttgaaaggcagcttgatatgtcattgaagcagatcagatcaacaaggacccaatacatgctggatcagctcaatgacctacagcataaggagcacatgctgactgcagctaataagtccctgaaagaaaggttgatggaaggctaccaattaaattcactccagttgaatccaagtgcagaagatgtggagtacgctagacaacaagcccaaccccagggtgatgggttttttcatgctttggagtgtgaacctacactacaaattgggtatcagccagaaaatataacaatggtcactgctggcccaagtatgactacttacatgccaggttggttagcatgataagaagactagctatggttctcactctcagccatgcatggtattcctttcctcaacatgatggttcccatatttgatcagcaaatttgtgttttgtcttgtatgttattgatgaaacagtcttcgtttagcacgtaggtggtctatatcataattctactgcaccgtaggaacagtgcaagtaatgctttgtgtggcgtgtgcaaagcactgcgctgcttcgtttagcacttagcagttgcaggcttttcttttttttttcaaatgaagaataattctcctttgtatgtaagaccataagatactccagcttttaatgtgttcctatctatctgtttatctttacgtgactctcatgatgttctgtgcggtttagaattatgcagaaa

SEQ ID NO: 4670 - DNA, 1187 bp, Mimulus guttatus
gtgagagtttagagtgatttttagagagagaaagagaggagagagagagagagaggagagatggggagagggagagttgagctgaagaggatagagaataagataaacagacaagtgacttttgcgaagagaaggaatggtcttttgaagaaagcttacgagctttctgttctttgtgatgctgaggttgccttgattatcttctccaatagaggaaagctgtacgagttttgcagtagctctagcagcatgctgaaaacactggaaaggtatcaaaagtgcaactatggagcaccagagactaatgtatctgccagagaggccctggaactgagcagccagcaggagtacttgaagcttaaagctcgttacgaagccctacagcattctcagagaaaccttctcggagaggatctcgggccattgaacagcaaggagcttgaatcacttgagaggcaacttgacatgtcacttaagcagatcagatcaactaggacccaagcaatgctggataccctcacagatcttcagaggaaggagcatgcactgaatgaggctaacaggagtctgaaacaccggttgatggaaggaagtcaaataagtctggaatggaaccataataataacgttgaccatgacatgggctatggtagagaagcgccacctcagcctcatcagcccgatggcttctttcatcccctcgactgcggtctgcaaatcggcgggtaccaggcagatcaaataacaggagcagggccaagtgtgaataactacataacaagctggctccagcaataatcgagttccgaccgggccgaaatggatcggatcttgttgcgcatgcatgcatgcatgctctagtcgtttaatttctgtctctcataattaaaaaaaagtactcttatctgagaaaatttcaatttttatgtgtgtttaatttcataaaattgcatgtttaatatatctattatatatatatatatatatatagtagctcggacttattttcagacgacgaccggtggtggtggttgaacaattcgtataacttattttctctgtcatgaggtttctttctttagtttgtagttcatatgcagactatgtaaagaaacactcttgcttcctattcaatttttctactactactgttattattattattgggaattgctttttgctgtttg

SEQ ID NO: 4671 - DNA, 965 bp, Lactuca sativa
cgaaagagagagagattgtgtcacctctgaatctttgtgtttttttggtgatagattcagtgattgtgagaatggggagagggagggtggaattgaagaggatagagaacaaaatcaacaggcaagtcaccttcgcaaagcgcagaaatggactgttgaaaaaggcttacgagctttccgttctctgtgatgctgaggttgctttgatcatcttctccaacaggggaaagctctatgagttttgtagcagctcaagcagcatgctgaaaacactggagaggtatcaaaaatgcaactatggagcaccagagtcaaatgtctctgcaagggaagcactagagctaagtagtcaacaggagtatttaaaacttaagacacggtatgaagccctacaacgttcccaaaggaatcttctgggtgaagatcttgggcctttaaactgcaaggagcttgaatcgctagaaaaacagctcgatacatcactcaagcatatccgatcagcccggacacagctcatgttggacacactttcagatcttcaaaagaaggagcatgcgttaaatgaagcaaacaggaccttgaagcaaaggctgattgaaggaaatcaagtaaactcactccattggtatccacatgcccaacaggaagtctgttatgaaagacaacctcaacctcaacaccaaaacgatgaagcattctttcatcccctcgactgcgggcccactttacaaatcggaaatgggtatcaaacggattcactaacggcaggagcaggagcagggccaagtatgaataattacatgcaaggatggttgccatgttaaaaagaataacatatataataattaattatggtatgggtttgtgggcataaaaaagatcccatgcatgtgtgcttagttaactgctatatattgtaagttatttggaacaaatttatgtcaacagaattaagatcagaaaaa

SEQ ID NO: 4672 - DNA, 976 bp, Taraxacum officinale
  misc_feature (936)..(937): n is a, c, g, or t
  misc_feature (948)..(948): n is a, c, g, or t
cggggatcacggtaggaaagctaggaaggagagagagattgtgttccgctgaatctttgtgtttttttctgatagattcagtgactgtgagaaaatggggagaggaagagtagaattgaagaggatagagaacaaaatcaaccgacaagtgaccttcgccaagcgcagaaatggactattgaaaaaagcttacgagctctccgttctctgtgatgcggaagttgcgttgatcatcttctccaacaggggaaaactttatgagttttgtagcagctcaagcagcatgctgaaaacactggagaggtatcaaaaatgcaactatggagcaccagagtcaaatgtttctgctagggaagcacttgagctaagtagtcaacaggagtatttaaaacttaagacacggtatgaagccctgcaaagatcccaaaggaatctcctaggggaagatcttggccctctaaactgcaaggaacttgaatcgctagaaaaacagctcgatacatctctcaaacatatcagatccgcccggacgcaactcatgctagacacactttcagatctccaaaagaaggaacaagcgttaaatgaagcaaacaggaccttaaagcaaaggctgatagaaggagatcaagtaaactcactccattggtatccacatgcccaacaagaagtttgttatgaaagacaacctcaacatcaaaacgatgaagccttctttcatcctctcgactgtgggcccactttacaaatagggtatcaaacggattcaatgacagcaagtggggcagggccaagtatgaataattacatgcaaggatggttgccatgttgaaaaaaaaaatagcgtaataattaatcgatcgggttgtgtgggtatgatataaaaatacatcccagtgtgtttattatctaattgttatgtaagttatttcaaannaatttatgtcnacagatctacatatatatatattttttc

SEQ ID NO: 4673 - DNA, 895 bp, Populus trichocarpa
ggagagggggtgagagagagagagagagagagagtaaagaaaggagaagagaagccttctgtgtgtggagaattgttgggatttgttgacttgagtgctgaaataaaagaaagatttttttgaaggaaagaaagaaaggagaaattatggggagaggtagggttgagttgaagagaattgagaacaagatcaacaggcaagtaacatttgcaaagagaaggaatggacttttgaagaaagcctatgagctttccgttctttgtgatgcagagattgctctcatcatcttctccaatagaggaaagctgtacgagttttgcagtagttcaagcatgctcaaaactcttgagaggtaccagaagtgcaactatggagcaccagagccaaatgtgtcagcaagggaggccttggaactgagtagccagcaggaatatctgaagcttaaagcacgctacgaagctctgcaaagaacccagaggaatcttttgggagaagaccttggccctctgagcagcaaagagcttgaatcacttgaaagacagcttgatatgtcactgaagcagatcagatcaacaaggacccagtacatgctggatcagctcaatgatctacagcataaggaacacatgttgactgcagctaataagtctctgagagaaaggttgatggaaggctacgaagtaaattcactccagttgaatctaagtgcagaagatgtgggtttttctcgacaacaagctcaaccccaaggttatggattctttcatcctttggagtgcgaacctactttacaaattgggtatcagcctgacagtgctataacagtggtcacttctggcccaagtatgactgcttacatgccaggttggttaccatgataggaggactaccgcgc

SEQ ID NO: 4674 - DNA, 888 bp, Populus trichocarpa
ggagagggggtgagagagagagagagagagagagtaaagaaaggagaagagaagccttctgtgtgtggagaattgttgggatttgttgacttgagtgctgaaataaaagaaagatttttttgaaggaaagaaagaaaggagaaattatggggagaggtagggttgagttgaagagaattgagaacaagatcaacaggcaagtaacatttgcaaagagaaggaatggacttttgaagaaagcctatgagctttccgttctttgtgatgcagagattgctctcatcatcttctccaatagaggaaagctgtacgagttttgcagtagttcaagcatgctcaaaactcttgagaggtaccagaagtgcaactatggagcaccagagccaaatgtgtcagcaagggaggccttggaactgagtagccagcaggaatatctgaagcttaaagcacgctacgaagctctgcaaagaacccagaggaatcttttgggagaagaccttggccctctgagcagcaaagagcttgaatcacttgaaagacagcttgatatgtcactgaagcagatcagatcaacaaggacccagtacatgctggatcagctcaatgatctacagcataaggaacacatgttgactgcagctaataagtctctgagagaaaggttgatggaaggctacgaagtaaattcactccagttgaatctaagtgcagaagatgtgggtttttctcgacaacaagctcaaccccaaggttatggattctttcatcctttggagtgcgaacctactttacaaattgggtatcagcctgacagtgctataacagtggtcacttctggcccaagtatgactgcttacatgccaggttggttaccatgataggaggact

SEQ ID NO: 4675 - DNA, 1282 bp, Glycine max
aagatggttttgctctcacattcatacaaataataatttaacaaatcataatatataatattccccttttattattattattgtaaggtcttgacaccatctctcgtggctatataaatatatatgcgtgtacaagacatacacgcagcgagcgagccacgaaaatattcatcacacagggttttggtttattattccaatttttggttttcccttttgttggatattagagtgtgtaagaaagagaagagagagaaatgggaaggggaagagtggagttgaagagaattgagaacaagatcaacaggcaagtgacctttgcaaaacgaaggaacgggcttttgaagaaagcttacgagctttccgttctttgtgatgccgaggttgctctcatcatcttctccaatagaggaaaactgtacgagttctgcagcagttcaagcatgctcaaaacgctagagaggtaccagaaatgtaactatggtgcgcctgaggctaatgtgtctacacgggaagccttggagttaagcagtcaacaggagtacttgaagctgaaggcacgttatgaggccctacaacggtcccagaggaaccttatgggagaagatcttggtcctttaagcagcaaagagctcgagtctcttgaaaggcagctagattcgtccttgaagcaaataagatcaaccaggacccagttcatgttggatcagctctctgatcttcaacgtaaggaacacttgctaagtgaggctaacaggtctctcagacaaaggcagttggaagggtatcaaataaatccactccaactgaatcccggagttgaagagatgggatatggcaggcatccagctcaaactcatggtgaagccctctttcaacaaatggagtgtgagccaacgttacaaattgggtatcagcctgatccagtatcagtggtgacagcaggcccaagcatgagcaattacatggcaggatggttaccatagtttgcgtttcctgcataagatccactgcaccagcacatttgccgttccaattttatttgaaaacgaaaaaaaaagaaggaagaaaatggctttggatgtaatgaagctgtaagtgtctgccgtgtatgaagtaggaacaaagttaagcagtgttgtttgtgtgtgctagctctttcataaaactgcacttctttgcttcggttactgtttcttcccttttaataagagtattgatagacaaattataaacatctacctattttttcatccattccattttttatcttatttctttc

SEQ ID NO: 4676 - DNA, 1160 bp, Glycine max
gcagtagcgagcggaccacgaaaatattcacagggtttggtttattccaatttttatttttagtttttccctttattggacattagagtgtgtaagagagagagagagaaatgggaagaggaagagtggagttgaagagaattgagaacaagatcaacaggcaagtgacctttgcaaaacgaaggaacgggcttttgaagaaagcttacgagctttccgttctttgtgatgccgaggttgctctcatcatcttctccaatagaggaaaactgtacgagttctgcagcagttcaagcatgctcaaaacgctagagaggtaccagaaatgtaactatggtgcgcctgaggctaatgtgtctacacgggaagccttggagttaagcagtcaacaggagtacttgaagctgaaggcacgttatgagtccctacaacggtcccagaggaaccttatgggagaagatcttggccctttaagcagcaaagagctggagtctcttgaaaggcagctagattcgtccttgaagcaaataagatcaacaaggacccagttcatgctggatcagctctctgatcttcaacgcaaggagcacttgctaagtgaggctaacaggtctctcagacaaaggcagttggaagggtatcaaataaatccactccaactgaatcccggagttgaagagatgggatatggcaggaatccagctcaaactcatggtgaagccctctttcaacaaatggagtgtgagccaacgttacaaattgggtatcagcctgatccagtatcagtggtgacagcaggcccaagcatgagcaattacatggcaggatggctaccatagtgggcgtttcctgcataagatccactgcaccacatttgccgttccaattttatttgaaaacgaaaaaaaaaacaacaaaaaagaaggaagaaaatggctttggatgtaatgaagctgtaagtgtctagtctaccgtgtatgaagtaggaacaaagttaagcagtgttgtttgtgtgtgctctttcataaaactgcacttctttgcttcggttactgtttcttcccttttaataagggtattgatagacaaattataaacatctaccttttttttcttctttccattctatttttatctaatttatcttctctttctttttt

SEQ ID NO: 4677 - DNA, 1055 bp, Juglans hindsii x Juglans regia
  misc_feature (44)..(44): n is a, c, g, or t
  misc_feature (1027)..(1028): n is a, c, g, or t
gggggcttttccttactcttttgttcgctttgtttagagcatgnattatcttgttaaaccaatcaaagtttctaggactcagctcgctcggcgaatctcttatgtttgacgaacggtctgagactgagatacagtacaaatagagcaacagcatagaagcatttgatttctgtatttttcgcagctgaataaatatttttgcctgtgggaaaatggggaggggaagagtggagctgaagaggatcgagaacaagatcaacaggcaggtgacctttgctaagcgaagaaacggacttttgaagaaagcctacgagctttccgtcctttgcgatgctgaggttgctctcatcatcttctccaataggggaaagctgtacgagtttagcagtagttcaagcatgctcaagacactagagaagtaccagaaatgcaactatggagtaccagatcaccagacaaacgtatccgccagagaggccttggagttgagtagtcagcaggagtacttgaagcttaaagcacgttatgaatccctgcagcgaacccaaaggcatcttctgggagaagatcttggccctttaagcatcaaagagctcgagtcactagaaaggcagctggacatgtcactcaagcagatcagatcaacacggacgcaacacatgctggatcagctcactgaacttcaacataaggaacacatgctcaatgaagcaaataagacactgaaacaaaggctggtggaaggataccatataaattcactgcaactgaatccaaatgacaacgatatgggatacggccgacaccctgctgatcaaactcagggtgatgacttctttcatcccttgtgtgaacccaccttacaaattggatatcagcatgatcctttaccagtcgtcacagcaggcccgagcatgaataactatatgccatcagggtggttgccatgattataaagaagggcatgaatggtgagacacggcatgcatgcattgattccttcgacaagaatcagtacaatatatannggtcgttctcatgtcgtttaatggaaa

SEQ ID NO: 4678 - DNA, 976 bp, Arachis hypogaea
cagtgtgtctataatacatacacagacagatagataataataataataataataacaacatacactctctttttcttttcctcagaaccatatcttctttatcttgtaataataataatagttgtaatattgagagagtgtgagagagatgggaaggggaagggtagagttgaagagaattgagaacaagatcaacaggcaagtgacctttgcaaagagaagaaacgggcttctgaagaaggcgtatgagctttcagttctatgtgatgctgaggttgctctcatcatcttctccaataggggaaaactgtacgagttttgcagcagttcaagcatgctgaaaacactagagaggtaccagaaatgtaactatggagcaccggaaactaatgtgtcaactagggaagccttggaattaagcagtcaacaagaatacttgaagctgaaggcacgttatgaagccctacaaaggtcccagagaaacctgatgggagaagatcttggccctctaagcagcaaagagctggagtcactggaaaggcagctagattcgtcgttgaagctaatcagatccacaaggacccaattcatgctggatcagctatcggaacttcaacgtaaggaacacttgctaagtgaggctaacagggctctcagacaaaggcagttggaagggtatcaaataaatccaatgcagctgaatcctggtggtgttgatgatatgggatatgcccgccatccacctcaacctcagccggatcctcttttccagcaattggattgtgagcctaccttacaaattggatatcagcctgatccagtatcagtggtcacggcaggcccaagcatgggcaattacatgggaggatggctaccatagaatgaatataccaagctccatgccttgtgacacccacttcagcttcatatatctatctcgtttattttcaattttatttcacaaactaaaaaaaaa

SEQ ID NO: 4679 - DNA, 999 bp, Helianthus annuus
  misc_feature (912)..(912): n is a, c, g, or t
ctgtgagagaatgggtagaggaagagtagaattgaagagaatcgagaacaaaatcaaccgacaggtcaccttcgctaaacgccgtaatggactgctgaagaaagcttacgagctttcggttctctgcgacgctgaagtcgccttgatcatcttctctagcagaggaaaactgtttgaattttgcagcagctcaagcatgcttaaaacactcgagaggtatcaaaaatgcaactatgaagcgcctgagtcgaatcatactgcaagggaggcactggagctaagtagtcagcaggagtatatgaaacttaaggcgaagtatgaagcactacaacgatcccaaaggaatcttctgggtgaggatcttggccctttaaactgcaaggagcttgagtcgctagagaggcagctcgacacatctctcaagcatatcagatcagcgcggacgcagctcatgttggacacactaacagatctccaaaagaaggagcatgcactaaatgaagcaaacaccacactgaagcaaaggttgatagaaggaaatcaaataaactcactccactggtttcaacacgccgagcaacaagtctgttatgacagacaacctgcacctccacaacaaagcgaagaaaccttctttcacccgctcgactgtgggcccacgttacacatagggtaccaaatggatccattaacaacgacagaagcagggccgagtatgaataattacatgcaaggatggttgccatgttgaaaggtaataacacaatgttgatcaggttgtgagcataaattataaagattcaaggtgtgtttaatctttatcgtaagtgatttgcaacaaacaaatattgacagatctatatgtatatttataaaaactgttgtcgttttgatgacaatttcatgttctgncagtttaagaaacggtttcaattgtaacttacttttaaaagtcttaagtttataattttgtcttgtatgttttaaaaaaaataaaaa

SEQ ID NO: 4680 - DNA, 1473 bp, Solanum tuberosum
tctctgtaactacaaacataaatcatatcaattcaaatcatttttttgaagaaaaagtaatggtggaattgcaatttcctgctggatttcgattccatccaactgatgaagagcttgtgatgcactatttatgtcgaaaatgcgcctctcagccgattgctgttcctattatagctgaaattgacctctacaagtataatccatgggatctacctgatttggctttgtatggtgagaaagagtggtatttcttttcgccgcgagatcggaagtatccgaacggttcacggccgaatcgagctgcgggaaatggatattggaaggcgacgggtgcggataagccgattggtcgtccaaaatcgatgggaattaagaaagctttggtgttttacgcaggcaaagctccgaaaggagaaaaaaacaaattggattatgcacgaatatcgacttgctcatgttgatcgatctgctcgtaacaagaacaatagcttaagacttgacgattgggttttatgtcgaatctacaataagaagggtacagttgagaagaatcaactgaatattcgaaaaatgaatgttgaaatgtcgccggcggtgagtgaaggtgatgtaaagccggagattatgccgttttcagtttcaacaaagccgtcttcgacgtcctaccacgtttacaatgacttcacgtactttgcctcatcggattctcttccgaaacttcacaccgattccagctgctcggagcacgtaccttcgccggagttcacatgcgagaaggaagttcagagcgaaccgaaggtgaaactgagtgagtgggaaaaaactgcccttgattttccgtttaattacacagatgccactacttctgagttgcagagttgttatgagatgtcaccgctacaagatatattcatgtatctgcaaaagccgttttaagtggggcccgccggttttccattttgatcgcacgtgcgaatgagactgaagtcgatgacttggcacgtgccgatgatttgtaggaattggaaaaaaagagtagtatctttgggttttccatttgctttcacattggctatttttttttgttttggagaaaagaaaaaaacaaaacaaattggttgtatatagttttttttttagtagaaggaagaaaaattagtagaaaactaagttgtgaaatgatatatttattggatttattaggatacttgtggaagtatttgattgatactcacaaattgtaaggaatatttagactccgcatatatgtatatgatttagaggtattaaaaatgagctcaattttaggtaattcgtcaaatttgtttggaattttaagggttgagctcaagataatttgaattgggtttaatttctacccactcaagtcgtaacgaatcttcaattgagctcaatttaatctctagaatcaacccgttcttaaaactctttatttgcattaatgtaatgtac

SEQ ID NO: 4681 - DNA, 1269 bp, Solanum phureja
atttgcttctcctcccctgtgttctacgtttcaattttcaaaagcacctctttctctgtaactacaaacataaatcatatcattttttgaagaaaaagtaatggtggaattgcaatttcctgctggatttcgattccatccaactgatgaagagcttgtgatgcactatttatgtcgaaaatgcgcctcacagccgattgctgttcctattatagctgaaattgatctctacaagtataatccatgggatctacctgatttggctttgtatggtgagaaagagtggtatttcttttcgccgcgagatcggaagtatccgaacggttcacggccgaatcgagctgcgggaaatggatattggaaggcgacgggtgcggataagccgattggtcgtccaaaatcgatgggaattaagaaagctttggtgttttacgcaggcaaagctccgaagggagaaaaaacaaattggattatgcacgaatatcgacttgctcatgttgatcgatctgctcgtaacaagaacaacagcttaagactcgacgattgggttttatgtcgaatctacaataagaagggtacaactgagaagaatcaactgaatattcgaaaaatgaatgttgaaatgtcgccggcggtgagtgaaggtgatgtaaagccggagattatgccgtattcagtttcaacaaagccgtcttcgacgtcgtaccacgtttacaatgacttcacgtactttgattcatcggattctcttccaaaacttcacaccgattccagctgctcggagcacgtaccttcgccggagttcacatgcgagaaggaagttcagagcgagccgaaggtgaaactgaatgagtgggaaaaaactgcccttgattttccatttaattacacagatgccactacttctgagttgcagagttgttatgagatgtcaccgctacaagatatattcatgtatctgcaaaagccgttttaagtggggcccgccgattttcaattttttcgatcgcacgtgcgaatgagactgaagtcgatgacttggcacgtgccgatgatttgtaggaattgaaaaaaagtagcatctttgggttttccatttgctttcacattggctatttttttttgttttggagaaaagaaaaaaacaaaacaaattggtcgtatatagtttttagtagaaggaagaaaaattagtagaaaactaagttgtgaaatgatatatttattggatttattagtatacttgtggaagtatttgattgatactca

SEQ ID NO: 4682 - DNA, 1187 bp, Solanum tuberosum
tctctgtaactacaaacataaatcatatcaattcaaatcatttttttgaagaaaaagtaatggtggaattgcaatttcctgctggatttcgattccatccaactgatgaagagcttgtgatgcactatttatgtcgaaaatgcgcctcacagccgattgctgttccgattatagctgaaattgatctctacaagtataatccatgggatcttcctgatttggctttgtatggtgagaaagagtggtatttcttttcgcctcgagatcggaagtatccgaacggttcacggccgaatcgagctgcgggaaatggatattggaaggcgacgggtgcggataagccgattggtcgtccaaaatcgatgggaattaagaaagctttggtgttttacgcaggcaaagctccgaagggagaaaaaacaaattggattatgcacgaatatcgacttgctcatgttgatcgatctgctcgtaacaagaacaatagcttaagacttgacgattgggttttatgtcgaatctacaataagaagggtacaattgagaagaatcaactgaatattcgaaaaatgaatgttgaaatgtcgccggcggtgagtgaaggtgatgtaaagccggagattatgccgtattcagtttcaacaaagccgtcttcgacgtcgtaccacgtttacaatgacttcacatacttcgattcatcggattctcttccgaaacttcacaccgattccagctgctcggagcacgtgccttcgccggagttcacatgcgagaaggaagttcagagcgaaccgaaggtgaaactgaatgagtgggaaaaaactgcccttgattttccatttaattacacagatgccactacttctgagttgcagagttgttatgagatgtcaccactacaagatatattcatgtatctgccaaagccgttttaagtgggggcccgccgattttcaattttttttgatccgcaccgtgcgaatgagaactgaagtcgatgaccttggcacgtggccgatgatttgtatgaatttgaaaaaaatagtatctttgggttttccatttgctttcacattggctatttttttttgttttggagaaaagaacaaaacaaaacaaattggtcgtatatagtttttttagtagaaggaagaaaaattagtagtacctaagtggtgaaatgaaaa

SEQ ID NO: 4683 - DNA, 1166 bp, Solanum tuberosum
tctctgtaactacaaacataagtcatatcaattcaaatcatttttttgaagaaaaagtaatggtggatttgcaatttcctgctggatttcgattccatccaactgatgaagagcttgtgatgcactatttatgtccaaaatgcgcctcacagccgattgatgttccgattatagctgaaattgatctctacaagtataatccatgggatcttcctgatttggctttgtatggtgagaaagagtggtatttcttttcgcctcgagatcggaagtatccgaacggttcaaggccgaatcgagctgcgggaaatggatattggaaggcgacgggtgcggataagccgattggtcgtccaaaatcgatgggaattaagaaagctttggtgttttacgcaggcaaagctccgaagggagaaaaaacaaattggattatgcacgaatatcgacttgctcatgttgatcgatctgctcgtaacaagaacaatagcttaagacttgacgattgggttttatgtcgaatctacaataagaagggtacaattgagaagaatcaactgaatattcgaaaaatgaatgttgaaatgtcgccggcggtgagtgaaggtgatgtaaagccggagattatgccgtattcagtttcaacaaagccgtcttcgacgtcgtaccacgtttacaatgacttcacatacttcgattcatcggattctcttccgaaacttcacaccgattccagctgctcggagcacgtgccttcgccggagttcacatgcgagaaggaagttcagagcgagccgaatgtgaaactgaatgagtgggaaaaaactgcccttgattttccatttaattacacagatgccactacttctgagttgcagagttgttatgagatgtcaccactacaagatatattcatgtatcctgcaaaagccgttttaagtgggggcccgccgattttcaattttttttgatccgcaccgtgcgaatgagaactgaagtcgatgaccttggcacgtggccgatgatttgtatgaatttgaaaaaaatagtatctttgggttttccatttgctttcacattggctatttttttttgttttggagaaaagaacaaaacaaaacaaattggtcgtatatagtttttttagtagaaggaagaaaaattagtag

SEQ ID NO: 4684 - DNA, 2850 bp, Capsicum annuum
taacacgaaaaacgtagttttattgccaagggtaataagcagttacattaatattggcatatatatatatgtaatacaccaacacagacacacacatcctaaggtttcataattaacttcagtaatcaatagttcgccatagctgatttgcttcttatttttattgtcataaatattcccttatagtactgggaaatataattctatctcttccttctcataagccaggctgctacacatgaaaccctgtagtaatttagcagtgacgctcgtcatcactgctgtcgctgcagtcactgccgctaccgtaaccacccatggccttcctcctacggtgttgtttcttgtaagtagtgcaacccgaagagcccattccatagccaccatgtcccccatgtgtctttccaaagcccataacatggcccaaaggtgtgcccgttccttggcccaaacccaagcccagcccattggacccaggcttgtgcatgtggtgattaccatattcatgagagtaggtactgttgtggcccgaaccatagcccgaaccgtgagtgttgtggcccaaaccatagcccgaaccatgagtgttatggcccgtaccatagcccaactttccatggcccatcataggcccacatgggttgctaccatgttgatggccatggctagcgccgtagcccatcattccaggcttggtttcgtagcaactctctttctcatagtaagatttttcatattcagagttcgagtaagtagttggtttttggttaccatagttatagtaatcgaactctttgccttcttctttgtagcaatgcattgaagccataatggatttttctttttgtaatttgatatgtaagaatgtgtgttgtttggtgaaaagagtataaataagctaaaaataaaacatcaataatacatgcgggtttgaagtgccgatatgcaatctgagttgcaacatattacttaaaatgattcacgtcaacaacggcaagacagggaagctaacagctagaaaggaatactagacaccaaaaatgcctagtacttttgaggtggtttttgggtaggaagcaaaccaaaacgcttcttcagaagcactctttgccttgaaaatttatcatcaggcgaaaagcgggctgggtgagcagattgtgtggccaaacccagtggtgactctttcttagtggtgtaaactttgtcaccattgtcattgatgtaaaactggagatacatccttctttaatgtttcaccaagaaagcagccagcagtagcgcctccaatacacttcacatccttacgtatatcagagctattcaaaactgttgcaaaaagaaaatgggagcagtggaattgcgattgcccgccggatttcgatttcacccgactgatgaagagcttgtgacgcactatttatgtcgaaaatgcgcgtcacagcctattgctgttcctattatagctgaaattgacttgtacaagtacaatccatgggatcttcctgatttggcgttgtatggggagaaagagtggtatttcttttcaccgcgagatcggaagtatccgaatggttcacggccgaatcgagctgccggaaatgggtactggaaggcgacgggtgccgataaggcaattggtcgtccaaagccaatgggaattaagaaagctttggtattttacgcagggaaagctcccaaaggagaaaaaaccaattggattatgcacgagtatcggcttgctcacgttgatcgatctgctcgtaacaagaacaatagcttaaggctggatgattgggtattatgccgaatatacaataagaagagtacaattgagaagagccaattgaatagtcgaaaaatgaatgttgcaatgtcacccgtggatattaaaccaaaaattatggcatttccggtatcgacaaggccatcggtgacgtctcagcaagttaacaatgacttcatctacttcgattcatcggattctctcccaaaacttcatactgattccagctgctccgagcacgtgctttcaccggagttcacgtgcgagagggaagttcagagtgagccgaaagtgagtgagtgggagaaaaacgcccttgattttccttttaattacagtgatgatgccacgacgacgatgggggagttggagagctgttatgagatgtcgccgcttcaagatatattcatgtatctacaaaagccattttgaattttgatgagaaagagtgggttggtccctctcattcatatgtcctgtcgcacgtgcaaaagagactgacgtcaatgacttggcacgtgctgatgtttttgaagtagcagtatcttttgctttcacattggcaatttctttactggaaagaacaacaacaaattggcgttcatactgctccaagtagttactagtagttagtagtgggacgaaaatggtagcggtaaagaagttttggatgatacagccagttttgtcagtgtagaaactagtaagtgtggtctcattgactaaccgagactggagtagctacatagtgttcctttccagggtaaactaaatttctgtccagggcaaactacaacagtttacagctttagatcgggtgcaatataaaatttcaacacaattattttgttgtgtatctcaaataatcagttgagattgtatatccgtacacgccctatacaagaaaaaagaatggtacattcttttttttctattaagcgtccttaggatattcatcttcaaatatgtgttgttttttatttttttattgtttaatggtcaaatatgttcagtcggatctcactatgtaggaataaactagtataaactggtatgttgtaatcttc

SEQ ID NO: 4685 - DNA, 2054 bp, Solanum tuberosum
agatagttatggtgttactactggatttggtgcaacatctcatagaagaaccaaaaatggcggtgcccttcaaaaggaacttattaggttcttgaatgctggagtttttgggaatggaacagaatcatctcacacattaccacattcagcaacaagggcagctatgcttgttaggatcaacactctgcttcaaggctactctggcattagatttgaaatcttggaagcaattactaagttgatcaacaacaacatcaccccgtgtttgcctcttcgtggcacaatcactgcctcgggtgatcttgtcccgttgtcatacattgctggtttgctcactggcaggcctaactccaaggctgttggacccaatggtgagaaacttaatgctgaggaagcgttccgcgtggctggtgttactggtggatttttcgagttgcagcctaaagaaggacttgcacttgtgaatggtacagcagttggttctggtatggcatcaatggtcctgtttgattccaacattcttgctgtcatgtctgaagttttatcggcgattttcgctgaagtgatgaatggaaaacccgaattcactgactatttgacacacaagttgaagcatcaccctggtcagattgaggctgctgctattatggaacacattttggatggcagctcttatgtcaaggaagctcagaagctccatgaaatggatcctcttcaaaaaccaaagcaagatcgttatgctctccgaacatctccacaatggcttggccctcaaattgaagtcatacgtgctgcaactaagatgatcgagagggagatcaactcagtgaacgacaatccattgatcgatgtttcaagaaacaaggccttacacggtggcaacttccaaggcacccctattggtgtctccatggataatacaagattggcccttgcatcaattggaaaattgatgtttgcccaattctcggagcttgtgaacgactattacaacaatgggttgccatctaatctcacagcaggaaggaatccaagcttggactatggtttcaaaggagctgaaattgcgatggcttcttactgctcggaacttcaattcttggcaaatccagtgactaaccatgtccaaagtgctgagcaacacaaccaagatgtgaattccttaggcttaatctcagcaaggaaaactgctgaggctgtggacatcttgaagctaatgtcatcaacctatctcgtggcgctttgccaggctatcgacttgaggcatttggaggagaacttgaagaatgctgtcaagaacactgtaagccaagtagccaaaaagactttgacaatgggtgctaatggtgaacttcatccagcaagattctgcgaaaaggaattgctacaagttgtggaaagggaatacttgtttacctatgctgatgacccctgcagctgcacctaccctttgatgcagaagctgagacaagtccttgttgatcatgcaatgaagaatggtgaaagtgagacgaatgtgaacagctcaatcttccaaaagattgtagctttcgaggacgaattgaaggctgtgttgcctaaagaagttgagagtgcaagagctgttcttgaaagtggcaaccctgtaattcctaacaggataacagaatgcagatcatatccattatacaggtttgtaaggaaagaagttggaacagaactattgacaggtgaaaaagttcgatcgcccggtgaggagattgacaaggtattcacagcattttgcaatggacaaatcattgatccattgttggaatgtctcaagagctggaatggtgctcctcttccaatttgctagatgtttgtcaagttgttaatttttcaaattctttttttaccttatagtgaattactagatcataatatatatgttgtgaagttatatcatttaattttcttttggacagtatgtaatattggctaaactaaggtgccaagtttatcccattatgagaatcagaatattctctacatgacttaaaagaagctgttgaaagcatttccaaaaaaaaaag

SEQ ID NO: 4686 - DNA, 1445 bp, Solanum phureja
gctagctcattctcactttcttatacaacgctattaccgtcgacgttcctaattttgtactaatcatcatggcacgcttggcaacagatggagctcaatttgatgctcgacaattcgattctaagatgaatgatttacttgccgctgagggaaaagatttctttacttcatatgacgaggtttatgacagtttcgatgctatgggtctgcaagaaaatcttctcaggggcatttatgcttatggttttgagaaaccatctgccattcagcaaaggggtattgtaccattttgcaagggacttgatgtaattcaacaagctcaatctggcacagggaagacagctactttttgctctggaattttgcagcaacttgattatggtttaattcaatgccaatcattggtgttggcacctactcgggaacttgcacagcagattgagaaggtaatgcgagcacttggtgactatcttggggttaaggtccatgcttgtgtaggtggaactagtgtcagggaggatcaacgtattctcgcagctggtgttcatgttgttgttggcacccctggacgtgtgtttgacatgttgcgaagacagtccctccgtcctgattgcctcagaatgtttgtgctagacgaggctgatgaaatgctgtcacgaggttttaaggatcagatatatgatattttccaaatgctgcctaccaaagttcaagtaggagtgttttctgcgaccatgccaccagaagcccttgacatcacaagaaagttcatgaataagcctgtgagaatcctggttaaacgcgatgaattgacactcgagggtatcaaacagttctatgtcaatgttgataaggaggaatggaagcttgagacgctctgtgatctatacgagacacttgccatcactcagagcgttatctttgtgaacactaggcgcaaggtcgattggttaacggacaaaatgagaagccgtgaccacacggtttcagctacacatggagatatggaccagaacactagagacataatcatgcgtgagtttcgttctggttcttcccgtgtccttatcacaactgatctgttggcccgtggtatcgatgtacaacaagtatcccttgttatcaactatgatctcccaactcagccggagaattatctccatcgtattggaagaagtggaaggtttggaaggaaaggagttgcaatcaactttgtgacaacagacgacgaaagaatgttgtttgatattcaaaaattctacaatgtggtcatcgaagaactcccttcaaatgttgctgacctcctctgaaaacttcatctttataaggtgagtaagaagcttatagtatagaaatcattttaaactaccattattatctagcatcgaaaacgcacccgtggcattaatgttgctaagaattttgcagtcagtatgtagtaaggt

SEQ ID NO: 4687 - DNA, 1497 bp, Nicotiana tabacum
gtttaattctcagttttgctaaagttattatcatcgtcattccgagtcatggcacgtttggcaccagatggagctcaatttgatgcccgtcaatatgattctaagatgaacgatttacttgccgctgatggaaaagatttctttacatcatatgacgaagtttatgacagttttgatgctatgggtctgcaagagaaccttctcaggggcatttatgcctatggttttgagaaaccttctgcaattcaacaaagaggtatagttccattttgcaagggacttgatgtaattcagcaggctcagtctggcacaggaaaaacagctactttttgttctggaattttgcagcagcttgattatggtttagttcaatgtcaagcgttggtgttagcacctactcgtgaacttgctcaacagattgagaaggtgatgcgagcacttggtgactaccttggggttaaggtccatgcttgtgtaggtgggactagtgtcagggaggatcaacgtattctcgcagctggtgttcatgttattgttggcacccctggacgtgtgtttgacatgctgcgaagacagtctctccgtcctgattacctcagaatgtttgtgctagacgaggctgatgaaatgctgtcacgtggttttaaggatcagatatatgatatttttcagatgctgcctacaaaagtccaagtcggagtgttttctgcgaccatgccaccagaagcccttgacatcacaagaaagttcatgaataagcccgtgagaatcttggttaaacgcgatgaattgacacttgagggtatcaaacagttttatgtcaatgttgataaggaggaatggaagctcgagacactctgcgatctatacgagacgctagcaattacacagagtgtcatatttgtgaacaccaggcgcaaggttgattggttaacagacaaaatgcgaacgcgtgatcacacagtctcagctacacatggagatatggaccagaacactagggacataatcatgcgcgagtttcgctctggttcttctcgtgtccttatcacaaccgatctgttggctcgtggtatagatgtacaacaagtatcacttgtgatcaactatgatctcccgactcagccagagaattatctccatcgtattggaagaagtggaaggtttggaaggaaaggagttgctatcaactttgtgacaacagacgacgaaagaatgttgttcgatattcagaagttttacaacgtgataatcgaagaactcccctcaaatgttgctgatctcctctgaaaaacttatgtttgtggctggagctttaagcagaaagagtaaccatgttatagtgtccacaccattccatagaaattagtcttttaactaccattatcatctagtgtctaagacagacctgaggcagtaatgctgctccaaattttgcagtagcacattttgtttttcatttcctaattcttaaacttctttggcattttgtagttt

SEQ ID NO: 4688 - DNA, 1908 bp, Cucumis sativus
tataacttcagtccttcagcattagcctccttttcaactccacggcgcagatccgaggagtttctaaatctttcactatcttccaacgctttctaatcttcttcaaatcctttcatctttcactgatctacagatatggctggtttggctccagaaggttctcaatttgatgcacgtcagtatgactcaaaaatgaatgagttactttcagctgatggacaggatttcttcacttcatatgatgaagtttatgacagttttgattctatgggcctgcaagaaaaccttctcagagggatctatgcctacggttttgagaagccatctgcaattcaacaaaggggaattgttcctttttgtaaagggcttgatgtgatccaacaagcccagtctggaaccgggaagactgcaaccttttgctctggcattttgcagcaacttgattatggtcttgttcagtgccaggctttggtcttggcacccactagggaacttgcacagcagattgagaaggttatgcgagcccttggtgattatcttggtgtgaaggttcatgcttgtgttggtgggacgagtgtacgtgaagaccaacgcattcttcaagctggtgttcatgtagttgttggtacacctggtcgtgtgtttgatatgttgcgtagacaatcacttcgccccgactacattcggatgtttgtattggatgaagccgatgaaatgctttctcgtggatttaaggaccagatttatgatatcttccagctgctaccatccaagattcaggttggggtgttctctgccacaatgcctcctgaagcccttgagatcaccaggaagttcatgaacaagcctgttagaattcttgttaagcgtgatgagctcacccttgagggtatcaagcagttctatgtcaatgttgacaaggaagactggaagctcgagacactgtgcgatctttatgaaactttggccattacacagagtgtcatcttcgtcaatactcgacgtaaagttgattggctcactgataagatgcgaagccgtgaccacactgtatctgctacccatggtgacatggaccaaaacacccgagacatcatcatgcgtgagtttcgatcaggttcttctagggttctgattaccactgatctgttggcccgtggtatcgatgtccagcaggtttctcttgttattaactatgatctgccgacacaaccggagaactaccttcatcgtattggacgaagtggacgatttggaagaaagggtgttgcgatcaactttgtaacgacagaggacgaaagaatgctatttgacattcagaagttctacaatgtggtaattgaagagctgccagcaaatgttgctgatcttctgtgagaaaaaagaagagaagggaagggtaatattgtggtagactgaggcgtggttttctccttgaagaacttcaaagcttttctttttttttcaacctcttttttattatcttttttttttctctttctttttttctagtgtcttaaattaaaatattcttggaacctataatctgaccttgggaaatggtgtggcctgcaccactgcaatataaaagattgtcaaattacctttatggtaaattatgggcctttttgtttctttgttggggttttgtattgtatttgaggtttttttttgttgccttatttccctttccaagttatgaaaaaaaaaaaaaaaaaaactctggttgtctttccaagcaatattaggtcttttctttttccttttatttattttttgtggacaattttgttttgtcattacttgttttaattgatcattgaacttcgagacctgtgtagaagttttatggaattttgtaaacgttagcacttgcaatatcaatcctacattattttcacctgaata

SEQ ID NO: 4689 - DNA, 1751 bp, Citrus sinensis
caagtgttcgaggccccgtataatatataagtgctgcaaagaccaaactttagtcccttcccttttaactccacggcgcagatccgaggagtttggtaaccctagcaactattttctcttaaatcaatcttctccttctctttgaagaaaaaagaaaaccaactctttctctcgattttaatcaccatcatcaaagctttgcagatatggctggtttggcacccgaaggatctcaatttgatgctcgtcagtatgacaccaagatgaatgaactgctctctactgatgggcaagatttcttcacttcttatgatgaagtttatgacagttttgatgcaatgggactgcaggaaaaccttttgaggggaatctatgcctatgggtttgagaagccctctgctattcagcaaaggggaattgttcccttctgcaagggacttgacgtcattcagcaggctcagtctggaactgggaaaacagcaactttctgctctggaattttgcagcaacttgattatggtcttgtccaatgtcaggccctggtattggcacccactagggaactagctcaacagattgagaaagtaatgagggcacttggtgattatcttggtgttaaggttcatgcttgtgtcggtgggacaagtgttcgcgaggatcagcgcattcttcaagctggtgttcatgttgttgttggcactcctggtcgtgtgtttgacatgctgcgccgacagtctttacgccctgattacattaagatgtttgtactggatgaggctgatgaaatgctttcccgtggttttaaggatcagatctatgatattttccagctgcttccagctaaagttcaggtgggggttttctctgctacaatgcctcctgaggccttggagattacaaggaagtttatgaacaagcctgtgagaatcttggttaaacgtgatgaactcacccttgagggtatcaagcaattttatgtcaatgttgagaaggaagaatggaagcttgaaacactctgtgatctttatgagactctggccataacccagagtgtcatctttgtgaacactcggcgaaaggtcgactggcttacggacaagatgcgaagccgtgaccatacagtctctgccactcatggggacatggatcagaacacccgagatatcattatgcgtgaatttcgctctggttcttctcgtgttctcatcaccactgatctgttggctcgtggtattgatgtgcagcaagtttcacttgtcataaattatgatctgccgactcaaccagaaaactaccttcaccgtattggacgaagtggtcgatttggaagaaagggtgttgccattaattttgtgacaagggatgatgagagaatgctttttgatattcaaaagttctataacgtggtcattgaggagctgccttcaaacgttgctgaccttctttgaggaggttctgttttttgtaagtttgtcgaggcaagaaggggtttcctgattttgcaagtactatttaatgtggtggttcttttctccccttttttttttttttttggtttcttcttcctttccgtctagtgtcttaaattaatgttgttctcaaacatatccgaccatttaatcatatgggtcatgcacatttgcaagctgcactgtggtgggtttataattattgaaatttttgttgctgttaggtctttgtattttatgtccttttgttataaattttatttctattataattgtttagca

SEQ ID NO: 4690 - DNA, 1776 bp, Manihot esculenta
aagcgcaagtcacacacactcactctcttccccttcaaactccaaggcgcagatccgaggagtttgggataaaaaaccctagttttctctctctactctcaaaaaaccatccaaatctctctacgtctctttacaaatcacctcactatcagtcatggcaggtttggcaccagaaggatcacagtttgatgctaagcaatatgatgccaaaatgaatgaattgctctcaactgatggacaagaattcttcacctcgtatgatgaggtttatgatagttttgatgcaatgggattgcaagagaaccttctgagaggcatctatgcttatggttttgagaagccttctgcaatccagcaaaggggaattgttccattctgcaagggccttgatgtaattcagcaggctcagtctggaactggaaaaactgcaactttctgctctggcattctccagcaacttgattatggtctagtccaatgtcaggcattggtcttggcacccactagagaactggcacagcagattgagaaggttatgagagcccttggtgattatcttggtgtgaaggttcatgcttgtgtaggtggaacaagtgttcgtgaggatcaacgcattctccaagctggtgttcatgttgttgtgggtacaccaggtcgtgtgttcgacatgttgagaaggcagtcacttcgcccagactacataaagatgtttgtattggatgaggcagatgagatgctttcccgtggttttaaggatcagatatatgacattttccagttgctgccagcaaaagttcaggtcggtgtgttctctgctaccatgccaccagaggcccttgagatcacgaggaaattcatgaacaagcctgtgaggatcttggttaagcgtgatgagcttacccttgagggtatcaagcagttctatgtcaatgttgagaaggaagaatggaaacttgaaacgctatgtgatctgtatgagacactagccatcacccagagtgtcatctttgtaaacacacggcgcaaggttgactggcttactgacaagatgcgaagccgtgatcacacagtatcagcaactcatggagatatggaccagaacactcgcgatatcatcatgcgggaattccgttctggctcttctcgtgttctcatcaccactgatcttttggcgcgtggtattgatgtccagcaagtttcccttgtcataaactatgatctgccgactcaacctgaaaactaccttcatcgtattggacgaggtggacgattcggaagaaaaggtgtggccattaattttgtgacaagggatgatgagagaatgctgtttgacattcagaagttctacaatgtggtcatcgaggagctgccatctaatgttgctgatctcctgtgatgagaaatttttggtgttgaggaaagggtttcttatttaatgtgctgtcttctcccttcttgtttagtgtcttaatttaaaatcttcagacatatttgacagttgttcaatctcatatgaggcttcttctcaattgcaacctgatgatattgtctagtccttattttgtcctcttggaaagaaatgcatgttgttgtcttttattattattattttttctgggggggggtttctgtatacccgaattacctattctataaattataatggaatatttgcttctgcaagtataatttttgttgtcagaggaagcaaattgtgagacgtaagagtcggtattctataactattgaaaactagacccgtctgtgttttattgt

SEQ ID NO: 4691 - DNA, 1777 bp, Manihot esculenta
  misc_feature (827)..(827): n is a, c, g, or t
gaagcgcaagtcacacacactcactctcttccccttcaaactccaaggcgcagatccgaggagtttgggataaaaaaccctagttttctctctctactctcaaaaaaccatccaaatctctctacgtctctttacaaatcacctcactatcagtcatggcaggtttggcaccagaaggatcacagtttgatgctaagcaatatgatgccaaaatgaatgaattgctctcaactgatggacaagaattcttcacctcgtatgatgaggtttatgatagttttgatgcaatgggattgcaagagaaccttctgagaggcatctatgcttatggttttgagaagccttctgcaatccagcaaaggggaattgttccattctgcaagggccttgatgtaattcagcaggctcagtctggaactggaaaaactgcaactttctgctctggcattctccagcaacttgattatggtctagtccaatgtcaggcattggtcttggcacccactagagaactggcacaacagattgagaaggttatgagagcccttggtgattatcttggtgtgaaggttcatgcttgtgtaggtggaacaagtgttcgtgaggatcaacgcattctccaagctggtgttcatgttgttgtgggtacaccaggtcgtgtgttcgacatgttgagaaggcagtcacttcgcccagactacataaagatgtttgtattggatgaggcagatgagatgctttcccgtggttttaaggatcagatatatgacattttccagttgctgccagcaaaagttcaggtcggtgtgttctctgctaccatgccnccagaggcccttgagatcacgaggaaattcatgaacaagcctgtgaggatcttggttaagcgtgatgagcttacccttgagggtatcaagcagttctatgtcaatgttgagaaggaagaatggaaacttgaaacgctatgtgatctgtatgagacactagccatcacccagagtgtcatctttgtaaacacacggcgcaaggttgactggcttactgacaagatgcgaagccgtgatcacacagtatcagcaactcatggagatatggaccagaacactcgcgatatcatcatgcgggaattccgttctggctcttctcgtgttctcatcaccactgatcttttggcgcgtggtattgatgtccagcaagtttcccttgtcataaactatgatctgccgactcaacctgaaaactaccttcatcgtattggacgaggtggacgattcggaagaaaaggtgtggccattaattttgtgacaagggatgatgagagaatgctgtttgacattcagaagttctacaatgtggtcatcgaggagctgccatctaatgttgctgatctcctgtgatgagaaatttttggtgttgaggaaagggtttcttatttaatgtgctgtcttctcccttcttgtttagtgtcttaatttaaaatcttcagacatatttgacagttgttcaatctcatatgaggcttcttctcaattgcaacctgatgatattgtctagtccttattttgtcctcttggaaagaaatgcatgttgttgtcttttattattattattttttctgggggggggtttctgtatacccgaattacctattctataaattataatggaatatttgcttctgcaagtataatttttgttgtcagaggaagcaaattgtgagacgtaagagtcggtattctataactattgaaaactagacccgtctgtgttttattgt

SEQ ID NO: 4692 - DNA, 1355 bp, Liriodendron tulipifera
ccacggctgagatacgaggagttgaaaaaaaaaacctagctccctctctgctcacaatccgctctcttcttcaacgatcttccttcgaatccttgaacataccgtcatggctggatcggcaccagaagggtcacaattcgatggtcgtcagtttgatactaaaatgaatgagttgttggcggctgatggacaagatttttttacatcatatgatgaggtttatgaaagttttgattctatggggttgcaggagaatcttctgagaggcatctatgcatatgggtttgagaagccctccgcaatccagcagaggggaattgtgcccttctgcaagggccttgatgtgattcagcaagcacagtctggtactggcaaaacagcaactttctgctccggaattttgcaacagctagattatggtctagttgaatgtcaggccttggttcttgctccaactcgagaacttgcccaacaaattgaaaaggttatgcgcgcacttggagattacttgggagtgaaggtgcatgcctgtgttggtggtaccagcgtgcgcgaggatcagcgcattctttcgagtggggttcatgttgtcgttggcactcctggtcgtgtgtttgacatgctgcgaagacagtcccttcgtcctgattgcatcaagatgtttgttctggatgaagcggatgaaatgctttcacggggtttcaaggatcagatctatgacattttccagctcctcccttcgaaagtccaggttggggttttttctgctacaatgccgcctgaggctcttgagattactcgcaagttcatgaacaagcctgtgagaattttggtgaaacgagatgagctgaccctggagggaattaaacagttctatgtgaatgtcgaaaaggaggaatggaagctggagaccctatgtgacctctacgagaccctggccatcactcagagcgtcatcttcgttaacacccgacgtaaggttgactggctgaccgagaagatgcgcagccgggatcacacagtttctgccacccacggtgatatggaccagaacacaagagacataatcatgcgcgaattccggtctggatcctctcgtgtgcttattaccactgatctcttggctcgtggtattgacgtccagcaggtctcacttgtcatcaactatgatctgccaacacagccagagaactatctccatcgtattgggcgtagcggtcgttttggaaggaaaggtgttgctatcaactttgtgacgcttgatgatgagcggatgctgtttgacatccaaaagttctacaacgtggtgattgaggagctcccctcaaatgttgccgacctcctctgatgacatt

SEQ ID NO: 4693 - DNA, 1582 bp, Populus trichocarpa
ttacctacctataaataatcttaaacacttaaacaaagcctctttcaaactccacggcgcagatccgaggagtttgggctattattgatttctctattctatcttcagcttcctttcaatctcactcctgttctttcttgctatcaatcactccctcactcccagtcatggcgggtttggcaccagaagggtcacaattcgattctaagcaatatgatgccaaaatgaatgatttgctcgcaaatgatggacaagatttcttcacatcatatgatgaggtttatgacacttttgattcaatgggactgcaagagaaccttttgaggggcatctatgcctatggttttgagaagccatctgcaatccagcaaagaggaattgttccattctgcaagggccttgatgtgattcagcaggctcagtcaggaactgggaaaacagcaaccttctgctctggtattctccagcaacttgattatggtctagtgcaatgtcaagctttggtccttgcgcccactagggaacttgcacaacagattgaaaaggttatgcgggcacttggtgattatcttggcgtcaaagttcatgcttgtgttggtggcacaagtgttcgtgaggaccaacgcattcttcaagctggagttcatgttgttgttggcactcctggtcgtgtgtttgatatgttaagaaggcagtcacttcgtccagattacattaaaatgtttgtcctggatgaggctgatgaaatgctgtcccgtggttttaaggatcagatctacgatattttccagttgctgccatctaaagttcaagttggtgtgttctccgctactatgccacctgaagcccttgagatcacaaggaagttcatgaacaagcctgtgaggatcttggttaagcgtgatgagcttacccttgaaggtatcaaacagtttcatgtcaatgttgataaggaggagtggaagcttgaaactctatgtgatctatacgagaccctagccatcactcagagtgttatttttgttaacacccgccgcaaggttgactggctgacagacaagatgcgaagccgtgaccacacagtctcagctactcatggagatatggaccagaacactcgtgatatcattatgcgagaattccggtctggctcttctcgagttctcatcacaactgatctcctggcccgtggaattgatgtgcagcaagtgtcccttgtcataaattatgatctgccgactcaaccagaaaactaccttcaccgtattggacgaagtggacgttttggaagaaagggtgtcgccattaactttgtgacaagggatgatgacagaatgctgtttgatatccagaagttctataatgtggtcatcgaggagcttccatctaacgtggctgatctcctgtgatgagatttttggtgaaaaagggtttcttattttcctagtactattttaacgaattgttttcctttcttttctgtttagagtcgttaaatttgatgttctgagacatcggacagtttaatctcacattggtcctcccttcattattacagcatgaagggatttgacgttggact

SEQ ID NO: 4694 - DNA, 1582 bp, Populus trichocarpa
ttacctacctataaataatcttaaacacttaaacaaagcctctttcaaactccacggcgcagatccgaggagtttgggctattattgatttctctattctatcttcagcttcctttcaatctctctcctgttctttcttgctatcaatcactccctcactcccagtcatggcgggtttggcaccagaagggtcacaattcgattctaagcaatatgatgccaaaatgaatgatttgctcgcaaatgatggacaagatttcttcacatcatatgatgaggtttatgacacttttgattcaatgggactgcaagagaaccttttgaggggcatctatgcctatggttttgagaagccatctgcaatccagcaaagaggaattgttccattctgcaagggccttgatgtgattcagcaggctcagtcaggaactgggaaaacagcaaccttctgctctggtattctccagcaacttgattatggtctagtgcaatgtcaagctttggtccttgcgcccactagggaacttgcacaacagattgaaaaggttatgcgggcacttggtgattatcttggcgtcaaagttcatgcttgtgttggtggcacaagtgttcgtgaggaccaacgcattcttcaagctggagttcatgttgttgttggcactcctggtcgtgtgtttgatatgttaagaaggcagtcacttcgtccagattacattaaaatgtttgtcctggatgaggctgatgaaatgctgtcccgtggttttaaggatcagatctacgatattttccagttgctgccatctaaagttcaagttggtgtgttctccgctactatgccacctgaagcccttgagatcacaaggaagttcatgaacaagcctgtgaggatcttggttaagcgtgatgagcttacccttgaaggtatcaaacagtttcatgtcaatgttgataaggaggagtggaagcttgaaactctctgtgatctatacgagaccctagccatcactcagagtgttatttttgttaacacccgccgcaaggttgactggctgacagacaagatgcgaagccgtgaccacacagtctcagctactcatggagatatggaccagaacactcgtgatatcattatgcgagaattccggtctggctcttctcgagttctcatcacaactgatctcctggcccgtggtattgatgtgcagcaagtgtcccttgtcataaattatgatctgccgactcaaccagaaaactaccttcaccgtattggacgaagtggacgttttggaagaaagggtgtcgccattaactttgtgacaagggatgatgacagaatgctgtttgatatccagaagttctataatgtggtcatcgaggagcttccatctaacgtggctgatctcctgtgatgagatttttggtgaaaaagggtttcttattttcctagtactattttaacgaattgttttcctttctttgctgtttagagtcgttaaatttgatgttctgagacatcggacagtttaatctcacattggtcctcccttcattattacagcatgaagggatttgacgttggact

SEQ ID NO: 4695 - DNA, 1688 bp, Euphorbia esula
  misc_feature (20)..(20): n is a, c, g, or t
  misc_feature (32)..(32): n is a, c, g, or t
  misc_feature (211)..(211): n is a, c, g, or t
  misc_feature (444)..(444): n is a, c, g, or t
  misc_feature (780)..(780): n is a, c, g, or t
ggcacgaggccaaggcgcanatccgaggagtntgggaaaccctaatttatctttctactctctaaagctttctcaagtctctctccttttttccctataccaatctctcgctcactaccagtcatggcaggattagcacccgaaggctcccagtttgatgcaaggcaatatgatgctaaaatgagtgaactactctcaagtgatgggcaanatttcttcacctcatatgacgaggtttatgaatcattcgatgccatggggttgcaagagaatcttctcaggggaatatatgcatatggttttgagaagccctctgcaatccagcaaagaggaattgtcccattctgcaagggtcttgatgtgatccagcaagcccagtctggaactggaaaaactgcaactttctgctctggaatcctccagcagctcgattatggactggtncaatgtcaggccttggtcttagccccaacccgagaacttgcacagcaaattgagaaggtcatgagagcccttggagactatttgggcgtgaaagtccatgcttgtgttggtggaacaagtgttcgtgaagaccaacgtatcctccaagctggtgttcatgttgtggttggaacccctggtcgtgtttttgacatgttgagaaggcaatctcttcgcccggattacattaagatgttcgtattggatgaggctgatgaaatgctctcccgtggtttcaaggatcagatctatgatatctttcagttgctcccaaccaaggtccaggtcggagtgttntccgccaccatgcccccggaagctctcgagatcacccgaaagttcatgaacaaacccgttaggatcctggtcaagcgtgatgagctaaccctagagggtatcaagcagttctacgtgaatgtggaaaaggaagaatggaagctcgaaacactctgcgatctctacgagactctagccataacccagagtgtcatttttgtgaataccaggcgtaaagttgattggctaaccgacaagatgcggagccgggaccacactgtctcagccacccatggtgacatggaccagaatacccgtgacatcatcatgcgtgagttccggtccgggtcatcccgggtcctgatcaccacggatcttttggcccgtggtattgatgttcagcaggtgtcccttgttatcaactatgatctcccgacccaacccgagaactatctccataggattggtagaggtggaaggttcgggagaaagggtgtggctattaattttgtgacaagggacgatgagaggatgttgtttgatatccagaagttttataatgtggtgattgaggagctgccttcgaatgttgcggatctcctgtagattgaaggaaaatttttggttaaggagggggttgggaattttaagttcttgaatttgcaggtactatttaatgtgtttgtttttttaagttgctatgtttagtgggtttttaattttggtattttcttgaggcataatctctctgacagacagtttcaatctctcttattgagtctttctttctccattgcctcctgaaagagattgtttagtaattttattatattttttgtcctctcttttagaagttttgcatgttttgattttgtattgtatacagcttttgaggatctttttatgaattattatggtaggattggact

SEQ ID NO: 4696 - DNA, 1547 bp, Cucumis sativus
ctctttcgctcgctgcgctttgcccaaacactcgcctccaactccacggatcagatccgaagagtttggcaaaccctagcttcctctcttcaatcttcatctctaccttctctaacaatccacagctatggcaggtttagctccagaaggaacccaatttgattctcgccaatacgatgctaaaatgaatgagattctttcagccgaagggcaggaattttttacctcatacgatgaagtttatgaaagttttgattcgatggggctgcaagagaacctcctcagaggcatttatgcctatggttttgagaaaccttctgcaattcagcaaagaggtatagttcccttctgcaagggcctcgatgtgattcagcaggctcaatctggaactggaaaaactgcaactttctgctctgggatacttcagcaacttgattatggtctagtccagtgccaggcattagttttggcaccgactagggagctggctcaacaaattgagaaggttatgagagctcttggagattatcttggagttaaggttcatgcttgcgtgggagggacaagtgtccgtgaggatcaacgcattcttcaagctggtgttcatgtagtagttggaacacctggtcgtgtgtttgacatgttgaggaggcagtctcttcgcccagattgtattaagatgtttgtattggatgaagctgatgaaatgctttctcgaggtttcaaagaccagatctatgatattttccagctgttgccatcaaaaattcaagttggggtattctcagccacaatgcctccggaagctttggagatcactaggaaattcatgaacaagcctgtcagaatcttggtaaaacgtgatgagcttactttggaaggtatcaaacaattttacgtaaatgttgataaggaagattggaagcttgaaactctatgtgatctgtacgagactctggctatcactcaaagtgtcatctttgttaacacacgtcgcaaggttgattggcttacggacaagatgagaagccgtgatcataccgtatcggccactcatggtgacatggaccagaacactcgtgatataatcatgcgtgaatttcgttctgggtcgtctcgtgttcttatcacaactgacttgttagctcgtggtatcgatgttcagcaagtgtcccttgtcataaattatgatttgccgacccaacctgaaaattacctccatcgaattggtcgaagtgggcgttttggaagaaagggtgttgccatcaattttgttacaaatgatgatgagagaatgctttttgatattcagaagttctataatgtggtcattgaggagctgccagccaatgttgcagatctcctatgatgaggtttttgtttgtttttgtttttgtttttgtttatagggatgggatttctctcttatctctgaatgacactctttagcctccccccacttgaacttctctatttttatcttcactttgttttcatatattagtattgtcaaactgacattttgttaatgatttatttcctgcttt

SEQ ID NO: 4697 - DNA, 1715 bp, Ricinus communis
aagacctaacccaataacttttcattataaacaatctcaagtcacaagcgctcactctcttcctcttcaaactccaaggcgcagatccgaggagtttgggattttagaaaccctaattttctctctctacttcctattagccctcaaatcttcattctatcaatctctctctcactagcagtcatggcaggtttggcaccagaaggatcacagtttgatgccaagcaatatgatgccaaaatgagtgaattgctttcaactgaaggacaagaattcttcaccacatatgatgaggtttacgacagttttgatgcaatgggattgcaagagaaccttctaaggggcatctatgcttatggttttgagaagccttctgcaatccagcaaagaggaattgttccattctgcaagggtcttgatgtaattcagcaggcccagtctggaactggaaaaacggcaactttctgctctggcattctccagcaacttgattatgggctagttcaatgtcaggcattggtcttggccccaaccagagaattggcccaacagattgagaaggttatgcgagcccttggcgattatcttggtgttaaggttcatgcttgtgtcggtgggacaagcgttcgagaggatcagaggattcttcaagctggtgttcatgttgttgttgggactcccggtcgtgtgtttgacatgttaagaaggcagtcacttcgcccagattacattaagatgtttgtattggacgaggctgatgaaatgctttcacgtggttttaaggatcagatctatgatattttccagctgctgccagcaaaagttcaggttggcgtgttctctgccaccatgcctcccgaagctcttgaaatcacaaggaagttcatgaacaagcctgtgaggatcctggttaagcgtgatgagcttaccctcgagggtatcaagcagttctatgtcaatgttgagaaggaagaatggaaacttgaaacactctgtgatctctatgagaccctagccatcactcagagtgtcatttttgtcaacacaaggcgcaaggttgactggctcaccgacaagatgcgcagccgtgaccatacagtctcagcaacccatggagatatggaccagaatactcgtgatattattatgagggaattccgttctggttcatcacgtgttctcatcaccactgatctcttggctcgtggtattgatgtgcagcaagtctctcttgtgataaactatgatctgccgactcaacctgaaaactaccttcatcgtattggaagaggtggacggtttggaagaaaaggtgttgccatcaactttgtgactagggatgatgagagaatgctgtttgacattcagaagttctataatgtggtcattgaggagctgccatcgaatgttgcagatctcctgtgacgagaatttttggtgcttgttgagaaagggtttcatattttgcaagtactgtttaacgggttgtttattttgtttattttcttgtttagtgttttaatttgatatttggaagacatatctgacagttcaatctcatatgcgccttctaaattgcaacctgaagagattgtctagttgttatttattatttttttagtctttcttgggaagttttgcatggtgggatttgtactatatacccttttttttatgctctataattgattgtcgaattgttcttcctgtttgct

SEQ ID NO: 4698 - DNA, 1646 bp, Ricinus communis
gtcacaagcgctcactctcttcctcttcaaactccaaggcgcagatccgaggagtttgggattttagaaaccctaattttctctctctacttcctattagccctcaaatcttcattctatcaatctctctctcactagcagtcatggcaggtttggcaccagaaggatcacagtttgatgccaagcaatatgatgccaaaatgagtgaattgctttcaactgaaggacaagaattcttcaccacatatgatgaggtttacgacagttttgatgcaatgggattgcaagagaaccttctaaggggcatctatgcttatggttttgagaagccttctgcaatccagcaaagaggaattgttccattctgcaagggtcttgatgtaattcagcaggcccagtctggaactggaaaaacggcaactttctgctctggcattctccagcaacttgattatgggctagttcaatgtcaggcattggtcttggccccaaccagagaattggcccaacagattgagaaggttatgcgagcccttggcgattatcttggtgttaaggttcatgcttgtgtcggtgggacaagcgttcgagaggatcagaggattcttcaagctggtgttcatgttgttgttgggactcccggtcgtgtgtttgacatgttaagaaggcagtcacttcgcccagattacattaagatgtttgtattggacgaggctgatgaaatgctttcacgtggttttaaggatcagatctatgatattttccagctgctgccagcaaaagttcaggttggcgtgttctctgccaccatgcctcccgaagctcttgaaatcacaaggaagttcatgaacaagcctgtgaggatcctggttaagcgtgatgagcttaccctcgagggtatcaagcagttctatgtcaatgttgagaaggaagaatggaaacttgaaacactctgtgatctctatgagaccctagccatcactcagagtgtcatttttgtcaacacaaggcgcaaggttgactggctcaccgacaagatgcgcagccgtgaccatacagtctcagcaacccatggagatatggaccagaatactcgtgatattattatgagggaattccgttctggttcatcacgtgttctcatcaccactgatctcttggctcgtggtattgatgtgcagcaagtctctcttgtgataaactatgatctgccgactcaacctgaaaactaccttcatcgtattggaagaggtggacggtttggaagaaaaggtgttgccatcaactttgtgactagggatgatgagagaatgctgtttgacattcagaagttctataatgtggtcattgaggagctgccatcgaatgttgcagatctcctgtgacgagaatttttggtgcttgttgagaaagggtttcatattttgcaagtactgtttaacgggttgtttattttgtttattttcttgtttagtgttttaatttgatatttggaagacatatctgacagttcaatctcatatgcgccttctaaattgcaacctgaagagattgtctagttgttatttattatttttttagtctttcttgggaagttttgcatggtgggatttgtactatatacccttttttttatgctctataat

SEQ ID NO: 4699 - DNA, 1752 bp, Vitis vinifera
ctctcttcttctcacaactccacggcgcagatccgaggagttgggaaaccctagctgcgctctctttctctcgctaaagctccagttctcaatatctctcgtaatcaccatcgtcagttatggcaggtcaagcaccagaaggttcacaattcgatgctcgtcaatttgattccaaaatgaatgacttgctctcagctgatggagaagatttcttcacctcatatgatgaggtttatgacacttttgattctatgggattagtagagaaccttttgaggggtatctatgcatatggttttgagaagccttctgcgatccaacaaagaggaattgttccattctgcaaggggctcgatgtgatccaacaggcacaatctggaactgggaaaactgcaactttctgctctggaatcttgcagcaacttgattatagtctagtccaatgccaggcattggtattggcacccactcgagaacttgcacagcagattgagaaggttatgcgagcacttggtgattatctcggtgtgagggttcatgcttgtgtgggtggaacgagtgttcgtgaggatcagcgcattcttcaaactggtgttcatgttgttgttggtactcctggtcgtgtgtttgacatgttgcggagacagtcacttcgcccagattacattaagatgtttgtattggatgaggctgatgaaatgctttcacgaggtttcaaggatcagatctatgacattttccagctgctgccatctaaagtccaggttggagtgttctctgccacaatgccccctgaggcccttgagatcactcgaaagttcatgaacaaacctgtgagaatcctggtaaagcgtgatgaactcacccttgaaggtatcaaacaattccatgttaatgtggataaggaagagtggaagcttgagacactgtgtgatctctacgaaaccctggccatcactcagagtgtcattttcgtgaacacaaggcgcaaggtggactggcttactgacaagatgcgaagccgtgatcacacagtatctgctacccatggagacatggaccagaacactagggatataatcatgcgcgagtttcgctccggctcctcccgtgttcttataaccactgatctcttagctcgtggtattgatgttcagcaagtctctcttgttattaactatgatctgccaactcaaccagaaaattacctccatcgaataggtcgaagtggacgatttggaagaaaaggtgttgccatcaactttgttaccagggatgatgagagaatgctgtttgacattcagaggttctataatgtggtcattgaggagctgccatcaaatgttgctgatctcctctaaagaggtttttttgggggttcctcgaggtaaggggtttcttatttcaaaagtactatttaacgttggattttttttcttttttttttttttctttttttaatgtctagtgtcttaatttaatgtttccagacatatttgaccatataatgatatgggtcctgcacatttgcgataggataattgtcatgttgcccatttcagtgtgatgggcatttattattgcaagttttggtgcaggtaggttttgtatcgtatgctcttattcttttccatccttgtattgttcaaaaagctagtagtttggattgtttattatgttggatcttgcttttgagttttcaatgaggagaaatattttataaatataggatgatgactcggtgtttttgtt

SEQ ID NO: 4700 - DNA, 1515 bp, Fragaria vesca
  misc_feature (835)..(835): n is a, c, g, or t
  misc_feature (1021)..(1021): n is a, c, g, or t
  misc_feature (1066)..(1066): n is a, c, g, or t
  misc_feature (1177)..(1177): n is a, c, g, or t
  misc_feature (1365)..(1365): n is a, c, g, or t
  misc_feature (1375)..(1375): n is a, c, g, or t
  misc_feature (1401)..(1401): n is a, c, g, or t
ttcaaactccacggcgcagatcggaggagtttgccaaaccctagctctctctctacctattcttcagctctcctttctctcaagcttttcatcagctcaatcagatatggcaggtctggctcccgaaggtgctcaatttgatgctaaacagtatgattctaagatgaatgagatcctctcatctgaaggccaagagttctttacatcgtatgatgaggttcacgacagttttgatgccatgggtttacaagaaaatcttctgcgtggaatctatgcttacggttttgagaagccttctgcaattcagcaaaggggaattgttcctttttgtaaaggtttggatgtgattcaacaagctcagtcaggaacaggcaaaacagcaaccttctgctcgggaattttgcagcaacttgactatggtttggtccagtgccaggctttggtgttggcacctaccagggagttggcacagcagattgagaaggttatgcgggcactgggtgactatcttggtgttaaggttcatgcttgcgtaggtgggactagtgttcgtgaggatcagcgaattcttcaagctggtgtgcatgtggtggttggcactcctggacgtgtgttcgacatgttgaggaggcaatcacttcgtgcagattacattaagatgtttgttttggatgaagctgatgaaatgctatctaggggtttcaaggatcagatctatgacatttttcagcttctgccatcaaaagttcaagttggtgttttctctgctactatgcctcctgaagcccttgagatcaccagaaagtttatgaacaaacctgttaggattttggtnaagcgtgatgagctcacccttgagggaatcaagcagttttatgttaatgttgacaaggaagaatggaagcttgagacactttgtgatctctacgagacccttgctatcactcagagtgtcatttttgttaatacaaggcgcaaagtggattggcttacagataagatgcgaagccgtgaccacacngtctctgctacccatggtgacatggaccagaaccagcgtgacatnatcatgcgtgagtttcgttctggttcctcccgtgttctcatcacaactgatctgttggcacgtggtattgatgtgcagcaagtgtcacttgtaattaattatgatttgccnactcaaccagaaaactacctccatcgtattggtcgaagtggtcgatttggaagaaaaggtgttgccatcaattttgtaacgagggatgatgacagaatgctatttgacattcagaggttttataatgtggtgattgaggagctgccttccaatgtggccgatcttctgtgaggagctgattttgctcnttttgttgtngaggcagatttctggttcctgttttnaaagtactatttatttttgtttttctgtcttttgtttttaattgatgctgtaaaaccttttaagaatgcctgttgcatactttccaagtgatgtccaattggttttcctcgtgc

SEQ ID NO: 4701 - DNA, 1954 bp, Gossypium hirsutum
cgttcttggcgtcgtcagaaaagaatccgagaagtgggattgcgtacaggggtttcaagtatgccattccttgggaggaggaacgggttccggaatgggaacgttgttgatatggaagatacgagaggagtatccggacggaatgatgcttacgtgttcggtgttcccatctcccaaggtttctgatactgttgttgagccttacaacgcgacactctcagttcatcagcttgtggaagatgctgatgagtgtatggttcttgataacgaagctctgtacgatatctgtttccgtacgcgggggcacctaagatttgttgtattgttattttgccttttcgctatcgtctttgcctatcaactccacggcgcagatccgaggagtctctatttttcaatccaaacaacccctctaaacactctcttcttttattgctcctactcttccagtcatggcaggtttggcaccagaaggatcccaatttgatgctcgtcaatatgaccagaaaatgactgagctgctccagactgatggagatgactttttcacaagttatgatgaagtttatgacagttttgatgcaatgggacttcaagagaaccttctgaggggtatctatgcatatggttttgagaagccttctgctattcagcaaagaggaattgtaccattttgcaagggtcttgatgtgattcaacaggcacaatccggaactgggaaaacagcgactttctgctctggaattctacagcaacttgactatgctgtagtccaatgccaggctctggttttggcacccacgagggagttggcacaacagattgagaaggtcatgcgagcacttggtgattaccttggtgttaaggtccatgcttgtgttggtggaacaagtgttcgtgaggatcagcgcattcttcaaagtggtgttcatgttgttgttggtactcctggtcgtgtctttgacatgttgagaaggcagtcacttcgtccagattatatcaagatgtttgtcttggatgaggctgatgagatgctttcccgtggttttaaggatcagatctatgatatcttccagctgcttccagccaagattcaggttggagtgttttctgccacaatgccgccggaggccctcgagattactaggaaatttatgaataagcctgtgagaattttggtaaagcgtgatgagctaaccctggagggtatcaagcagttttatgtgaatgttgaaaaggaagagtggaagcttgaaactctgtgtgatctttacgagaccctagccattacccagagtgtcatttttgtgaataccaggcgtaaggttgactggttaactgacaagatgcgaagccgtgaccacacagtgtctgccacccatggagacatggaccagaacactcgcgacgttatcatgcgtgaattccgctctggttcatctcgtgttctcatcaccactgatctccttgctcgaggtattgacgtgcagcaagtctctctagtcataaactatgatctgcctactcaaccagaaaactacctccaccgtattggtcgaagtggaaggtttgggagaaaaggtgtggccatcaactttgtgactacagatgatgagaggatgctttttgacatccaaaagttctataatgtggtcattgaggagctgccatcaaacgttgctgatctcctttgatgagattagacaccctttttgaatattgttgaggcaaggtgttttgttgttttggcaagtttcttatttttctccctatctagcgtcttaagttaaatgttcttaaacatatctgaccattgaatccagttttgcctactcctttgtggtgggtttaatatgttatttcaagtttttatgcagcagtagggtttttgagttgtatgtcatcatttactagttataatataaaatcatggaaggcatttcatacaaaaaag

SEQ ID NO: 4702 - DNA, 1653 bp, Gossypium hirsutum
cccttagcactccacgacacagatccgaggagttggggaaaaccctcacacaaattctctctctaaatcttaaccgagaaggtctccaaaaaagactaccctttttgcccatttactctccttattcaacaaattcggcatcacatcccccaaaatagtcgcttttttatctcttgctctcttcatctgcttcaagtcatggctggtgtagcacccgaaggatcccaattcgatgctcgtcaatttgatcagaaaatgagtgatttgctccaaacggatggagatgatgttttcacttcttatgatgaagtttatgacagttttgatgcaatgggacttcaagagaaccttctgaggggcatctatgcatatggttttgagaagccctcagcgattcagcaaagaggaattgttccattctgcaagggtctcgatgtgatacaacaggcacagtctgggactggaaagacagcgactttttgctctggaattttgcagcaacttgattacggtatagtccaatgccaggctctggttttggcacccactagggagttggctcaacagatcgagaaggtgatgcgggcacttggtgattaccttggtgtgaaggtccacgcttgtgttggtgggactagtgttcgcgaggatcagcgaattcttcaaagtggtgttcatgttgttgtcggtactcccggtcgtgtcttcgatatgttgagaaggcaatcactccgtccagattatattaagatgtttgtcttggatgaggctgatgaaatgctctcccgtggttttaaggatcagatctatgacatcttccagcttcttccgggcaagattcaggttggggtattttctgctacaatgccacccgaagccctagagatcactcggaagttcatgaataaacctgtgagaattttggttaagcgcgacgaactaaccctggagggtatcaagcagttttatgtgaatgttgaaaaggaagagtggaagctcgaaacactctgcgatctctatgaaacactggccattacccaaagtgtcattttcgtgaacacgaggcgcaaggttgactggctaactgacaaaatgcgaagtcgagaccacacagtttctgccacccatggagatatggaccagaatacgcgtgatgtcatcatgcgggaattccgttctggttcttcccgtgttctcatcactaccgatctgttagcccgtggtattgacgtgcagcaagtctcccttgtcataaactatgatctgcccactcaaccagaaaactacctccaccgaatcggacgaagtggaaggttcgggagaaaaggtgttgccataaactttgtgactgtagatgatgaaagaatgctgtttgatatccagaagttctacaatgttgtcatcgaggagctgccatcgaatgtcgcggatctcctttgatgagattacgttttctgaaggttgtcagaggcgagcgctttcattgtttgaatgttcaattaagtgtgctctttttttcttttttggttttccctttttagcattttaagttgaatgttctttaagatatttgaccatttaattatatgtgttctaaaaatgctacataaagtttatccacttttcctcactcttttgcactttatttatgct

SEQ ID NO: 4703 - DNA, 1696 bp, Vitis vinifera
cttaactcctcttcactgcgtgcggatccgaggagtttggggaaaccctaatcctaaccctagccctaatccacctcttgctcttcgctttcagtcatggctggcttggcaccggaaggatcacaatttgatgctcgtcaatatgatagcaaaatgaatgagttacttgggactgatggacaagatttcttcacatcatatgatgaggtctatgaaagttttgatgcaatggggttgcaagagaatctcctgagaggcatttatgcatacggttttgagaagccctctgcaattcagcaaagaggtattgttcccttcatcaaggggcttgatgtaattcagcaagcacagtctggaactggaaaaacagcaactttctgctctggaattttgcagcagcttgattatggcttagttgaatgccaggcattggtccttgcacccactcgggaacttgcccaacaaattgaaaaggttatgcgagcactaggtgattatcttggtgtgaaggttcatgcttgtgttggtgggaccagtgtccgtgaagaccagcgcattctctcaagtggggttcatgtcgttgtgggtactcctggtagggtttttgacatgttgcgcaggcaatcacttcgtcctgattacattaagatgtttgtgttagatgaagcagatgaaatgctttcacgaggtttcaaggatcagatctatgatattttccagttgctgccatcaaagattcaggttggggtgttctctgccacgatgccacctgaggcccttgagatcacaaggaaattcatgaataaacctgtgaggattctggtgaaacgtgatgagctcacccttgagggtatcaaacagttctatgtcaatgttgataaagaggaatggaagcttgagacactttgtgatctctatgagacgctggcgatcacccagagcgtcatctttgtgaacacccggcgcaaggttgactggctgacggacaagatgcgcagccgtgaccacacagtctctgccacccacggagacatggatcaaaacacaagagacatcatcatgcgtgaattccgatctggttcctctcgtgtgctcatcactactgatctattggcccgtggtattgatgtccagcaagtctctcttgtgataaactatgacctcccaacacagccagaaaactacctccatcgaattgggcgtagtggacgatttgggaggaagggggtggcaatcaactttgtgaccaaggatgatgagaggatgctttttgatatccaaaggttttataatgtggtggttgaggagctgccatcaaatgttgctgatctcctgtgatgaagtttttgctcatggaggtaaatgacttttatttgaaaagtcatatttattatgttcgttctcataggtctggcatcttaatttatcatggaatgaacttgccgtacaattgggagatacaggtcctgcgcatttcacatcgggacacatccattgctcattttgggtatattggcaatccgttgttgcaacttttgttgcctgagttttcttttgtattttaagttttttaagtttccttgaacaatttgagaaattggatctagtttggattggattcattttgttctattttagttttttgtgtgtgggaggagaagctcaatatgattagaaaatggttttttgagtttca

SEQ ID NO: 4704 - DNA, 1733 bp, Liriodendron tulipifera
  misc_feature (1561)..(1561): n is a, c, g, or t
tcactatcgttccttcatctccacggcggagatcggaggagttggtacaaaaaaaaaaaaactaaaaaaccctacctttcgttcggtcgcttctgcgcttttttccatctaatttcatagcgatcttccttcgattccatcacaagcagtcatggcgggaatggcacctgaaggatcccagtttgatgcacgatcatttgatgccaaaatgaatgagttgttgacagcagatgggcaagatttctttaaatcatatgatgaggtttatgaaagttttgatgcaatgggtttgcaggagaacctccttagaggcatttatgcctacggttttgaaaaaccctcagcaatccaacagaggggaattgtgcctttctgcaagggacttgatgttatccagcaagctcagtctgggacgggcaaaacagcgactttctgctcaggaatcctgcagcagcttgactatggcctagttgaatgtcaggctttggttcttgctcctactagagaactcgctcaacaaattgaaaaagtcatgagggcccttggtgattatctgggtgtcaaggttcatgcttgtgttggtggaaccagtgtccgagaggatcaacgtattctttcaagtggtgttcatgttgttgttggaactcccggtcgcgtttttgacatgttacggagacagtcccttcgccctgactacattaagatgttcgtattggacgaagcagatgaaatgctctcaagaggtttcaaagatcagatctatgatattttccagctccttccgtcgaaggttcaggtgggcgtcttttctgccacaatgccaccagaggccctcgagattactcgcaagtttatgaataatcctgtaaggatactggtgaagcgagatgaactcactcttgagggaatcaaacagttctatgtaaatgttgagaaggaagaatggaagctggagaccctctgtgacctctatgagacattagccatcactcagagtgtcatctttgtaaacactcggcgcaaggttgactggctgactgataagatgcgtagccgggatcacaccgtctctgcgacccatggggatatggatcagaacacaagggacatcatcatgcgcgaattccggtctggatcctcccgcgtactcatcaccaccgacctcttggcccgtggtattgatgtccagcaggtctcgcttgtcataaactatgatctgccgacgcaaccagagaattatctccatcgcattgggcgtagtgggcgttttgggaggaaaggtgttgcgatcaactttgttacacgggatgatgagaggatgctgtttgacatccagaagttctacaatgtggtgattgaggagcttccatcaaacgttgctgatctcctctgatgtggtttcttcatgtttattgaggtaagatgcttttatttggtaatttctattattagtgtgtccttttaggtccagtactttattctggcagcatcaaacttatatgactgtggggttatgtggggtccgcacatttgcaaagtggggttccgactgtgcccattntgaagagggcatgcgtggagatcctgtcattgcaaattttgtagcagctagggtttttgtattttatgttgtttttttcttcttctttgtttgttacctgaaagaaaggtaagtttggactgatttctatgtttagcttggttttattttcatatgccagagaggtttatgt

SEQ ID NO: 4705 - DNA, 1781 bp, Juglans hindsii x Juglans regia
  misc_feature (36)..(36): n is a, c, g, or t
  misc_feature (38)..(38): n is a, c, g, or t
  misc_feature (48)..(48): n is a, c, g, or t
  misc_feature (50)..(50): n is a, c, g, or t
  misc_feature (55)..(55): n is a, c, g, or t
  misc_feature (59)..(59): n is a, c, g, or t
  misc_feature (62)..(62): n is a, c, g, or t
  misc_feature (67)..(67): n is a, c, g, or t
  misc_feature (76)..(76): n is a, c, g, or t
  misc_feature (92)..(92): n is a, c, g, or t
  misc_feature (100)..(100): n is a, c, g, or t
  misc_feature (110)..(110): n is a, c, g, or t
  misc_feature (121)..(121): n is a, c, g, or t
  misc_feature (124)..(124): n is a, c, g, or t
  misc_feature (126)..(126): n is a, c, g, or t
  misc_feature (131)..(131): n is a, c, g, or t
  misc_feature (133)..(134): n is a, c, g, or t
  misc_feature (137)..(137): n is a, c, g, or t
  misc_feature (143)..(143): n is a, c, g, or t
  misc_feature (146)..(146): n is a, c, g, or t
  misc_feature (158)..(158): n is a, c, g, or t
  misc_feature (166)..(166): n is a, c, g, or t
  misc_feature (170)..(170): n is a, c, g, or t
  misc_feature (175)..(175): n is a, c, g, or t
  misc_feature (188)..(188): n is a, c, g, or t
  misc_feature (191)..(191): n is a, c, g, or t
  misc_feature (194)..(194): n is a, c, g, or t
  misc_feature (202)..(202): n is a, c, g, or t
  misc_feature (208)..(208): n is a, c, g, or t
  misc_feature (211)..(211): n is a, c, g, or t
  misc_feature (223)..(223): n is a, c, g, or t
  misc_feature (246)..(247): n is a, c, g, or t
  misc_feature (577)..(577): n is a, c, g, or t
  misc_feature (601)..(601): n is a, c, g, or t
  misc_feature (616)..(616): n is a, c, g, or t
  misc_feature (649)..(649): n is a, c, g, or t
  misc_feature (664)..(664): n is a, c, g, or t
  misc_feature (691)..(691): n is a, c, g, or t
  misc_feature (703)..(703): n is a, c, g, or t
  misc_feature (706)..(706): n is a, c, g, or t
  misc_feature (709)..(709): n is a, c, g, or t
  misc_feature (746)..(746): n is a, c, g, or t
  misc_feature (757)..(757): n is a, c, g, or t
  misc_feature (778)..(778): n is a, c, g, or t
  misc_feature (953)..(953): n is a, c, g, or t
  misc_feature (958)..(958): n is a, c, g, or t
  misc_feature (1195)..(1195): n is a, c, g, or t
  misc_feature (1516)..(1516): n is a, c, g, or t
  misc_feature (1742)..(1742): n is a, c, g, or t
  misc_feature (1747)..(1747): n is a, c, g, or t
ggggccttctctttgttgtagtctcttcccactacncncagctctctntntctcngtgnttngttgntttcccttnaactcctccaatcaangatccgangagtttgggngaccctaaccntananacccncnnacngaaacncancctctctcttcntcgagctntctntatcnctttcagtcatgnctngtncggcaccngagggntcncaatttgatgcncgtcaatttgatgctaaaatganngagttacttggagcagatgggcaagatttcttcacatcatatgatgaggtttatgagagttttgatgtgatgggattgcaagagaacctccttagaggaatctatgcttatggttttgagaagccctctgcaattcagcaaagggggattgttcctttctgtaaaggacttgatgtgattcaacaagcacagtctggaactgggaaaactgctactttttgctccggtatcttgcagcagcttgattatggcttggtcgaatgccaggccttggttcttgctcccactagggagcttgcacaacagattgagaaggtcatgcgggccctnggtgactatttgggtgtcaaggtncatgcctgtgttggnggaacaagtgttcgtgaggatcaacgaattctntctgctggggtccangttgttgttggtacccctggtcgtgtntttgacatgctncgnagncaatcactgcgccctgattacattaggatgtttgtgntagacgaagcngatgaaatgctttcacgaggnttcaaggatcagatctatgatatcttccagctgctgccacctaaaattcaagttggggttttctctgccacaatgccgcctgaggctcttgagattaccaggaaattcatgaataaacctgtaaggattctggttaaacgtgatgagctcacccttgagggtattaagcaattcnatgtnaatgttgacaaggaggaatggaagcttgagacgctttgtgatctttatgaaaccttggcaatcacccaaagtgtcatctttgtgaacaccaggcgcaaggtcgattggctgacagacaagatgcgcggtcgtgatcacacagtttctgccacccatggagacatggaccaaaatacaagggacatcatcatgcgggaattcaggtctgggtcctctcgtgtactcatcaccactganctcctggccaggggtattgatgtccagcaagtctctcttgttataaattatgatcttccaactcagccagagaactacctccatcgaattggccgtagtggacggtttgggaggaagggtgttgccatcaattttgttaccacagacgatgagaggatgctctttgacatccagaagttctataatgtggtgattgaggagctgccagccaatgttgccgatctcctttgattcatttttaacgtggcatggctaatggcttttcatctggaagagccatagttattacttcctttctcctgggtcgcgggcctttttggnctcctcagcactcgatatggatgccctttcccattttgggtgtaaaagaattatcttttgttgcaaattttgatgtgggtttgctatgttttatgatgcctatgagaattgctgaattgattgtagtttggattgacctcatcttggtctaagatgaatttgggtgtctgtgtgagtggggaatgttatttgaccatgctgggatactgagcttggtcagttgctnctctncaaactgttttactactgtatctcgtctctctac

SEQ ID NO: 4706 - DNA, 1431 bp, Cleome spinosa
tccgatttttgggagattcaagctctcaagaaaaccctagctttttgtctctctagctttcatctccatcagttcagctccagtcatggcaggtttggcaccagagggctcacagtttgatgctcgtcagttcgaccagaagttgaatgatttgcttgatggtggcgatgaattcttcacatcttatgacgaggtttgtgaaagctttgacgccatgggtttgcaagagaatcttctcaggggtatctacgcatatggttttgagaagccctctgcaattcagcaaagaggaattgtccctttctgcaagggccttgatgtgatccagcaggcacagtctggtaccgggaaaaccgcaaccttctgctctggcattttgcagcagcttgactacagccttgtccaatgccaggctctggttttggctccaactagggagcttgcccagcagattgagaaagtcatgcgggctcttggagattacctcggtgttaaggttcatgcctgtgttggtggaaccagtgttcgtgaggaccagcgtattctccaggccggggtccatgtcgtcgttggaactcctggtcgtgtctttgacatgttgcgtaggcaatcccttcgtcctgattacatcaagatgtttgtcctcgatgaggctgatgagatgctctcccgaggtttcaaggaccagatatatgatatcttccagctccttccacccaagattcaggtgggtgtgttctcagccacaatgcctccagaggctctcgagatcacaaggaagtttatgaacaaacccgtgaggatcttagtgaaacgtgacgagctcacccttgagggtatcaagcagttttacgtcaatgttgagaaggaagagtggaagctcgagacgttatgtgatctctacgagactctggccattacccagagtgttatctttgtgaacactcggcgaaaggtggactggctcacggacaagatgagaagccgtgaccacactgtctcagccactcatggtgacatggaccagaacactcgagacatcatcatgcgggagttcaggtcgggttcttcccgtgttctgatcacgaccgatctcttggcccgtggtattgatgtccagcaagtctctctggtcataaactttgacctcccgacccagccggagaattacctccaccgtatcggaagaagtgggaggttcggaagaaagggtgtggccatcaatttcgtgacccgggatgatgagagaatgctctttgatatccagaagttctacaatgttgtcgtggaggagcttccgtcgaatgtggccgaccttctgtaagagggagagagggcttgtttcgcaaggtaggtgtgtctgtgtccatcgccggtggaaggtttcttgtttcgcaaggtactgttggattttgaccttttactacatcc

SEQ ID NO: 4707 - DNA, 1399 bp, Eschscholzia californica
cccccgggctgcaggtattcgcgagcagggcgttccttaactcctcggctgatacacgagttaggaaaccctagctctaaacaaaaaagtactcgctttcttcttctctcaaatctcacagatttcatctcaattagtcatggcgggattagcaccagagggatctcagtttgatgctaagcagtatgattccaaaatgaatgatttgcttcaagcagatggacaggatttctttacatcttacgacgaggtttttgaaagttttgatgctatgggtctgcaagaaaacctacttaggggcatatatgcatatggtttcgagaagccttctgcaattcaacagaggggaattgtacccttctgccagggacttgatgttattcagcaagcacagtcaggaactggaaagacagctacattttgttctggaatcttgcagcaacttgactacggtttgctagattgtcaggccttggttcttgcaccaactcgagaacttgcccaacagattgagaaggtcatgcgagcactaggtgattatttgggtgtgaaggttcatgcttgtgtaggtggaaccagtgtcagggaagatcaacgcattctctccagtggagttcatgttgtggttggcaccccaggtcgtgtttttgacatgttacggagacaatcacttcgtcctgataacatcaagatgtttgtattggatgaggctgatgaaatgctttctcgggggttcaaggatcagatctacgatattttccagctcctcccatcaaaagtccaagtcggagttttctccgccacaatgcctcctgaggctttagaaatcactaggaaattcatggacaaacctgttcggattctagtgaagcgtgacgaactcacccttgaaggtatcaaacaattctacgtcaatgtcgagaaggaagaatggaaacttgaaacactctgcgatttatatgaaaccttagccataacccaaagtgtcatcttcgtcaacactcgtcgaaaggtggactggctaactgacaagatgcgaagtcgtgatcacacagtctctgctactcatggagacatggatcagaataccagagacattattatgcgtgaattcagatctgggtcatctcgtgttctaatcactactgatcttcttgctcgaggtattgatgttcaacaagtttctcttgttataaattacgatctgcccactcagccagagaactatcttcatcgtattggacgtagtggaagatttggaaggaaaggagttgcgattaatttcgtaacgaaagacgatgagaggatgctgtttgatattcagaggttttacaatgtggttgttgaggagctgccttcaaacgttgctgatcttctttgaggagatactttttctgag

SEQ ID NO: 4708 - DNA, 1727 bp, Tropaeolum majus
atccaactccacggcgcagatccgaggagtttgggaaaccctagccttctctctctaacacactaggaagaaagctcacttttgctctcgtaacacactcagaataaccccctttcgttcataccgatcatcctttgctaccagaagtcatggcgggtttggcacaagaaggatcacaattcgatgctcggcaattcgatgcaaaaatgacagagctgctttcaacagacgggcaagattttttcacatcctatgatgaggtttatgacagttttgatgcaatgggattgcaggagaaccttcttaggggcatctatgcctatggttttgagaagccttctgcaattcagcaaagaggaattgtcccattctgcaagggtcttgatgtgattcagcaagctcagtctggaactggcaaaactgcaactttctgttcggggattttgcaacagttggattatggtcttgtccagtgtcaagctttagtgcttgcacccactagagaacttgcccagcagattgaaaaggtcatgcgagcacttggagactatcttggggttaaagttcatgcttgtgttggtgggacaagtgtccgggaggatcaacgcattcttcagtctggtgttcatgttgttgttggaactcctggtagagtatttgacatgttgcgtaggcaatcacttcgctccgattgtatcaagatgtttgtactggatgaggctgatgaaatgctctctcgtggtttcaaggatcagatctacgacatatttcagcttctaactgcaaaggttcaagtcggtgttttctctgctacaatgccacctgaagcgcttgaaattaccagaaagtttatgaacaaacctgtgagaatcttggtgaagcgtgatgaactaactctagagggtattaagcagttctatgtcaatgttgataaggaagaatggaagctagaaacactctgtgatctttatgagactctagccatcactcagagtgtcattttcgttaacacacgacgaaaagttgattggcttacagacaagatgagaagtcgtgaccacacagtctcagccactcatggtgacatggaccaaaatactcgtgatatcatcatgcgtgaattccgctctggctcttctcgtgttcttatcaccactgatctccttgctcgtggtattgatgtgcaacaagtgtctcttgtcataaactatgatctgccaacacagccagaaaattatcttcatcgtattggacgaagtggacgtttcggaagaaaaggtgtttcaattaactttgtgaccaccgaggacgatagaatgctggctgatatccagaagttctataatgtgataatcgaggaactgccatcaaatgttgccgatctcctctgaagatattctattataattttcaggagttttgttgaggagaaggtttttttggtcttgttttgtagtgctacttagattgtttgcgtttggtgtagtgttttttaagttaatgttgtcaaaacacacaatcccttaatgatatgatgtctgaaaaactacacaaaagttgcaatagctaatcttctacaatggtcttctttcagtttttcttgatcaaacagttttgtgtgtatctggttggctgggtgttttaactgatttaaacttgtactgtccaacccaactaaactgtgaatgttggggagtttgtgacagcatcaatgacatccttgtttg

SEQ ID NO: 4709 - DNA, 1855 bp, Tropaeolum majus
cggccggggccacaaacacatcatagtgaaacagtttgcctctcttctttcgttacaacttctcggcgcagatccgagttgtttgtgaaaccctaattttctctctctagaagaacgaacggagaaggctcaacacctctctctctctctacagtgatcaccgcatcttagcagaagcaacctcagtcatggcaggttcagcaccggaaggctcacagtttgacacgaatcattatgattcaaaaatgacagagctactatctactgatgggcaagattttttcacatcatatgatgaagtttatgacagcttcgatgctatgggattacaagaaaacctcctcaggggtatctatgcttatggttttgaaaagccttctgcaattcagcaaagaggtattgtaccattttgcaagggtcttgatgttattcaacaggctcagtctgggactgggaaaacagcaactttctgctctggaattctgcagcagctagactatagccttgtccagtgtcaagctttggtgctggcacccactagggaacttgcacaacagattgaaaaggtcatgcgagcacttggtgactacctaggtgttaaagttcatgcttgtgttggagggacaagtgttcgtgaggatcagcgaattcttcaggctggtgtccatgttgttgttggaactccgggtcgtgtttttgacatgttacgcaggcaatcccttcgtcctgattgcattaagatgtttgtcctagatgaggctgatgagatgctttcacgtgggtttaaggatcagatctacgatatcttccagcttcttcccggcaaagttcaggtcggagttttctctgctaccatgccacctgaagcacttgaaattaccaggaagtttatgaataagcctgtgaggatcttggtgaaacgtgatgagcttactcttgaaggtattaagcagtttcacgtcaatgttgacaaggaggaatggaaacttgagactctctgcgatctctatgagactcttgccatcacccaaagtgtcatctttgtgaacacaaggcgtaaggttgattggcttacggataaaatgcgtagccgtgaccacacagtctcagctacccatggtgacatggaccaaaacactagagatatcatcatgagggagttccgttctgggtcttctcgtgttctcatcaccactgacctccttgctagaggtattgatgtgcagcaagtctcccttgttatcaactatgatctgccaacccaacctgagaactaccttcatcgtattggacgaagtggacgatttgggagaaagggtgttgccattaactttgtgaccaaagaagatgaaagaatgctgtttgatatccagaagttctacaatgtcatcatcgaggagttgccatcaaatgttgctgatcttctctgaagtgattctttttgaaagtttgttggaagcgaagaggtattctaattcatcttctgcaggtgctatttaaagtgttgtttctttttggctgttttggtctagtgttttaaattactgttcttgaaatatatctgaccattaatgttctcaaacatgtctgacctttgcacaagtattttgctttattatttttcagatttagaggttggttctttaatgagttatggattgctgtttacttcttctattgccttttgaaataagtgtgtttgatgctccaaaatcaacataaatgtatgttgtaaaagtatcttagatgaatgtggataagttttccagctattgtgttgtctttcgccctgccttgcttgtatggttattggtaattactcattaatcttgtagctaggtgtgttgccattgat

SEQ ID NO: 4710 - DNA, 1654 bp, Tropaeolum majus
cggccgggggacgcgcaccacacacaacacatcactgtgaacagtttggcctcttattctctctcgcatcagcttctcggcacagatccgagtagtttttcaaaccctaactagtgtatcgatcatctctaagcagaagcagtcatggcaggtttagcaccagaaggatcacaatttgacgcacgacattatgatgcaaaaatgaccgaattgctctcgactgatgggcaggactttttcacatcgtacgacgaggtttatgacagctttgatgtgatgggactacaggaaaacctccttaggggtatttatgcttatggttttgagaagccttctgccattcaacaaagaggaattgttcccttctgcaagggtcttgatgtgattcagcaagctcaatctgggacagggaaaacagcaactttctgctcaggaattctacagcagctagattacagtcttgtccagtgtcaagcattagtgcttgcacccactagggaacttgctcagcagattgagaaggttatgcgagcccttggtgattacctcggagttaaagttcatgcttgtgttggcgggacaagtgttcgtgaggatcaacgtattcttcaagctggtgttcatgttgttgttggaactcctggtcgtgtatttgacatgttgcgtaggcaatcccttcgtcctgattacattaagatgtttgtactggatgaggcagatgaaatgctttcacgtggtttcaaggatcagatctacgatattttccagcttctccctgggaaagtccaagtcggagttttctctgctaccatgccaccagaagcccttgagattacaagaaagttcatgaataagccggtgaggatcttggtcaaacgtgatgagctaactcttgaaggtatcaagcagttccatgtcaacgttgataaggaagaatggaaactcgagaccctatgtgatctttatgagactctggccattacccaaagtgtcattttcgttaatacgaggcgtaaggtcgattggctcaccgacaaaatgcggagccgtgaccacactgtctcagccactcacggtgacatggaccagaatactcgtgacatcatcatgcgtgagttccgttctgggtcttctcgtgttcttatcaccactgatctccttgctcgtggaattgacgtacaacaagtctctcttgttataaactatgatctgcctactcaacccgaaaactaccttcatcgtatcggacgaagtgggcgattcggaagaaagggtgttgccattaactttgtgacaaaggatgatgacaggatgctcttcgatatccagaagttctacaatgttattatcgaagaactgccgtcaaatgttgctgatcttctctgattgagttttttccttttctggaattttgggcggaggcaaaggattttaatcgcacttctgagttgctatttaaagtgttgtttatttttctttcttcttgtttggtttattgttttaaattactgtttttaagtgtagacttgatgatgaatgttctcaaacatgactgaccatgcatgcagtggtaatttttgtattctttttcttcgaaatttagtttgcctgtagagcttgaatgttggaaaaaaaaaaaaaaggccgcctcggc

SEQ ID NO: 4711 - DNA, 1750 bp, Citrus sinensis
tctctctctatctttatatccatcgatactgcctgctactacccgcgtgtttccttgaactcctctccctcaaagcaaacaactaaactcagagatccgaggagttcggggaaaaccctaacccaaaccctagtctttaaaatcaaacaagcttccacctttcatcatcatcactatcagtcatggctggtttggctgaaggatcccagtttgatgcccgtcaatttgatgctagaatgaatgatttacttggaagtgatggacaagatttcttcacatcgtatgatgaggtttatgatacttttgatgctatgggattgcaagagaatcttcttagaggcatttatgcatatggttttgagaagccttctgccattcagcaaagggggattgttccattctgcaagggacttgatgtaattcaacaagcacagtctggaactggaaaaactgcaactttttgctccggaattttgcagcagcttgattatggtttagttgaatgccaagcattggttcttgctccaactagggaactggcgcaacagattgagaaggttatgcgagcacttggtgactatcttggtgtcaaagtgcatgcatgtgtaggtggaaccagtgtccgtgaagatcaacgcattctttcaagcggtgtacatgttgtagttggtacacctggtcgtgtgtttgacatgttgcggaggcaatctcttcgcccagataacatcaggatctttgtgctggatgaggctgatgaaatgctgtcacgaggtttcaaagaccagatctatgatatcttccagttgctacccccaaagattcaagttggggttttctctgccacaatgccaccagaggcccttgaaatcacaaggaagttcatgaataaaccggttaggattctggtgaaacgtgatgagcttaccctagaaggtatcaagcaatttcatgttaatgttgaaaaggaggaatggaagcttgagacactatgcgatctgtacgagactttggcaatcacccaaagtgtcatctttgtgaacacccggcgtaaggtagattggctgacagataagatgcgtagtcgtgatcataccgtgtctgccacccacggtgacatggaccaaaacactagggacatcatcatgcgtgaattccggtctggttcgtctcgtgtgcttatcactactgatctcttggcacgtggtattgatgtccagcaagtgtccctggtcataaattatgatcttcctacacagccagaaaactacctgcatcgtataggtcgtagtggacgatttggaagaaagggtgttgccattaatttcgtgaccagggatgatgaaaggatgctgtttgatattcaaaagttttacaatgtcgtaattgaagagctgccagcaaatgttgctgatctcctgtgatgtgtttttggattggtaaggtgtttttgaagtttgaagtctagtcattatggtgggtctggagtggttgctaaaagaaccctacaattatggcatttggaatggcctttgtttaagtttatgttgcatctgttgtaggtttgcattaaattatgttgttctacactttttttttaattgtcgtgcgacgacattatgtagagttggagcatggctagtttatttgtcttaggaaaactcgacttgcttgcttattgctttttaaagttatttggcttgttctttcatctaatatagttatttggcttgttctttcatctaaaaaaaaa

SEQ ID NO: 4712 - DNA, 1509 bp, Elaeis guineensis
  misc_feature (622)..(622): n is a, c, g, or t
  misc_feature (625)..(625): n is a, c, g, or t
  misc_feature (637)..(637): n is a, c, g, or t
  misc_feature (640)..(640): n is a, c, g, or t
  misc_feature (667)..(667): n is a, c, g, or t
  misc_feature (676)..(676): n is a, c, g, or t
  misc_feature (736)..(736): n is a, c, g, or t
  misc_feature (739)..(739): n is a, c, g, or t
  misc_feature (751)..(751): n is a, c, g, or t
  misc_feature (757)..(757): n is a, c, g, or t
  misc_feature (766)..(766): n is a, c, g, or t
  misc_feature (799)..(799): n is a, c, g, or t
  misc_feature (808)..(808): n is a, c, g, or t
  misc_feature (814)..(814): n is a, c, g, or t
  misc_feature (859)..(859): n is a, c, g, or t
  misc_feature (865)..(865): n is a, c, g, or t
  misc_feature (1090)..(1090): n is a, c, g, or t
tgttgaatccgaggcttgatctcgggttcagcagttgatcggccctctcgattcgatttctctctctccagtaatcaccaccagcagccgacccttctctttatcgcaagcagacatggcaggagcagcaccagaaggatctcaatttgatgctcgtcaatatgatgccaagatgactgagctgctgtcaacagatggtcaggacttctttacatcatacgatgaggtttatgatagttttgatgctatggggctccaagaaaatcttctgaggggcatttatgcttatggttttgaaaagccctctgcaattcagcagagaggaatcgttcccttctgcaagggacttgatgtaatacagcaagcgcaatcaggaacaggaaaaactgcaactttctgttctggaattttgcagcagcttgattatgggttggttgaatgccaggctttagttcttgccccaactcgagaactagcacagcaaattgagaaggtcatgcgagcacttggtgactacctgggtgtgaaagttcatgcttgtgttggaggaaccagtgttcgtgaggatcaacggattctttcaagtggggttcatgttgttgttggtaccccaggtcgtgtnttngacatgttacgnagncaatcactccgtcctgactacattagnatgtttgtnctggatgaggcagatgaaatgctttcacgtggtttcaaggaccagatctacgacatcttncancttcttccttcnaaaatncaggttggngtcttctctgccacaatgcctcctgaggccctngagataacncgcaanttcatgaacaaacctgtgaggatccttgtgaagcgagatgagctnaccctngagggtattaaacagttttatgtcaatgttgaaagagaagagtggaagctcgagactctctgtgatctttatgagactctggcaatcactcaaagtgtcatctttgtgaacacccgacgcaaggttgactggctcacggacaagatgaggagcagggatcacacggtctcagctacacatggtgacatggatcagaataccagggacattataatgcgtgaattncgatctggttcctcccgtgttctgatcacaactgatctccttgctcgtggtatcgatgtccagcaagtttcactggtcataaattatgacctaccaacccaaccagagaactatctccaccggattgggcgaagtggacgtttcggaaggaagggtgttgcgatcaactttgtcactcgtgatgatgaaaggatgctgtttgatattcagaggttctacaatgtggtgattgaggagctgccgtcgaatgttgctgacctcctgtgatgagtttctgggatagtatttaatatttatgcctttgtaggttttttctgtttccaatatttttctcatcaaacttaacctgactatttttggtggtatgtttgggaccatttgctttgatggtgattggaagcaaattaattttttatcca

SEQ ID NO: 4713 - DNA, 1563 bp, Helianthus annuus
acttttataacaactcacaaacacgagtcttcttcctcaactccgcggcgtcgatccgaggagtttgagaaaaccctaattcattcaacacttcccacattcttcttcttcttcttcttcttcttcagtcatggcgggcgtagcaccagagggatcccaattcgatgctagacagtttgactctaaaatgaatgatttgctttcggctgatggacaggattttttcacgtcatatgatgaagtttatgatagctttgatgctatgggtctgcaagagaatcttttgaggggcatatacgcatatggttttgagaaaccatcggcaattcagcaaaggggaatcgtaccattcaccaagggtctcgatgttattcaacaagcacaatctggaaccggaaaaaccgccactttttgctcaggcatcctccaacaactcgattacaatgtagtcgaatgccaggctttggttttagcaccgactcgtgaacttgcacaacaaattgagaaggtcatgcgggccctcggtgactaccttggtgttaaggttcatgcttgtgttggtgggaccagtgttcgtgaggatcaacgcatcctctcagctggggtccacgtcgttgttggtacacccggccgtgttttcgacatgttgcgcagacagtcccttcgttctgataacatcaaaatgtttgttcttgatgaagctgatgaaatgctttcacgaggttttaaagatcagatctacgatatcttccagttgttgccatcaaaggttcaggtcggagtgttttccgcaacaatgccaccggaagctttagaaatcactagaaagttcatgaacaaaccggtgaggattctcgtaaagcgtgacgaactcactttggaaggtatcaaacaattctacgtgaacgtggagaaagaagagtggaagcttgaaaccctttgtgacctttacgagacactagcaatcacgcaaagtgtcatctttgtgaacacacgaaggaaggttgactggttgaccgacaagatgagaagccgtgaccacaccgtctcagccacacacggtgacatggaccagaacacacgtgacatcatcatgcgtgagttccggtccggctcttctcgtgttctcatcaccactgatttgctggcgcgtggtattgatgttcaacaagtttcacttgttataaactatgatcttcctacccaaccggaaaattaccttcatcgtatcgggcgtagtggacgatttggaagaaaaggtgtggcgattaactttgtgacacttgatgatgagaagatgcttggtgacatccagaagttttacaatgttgtcgttgaggagctgccgtccaacgttgctgatctgatttagatgaattatcgtcgctgcggttttgaatttgaatttggtggttatttttgtttaagttattgaaagatggtgttttggtagtaggatttgaaaccatgtttgtacccttgagctttaatttcctgggactgtatggattagtttattttcgattcaatctttcagtgtcattccatttttgatcctccgac

SEQ ID NO: 4714 - DNA, 1736 bp, Mimulus guttatus
ccgcaattcagtataaaaaggaaaacccttaacgcagctcttatttttggcaaacagaaaaagcgattcctttcactcttctttgttctccaactccgcggcgcagatccgaggagttattcagcaaatttaatcagccctaaaacaagtttttcttcactccaattgaaaaagtatggcaggtttggcaccagaaggatctcaatttgatactcgtcagtttgactcgaggatgaacgaactcctccaagttgagggagaagaattctttacttcctatgacgaggtttacgatagtttcgatgcaatgggtcttcaagagaatctcctaagaggcatttatgcctacggttttgagaagccctctgcaatccagcaaaggggcattgttcctttctgcaagggactcgatgtcattcagcaggcacaatccggaactggaaaaactgctactttctgctctggcattttgcagcagctcgattacggtttgacacagtgccaggccttggttttggcccccactagagagctcgctcagcagattgagaaggttatgcgtgcactaggtgactacctcggtgtgaaggtccacgcttgtgtcggtggaacctcagtccgtgaggaccagaggatcctctccgctggggtccacgtcgttgttggaacccctggccgtgtgtttgacatgctgcgaagacagtcactccgtgctgacagcatcaagatgtttgtcttggacgaggctgatgaaatgctgtctcgtggttttaaggatcagatttacgacattttccagctgctgccatcgaaagtacaagtcggtgtgttctccgccacaatgcctcccgaagccctcgaaatcacccgaaagttcatgaacaagcccgtaaggattctcgtgaagagagacgagctaaccctcgagggtatcaagcagttctacgtgaacgttgaaaaggaagagtggaaactagagacgctatgcgacctctacgaaaccctagcaatcacccagagcgtcatctttgtcaacaccaggcgaaaggtcgactggctcacagacaagatgcgaggtagggaccacactgtctccgccacacacggtgacatggaccagaacacacgtgacatcatcatgcgcgaattccgatcgggctcttctcgtgtgcttatcaccaccgatcttttggctcgtgggattgacgtgcagcaggtttcgctcgtaatcaactacgatttgccaactcagcccgagaattacctgcacaggatcggaagaagtggtaggtttgggagaaagggagttgcgattaattttcttgttagggaggatgaaaagatgctccaggatattcagaagttctacaatgttgtcattgaggagcttccgtcgaacgtggctgatcttctttgaggttgcggttttttttgaagtatttttggttcgtttctggcaagagggaggctcgttcgaagttttttttctttttctagtttaattttgtttttttttttctttctttttgttaatttaatttgcaaaagatgatgtgatccacccttgtgaaaactggtgcatgaatgtataatccgattcgctgtgggtggataaattatatacactgttgcagttttgtctgtaggtatgtatcgtattcgaatttttgtcccgaaaaattggttcattctctatagttgtcgagctgtgttaggcgtctgcgtttattagtgtt

SEQ ID NO: 4715 - DNA, 1660 bp, Solanum phureja
aaaaaaacacacaaacacaacagtctcatctttctaatctattcctctttcctgaactcctgcggcgtagatccgaggagtttcagacagtctttacaaaccctaacccccaatcgcttttacccacttctcctcctactctttactctttattcctcagatctttaactcatctttatcagtcatggctggcttggcaccggaaggttctcaatttgatgctcgtcaatttgatgctaaaatgaccgagctgcttgggactgaacagcaggagttcttcacatcatatgatgaggttcatgacagttttgatgccatgggtttgcaagaaaaccttcttaggggaatctatgcctatggttttgagaagccatctgctatccagcaaaggggtattgttcctttttgcaagggtcttgatgtgatccaacaggcacaatctggtacaggaaagactgcaactttctgctctgggattctccagcaacttgattacagcttagtcgaatgtcaggctctggttctggctccaacccgtgagcttgcccaacagattgagaaggttatgcgagcacttggtgactatcttggtgtgaaggttcatgcctgtgtaggaggtaccagtgtccgtgaggatcagcgtatccttcaaagtggtgttcatgtggttgttggtactcctggtcgtgtatttgacatgttgcgcaggcagtctcttcgccccgaccacatcaagatgtttgttctggatgaagctgatgaaatgctctcaagaggtttcaaggatcagatttatgatattttccaattgctgccaccaaagattcaagttggtgttttctctgccacaatgccaccagaggcccttgaaattactaggaagttcatgaacaagcctgtgaggatccttgtgaagcgtgatgagctcactcttgaaggtatcaagcaattttatgtgaatgttgacaaggaagagtggaagcttgaaactctttgcgatctttacgagaccttagccatcacccagagtgtgatctttgtgaacaccaggcgtaaggttgattggctcactgataagatgcgcagccgtgatcacacagtatctgccactcatggagacatggaccagaacaccagagatatcattatgcgagagttccgatctgggtcatctcgtgtgcttatcactaccgatcttctggcacgtggtattgatgtgcagcaagtatcccttgtgattaactatgaccttcctactcagccagaaaactacttgcatcgtattggtcgtagtggacgatttggaaggaagggtgtagctatcaattttgtcacaaaggatgatgaaaggatgctttttgacattcagaagttttacaatgttgtagtggaggagctaccagccaatgtggccgatcttctttgaggtggtggttttggttgtctgagctgaattcttccttatattaagtaatttaatattttattcttaggttagttagaaccgcactggactaaaagttggaaactgcagtttctgtgattcgtcgtagttttccaattttgttggttttgtctttttgtattgcaagtccacaacaacttcaggttttggatgtctttgaatttttaagtatatttgatttaaacttttggccta

SEQ ID NO: 4716 - DNA, 1516 bp, Malus domestica
ctttcaaactccacggcgcagatccgaggagtttgggaaaccctagctctcttttagcaacctccaattgtcctctacttctctctctagcgctcatcaacatcatcagtcatggcaggtgttgcacccgagggatcacaatttgatgcaaaacagtatgatactaagatgagtgagctgctctcaactgatgggcaagatttcttcacatcgtatgatgaagtttttgaaagttttgatgccatgggattgcaggaaaatctgctgagaggcatttatgcttatggttttgagaagccttctgcaattcagcaaaggggaattgttccattctgcaaaggccttgatgtgattcaacaggctcagtctggaaccgggaaaacagcaaccttttgctcagggattttgcagcaacttgattatggtgttgtccagtgccaggccttggttttggctcctaccagggagttggcacagcagattgagaaggttatgcgagcacttggtgactaccttggcgttaaggttcatgcttgtgttggtgggacaagtgttcgtgaggatcagcgcattcttcaagctggtgttcatgttgttgttggaacccctggtcgtgtgtttgacatgttgaggaggcagtcgcttcgcccagattacattaagatgtttgtattggatgaggctgatgaaatgctttctcgtggttttaaggatcagatctacgacattttccagcttttgccatcaaaggttcaggttggggtgttctctgctaccatgccacctgaagcccttgaaatcactagaaagtttatgaacaaacctgtgaggattttggtaaagcgtgatgagctcacccttgagggtatcaagcagttctatgtcaatgtcgataaagaagaatggaagctcgagaccctttgtgatttgtatgagactctggccatcacccagagtgtcatttttgttaacaccaggcgcaaggtggactggcttaccgacaagatgagaagccgtgaccacactgtctctgccacccatggtgacatggaccagaacactcgtgatatcatcatgcgtgaattccgatcaggctcatcccgtgttctcatcaccactgatctcttggctcgtggtattgatgtgcagcaggtatctctcgtaatcaactatgatttgccgactcaacctgaaaactaccttcatcgtattggacgaagtggtagatttggaaggaagggtgttgctattaactttgtgacaaaagacgacgagagaatgctctatgacatccagaggttttacaacgtggtgattgaggagctcccatcgaatgtggccgatcttctctgaagaactcgcgcattttgttcccccgcttatctttttgaggcagatttttattatcctgttttgaaagtactgtttaatgctgctgcttttcattttgttttgtcctcaatttatgctgtcaaacatatctaactgttcaatggtatgcgccttcttgctcggt

SEQ ID NO: 4717 - DNA, 1617 bp, Malus domestica
ttcaaactccacggcgcagatccgaggagtttgggaaaccctagctctcttttagcaacctccagttgtcctctgctcttctctctctctctctccagcgttcgtcaacatcatcagtcatggcaggtgttgcacccgagggatcacagtttgatgcaaaacagtatgatactaagatgagtgagctgctctcaactgatgggcaagatttcttcacatcgtatgatgaagtttttgaaagttttgatgccatgggattgcaggaaaatcttctgagaggcatttatgcgtatgggtttgagaagccttctgccattcagcaaaggggaattgttccattctgcaaaggccttgatgtgattcaacaggctcagtccggaaccgggaaaacagcaaccttttgctcggggattttgcagcaacttgattatggtgttgtccagtgccaggctttggttttggcacctaccagggagttggcacagcagattgagaaggttatgcgagcacttggtgactaccttggtgtaaaggttcatgcttgtgttggtgggacaagtgttcgtgaggatcagcgcattcttcaagctggtgttcatgttgttgttggaacccctggtcgtgtgtttgacatgttgagaaggcagtcacttcgcccagattacatcaagatgtttgtattggatgaggctgatgaaatgctttctcgtggttttaaggatcagatctacgacattttccagctcctgccatcaaaggttcaggttggggtgttttctgctaccatgccacctgaagccctggaaatcacaaggaagtttatgaacaaacccgtgaggatcttggtaaagcgtgatgagctcacccttgagggtatcaagcagttctatgtcaatgtcgataaagaagaatggaagctcgagaccctttgtgatctgtatgagaccctggccatcacccagagtgtcattttcgttaacaccaggcgcaaggtggactggcttactgacaagatgagaagccgcgaccacactgtctccgccacccacggtgacatggaccagaacactcgtgacatcatcatgcgtgaattccgatctggctcatcccgcgttctcatcaccactgatctcttggctcgtggtatcgatgtgcagcaggtatctctcgtaataaactatgatttgccaactcaacccgagaactaccttcatcgtattggacgaagtggaaggtttgggagaaagggtgtcgctattaactttgtgacaagggacgacgagagaatgctctatgacatccagaggttttacaatgtggtgatcgaggagctcccatcgaatgttgccgatctgctctgaagagctcacgttttgttccggttctctttttgaggcagtttttaattatcctgttttgaaagtactgttttatgctgctgtttttggttttgttttgtcctcaaacatatctaactgttaaatggtatgcggccttcttgctcggtcggtttcgatatatgaagaaagacttttaggatgtccgttgcatactgtcattgtgcggttcaggtttttgttattttgaatggttataaatattaaggttgtttcaata

SEQ ID NO: 4718 - DNA, 1692 bp, Aquilegia formosa
tcttcactcttctgcgtttctttaactccaccgaaggagttttggaaaccctaaaagcacaacaaaaaaagcaaacgaaacaaagctttctttcaatctctctctcttttaaatcttctttgctcgttcgttcgttttatctcaatcaatcaatctctaatcatggctggtttggcacccgaaggatcacagtttaatgctcaacaatatgattcaagaatggaactagttaatgctgatggacaagatttcttcacttcatatgatgaggttcatgagagttttgatgcaatgggtttgcaagagaaccttctgagaggcatctatgcatatggttttgagaagccctctgctatacagcaaaggggaattgtacccttctgtaagggtctcgatgtcatccaacaagcacagtctggaactggaaagacagccactttctgctctggaatcttgcagcagcttgattatagtctagttgaatgccaggcattggttctcgctccaactagagaacttgctcaacaaattgagaaggttatgcgtgcacttggagactatcttggtgtcaaggttcatgcatgtgttggtggaacaagtgttcgtgaggatcaacgcattctttctggcggggttcatgttgtagttggtactcctggccgtgtctttgacatgctgcgcagacagtcacttcgccctgattgcatcaaaatgtttgtattggatgaggcagatgagatgctttccagaggtttcaaggatcagatttatgacattttccagcttctgccctcaaaagttcaggtaggggtattctctgcaactatgccacctgaagcccttgagatcacaaggaaatttatgaacaagcctgtcagaattttggtgaagcgtgatgagctaacccttgagggtattaagcaattctatgttaatgttgacaaggaagagtggaaattggagactttgtgtgatctttatgagaccttggctattactcagagtgtcatctttgtaaatacgcgacggaaggttgattggttgaccgacaagatgaggggccgtgaccatactgtgtctgccactcatggagacatggaccagaatactagggatattatcatgcgtgaatttcgttctgggtcctcccgtgtgctcatcaccactgacctcttggctcgtggtattgatgtccagcaggtttctcttgtcataaattatgatcttcctacgcagccagagaactatcttcatcgtattggacgtagtggtcgatttggaaggaaaggtgttgctatcaactttgtgactcgtgatgatgaaagaatgctttttgacatccagaagttctataatgtggttattgaggagcttccatcaaatgttgctgatctcctctaatgaagctttttctcttggcatgttgaggtatgggcacttggagtttgttaagtgcactattttatgtggttatataggaagttgtcgtaatttagtggtgggtgcacctgactattgagtaatgttggtccctatttgcaatagagtgcttgcccattttcgctgtgtggcatcaatttattgcaagcttagtcgcaacttggggttctgtatcgtatgctttccttttataccccaaaagggaaggtagcttggatttattttatttcttttccccaaggtgtggttatc

SEQ ID NO: 4719 - DNA, 1764 bp, Aquilegia formosa
tcttcactcttctgcgtttctttaactccaccgaaggagttttggaaaccctaaaagcacaacaaaaaaagcaaacgaaacaaagctttctttcaatctctctctcttttaaatcttctttgctcgttcgttcgttttatctcaatcaatcaatctctaatcatggctggtttggcacccgaaggatcacagtttaatgctcaacaatatgattcaagaatggaactagttaatgctgatggacaagatttcttcacttcatatgatgaggttcatgagagttttgatgcaatgggtttgcaagagaaccttctgagaggcatctatgcatatggttttgagaagccctctgctatacagcaaaggggaattgtacccttctgtaagggtctcgatgtcatccaacaagcacagtctggaactggaaagacagccactttctgctctggaatcttgcagcagcttgattatagtctagttgaatgccaggcattggttctcgctccaactagagaacttgctcaacaaattgagaaggttatgcgtgcacttggagactatcttggtgtcaaggttcatgcatgtgttggtggaacaagtgttcgtgaggatcaacgcattctttctggcggggttcatgttgtagttggtactcctggccgtgtctttgacatgctgcgcagacagtcacttcgccctgattgcatcaaaatgtttgtattggatgaggcagatgagatgctttccagaggtttcaaggatcagatttatgacattttccagcttctgccctcaaaagttcaggtaggggtattctctgcaactatgccacctgaagcccttgagatcacaaggaaatttatgaacaagcctgtcagaattttggtgaagcgtgatgagctaacccttgagggtattaagcaattctatgttaatgttgacaaggaagagtggaaattggagactttgtgtgatctttatgagaccttggctattactcagagtgtcatctttgtaaatacgcgacggaaggttgattggttgaccgacaagatgaggggccgtgaccatactgtgtctgccactcatggagacatggaccagaatactagggatattatcatgcgtgaatttcgttctgggtcctcccgtgtgctcatcaccactgacctcttggctcgtggtattgatgtccagcaggtttctcttgtcataaattatgatcttcctacgcagccagagaactatcttcatcgtattggacgtagtggtcgatttggaaggaaaggtgttgctatcaactttgtgactcgtgatgatgaaagaatgctttttgacatccagaagttctataatgtggttattgaggagcttccatcaaatgttgctgatctcctctaatgaagctttttctcttggcatgttgaggtatgggcacttggagtttgttaagtgcactattttatgtggttatataggaagttgtcgtaatttagtggtgggtgcacctgactattgagtaatgttggtccctatttgcaatagagtgcttgcccattttcgctgtgtggcatcaatttattgcaagcttagtcgcaacttggggttctgtatcgtatgctttccttttataccccaaaagggaaggtagcttggatttattttatttcttttccccaaggtgtggttatcttttgttttgttttttttatctttttctttttaattttgtttttcattttgagagattggtatgtagaaatg

SEQ ID NO: 4720 - DNA, 1564 bp, Persea americana
cactctttggagttgagaaaaaaccctagcgctctttcttccgctctcatcgcattttcgctattagtctccgctgcaattaccaatcgaatccatccatctcagtcatggcaggagtggcaccagaaggatcgcaatttgatgctcgccaatttgatgccaaaatgaatgaattgcttacaacagatgcccaagacttttttacgtcgtatgatgaggtttttgagagcttcgactctatgggtcttcaggagaaccttctaagaggcatatatgcatacggttttgagaagccatccgcaatccaacagaggggaattgtgcctttctgtaagggacttgatgtaattcagcaggcgcaatctggtactggtaagacagcaactttctgctctggaattctgcagcagctagattatggtcttgttgaatgtcaagcattggttcttgctccgactcgggaacttgcacaacaaattgaaaaggttatgagggcacttggtgattatcttggcgtgaaggttcacgcttgtgttggtggaactagcgttcgtgaggatcagcgcattctttccagtggcgttcatgttgttgtgggcactcctggtcgtgtttttgatatgctgcgaaggcaatcccttcggcctgactacattaagatgttcgtcttagatgaggcagatgaaatgctttctcgaggttttaaagatcagatttatgatatatttcagctgcttccttcaaaaattcaagttggcgtcttctctgctacaatgcctcctgaggcgttggagatcacccgcaagttcatgaataagcctgtgagaattttggtgaagagagatgagctcacccttgagggaatcaagcagttctatgttaacgttgaaaaggaagagtggaaattggagaccctctgtgacctctatgagacattggcaatcacacagagtgttatctttgtaaacactcgacgaaaggttgactggctaactgataagatgcgcagccgagaccacactgtatctgcaactcatggagatatggaccagaacactagagacatcattatgcgtgagttccgctctgggtcttcacgggtgcttattaccaccgatctgctggcccgtggcattgatgtgcaacaagtctcacttgtcataaactatgatctgccgactcaaccagagaactatcttcatcgtattggacgaagtggtcgttttggaaggaaaggtgttgcaattaacttcgtgaccctggatgacgagaggatgctgtttgatattcagaagttctacaacgtggtgatagaggagctgccatcgaatgttgccgatctcctctgatgagcaactatctattcatgaaggtaagactctttttttcttggtacctgatattatcagtgttccttcataggcttggtgtttgatgtgggtgttgataaactgcaaactttatccgactattgagtgatgttggtccagcacatttgcaatgttgagttcagttagtatctattccaacaggtggatgtgtctcaataaggggatctcttcat

SEQ ID NO: 4721 - DNA, 1580 bp, Persea americana
  misc_feature (1455)..(1455): n is a, c, g, or t
ggaattcgcgtgtgggcactctttggagttgagaaaaaaccctagcgctctttcttccgctctcatcgcattttcgctattagtctccgctgcaattaccaatcgaatccatccatctcagtcatggcaggagtggcaccagaaggatcgcaatttgatgctcgccaatttgatgccaaaatgaatgaattgcttacaacagatgcccaagacttttttacgtcgtatgatgaggtttttgagagcttcgactctatgggtcttcaggagaaccttctaagaggcatatatgcatacggttttgagaagccatccgcaatccaacagaggggaattgtgcctttctgtaagggacttgatgtaattcagcaggcgcaatctggtactggtaagacagcaactttctgctctggaattctgcagcagctagattatggtcttgttgaatgtcaagcattggttcttgctccgactcgggaacttgcacaacaaattgaaaaggttatgagggcacttggtgattatcttggcgtgaaggttcacgcttgtgttggtggaactagcgttcgtgaggatcagcgcattctttccagtggcgttcatgttgttgtgggcactcctggtcgtgtttttgatatgctgcgaaggcaatcccttcggcctgactacattaagatgttcgtcttagatgaggcagatgaaatgctttctcgaggttttaaagatcagatttatgatatatttcagctgcttccttcaaaaattcaagttggcgtcttctctgctacaatgcctcctgaggcgttggagatcacccgcaagttcatgaataagcctgtgagaattttggtgaagagagatgagctcacccttgagggaatcaagcagttctatgttaacgttgaaaaggaagagtggaaattggagaccctctgtgacctctatgagacattggcaatcacacagagtgttatctttgtaaacactcgacgaaaggttgactggctaactgataagatgcgcagccgagaccacactgtatctgcaactcatggagatatggaccagaacactagagacatcattatgcgtgagttccgctctgggtcttcacgggtgcttattaccaccgatctgctggcccgtggcattgatgtgcaacaagtctcacttgtcataaactatgatctgccgactcaaccagagaactatcttcatcgtattggacgaagtggtcgttttggaaggaaaggtgttgcaattaacttcgtgaccctggatgacgagaggatgctgtttgatattcagaagttctacaacgtggtgatagaggagctgccatcgaatgttgccgatctcctctgatgagcaactatctattcatgaaggtaagactctttttttcttggtacctgatattatcagtgttccttcataggcttggtgtttgatgtnggtgttgataaactgcaaactttatccgactattgagtgatgttggtccagcacatttgcaatgttgagttcagttagtatctattccaacaggtggatgtgtctcaataaggggatctcttcat

SEQ ID NO: 4722 - DNA, 1798 bp, Theobroma cacao
cgcggggattgctatcaacactaaacagcgctctcttctctcttctcctctttttttcctttaaactccacggcgcagatccgaggagtttgggaaaccctaactctctctctaaatctcaaccgaaaaagcctcccgaaaactaccccttttcacctctctctctctctctgtctatctcctcaacaaatccacccactccctaaaacactttcttcttctcttgctctagctatcttcatctgcttcaagccatggcaggtttggcaccagaaggatcccaattcgatgctcgtcaatatgatcagaaaatgactgagttgcttcaaactgatggagatgagtttttcacaagttatgatgaagtttatgacagttttgattcaatgggacttcaagagaaccttttgaggggtatctatgcatatggttttgagaagccttctgcaattcagcaaagaggaattgttccattctgcaagggtcttgatgtaattcagcaggcacagtctggaaccgggaagacagcaactttctgctctggaattctacaacaacttgactatggtgtagtccaatgccaggctctggttttggcgcccactagggagttggcgcaacagattgagaaggtgatgcgggcacttggtgattaccttggtgtgaaggtccatgcttgtgttggtgggacaagtgttcgagaggatcaacgcattcttcaaagtggtgtgcatgttgttgttggcactccgggtcgtgtctttgacatgttgagaaggcagtcacttcgaccagattatattaagatgtttgtcttggatgaggctgatgaaatgctttctcgtggttttaaggatcagatctatgatatttttcagcagctgccagccaagattcaggttggagtattttctgccacaatgccaccagaagcccttgagatcactaggaagttcatgaacaaacctgtgagaattttggttaagcgtgatgagctcaccctcgagggtatcaagcagttttatgtgaatgttgaaaaggaagagtggaagcttgaaactctatgtgatctctatgagaccctggccatcacccagagtgtcatttttgtgaacaccaggcgcaaggttgactggctaactgacaagatgcgaagtcgtgaccacacagtgtctgccacccatggagacatggaccagaatacgcgtgacattataatgcgtgaattccgttctggttcttctcgtgttctcatcactactgatctcttggctcgtggtattgatgtgcagcaagtctctcttgtcataaactatgatctgccgactcaaccagaaaactacctccaccgtattggacgaagtggaaggtttggaagaaaaggtgttgccattaactttgtgactagggatgatgagagaatgctgtttgacatccagaaattctacaatgtggttgtcgaggagctgccatcaaacgttgctgatctcctttgatgagattaccctttttgaagattgttgaggcaaggggttttgttgttttgcaagtactatttaacgtgctcttttctttttcttttctcatttagtgtcttaagttaatgttgttcttaaacatatctgaccatttaatgatatgggtcttgcacaattgctacataaagattgtccagttttgcccactccgtgatggtgggtttatgttatttcaagttttgatgcggttaggtttttggattgtatgttgctattagtatttcatccttatatataaattattaaaggctgttactggt

SEQ ID NO: 4723 - DNA, 1659 bp, Gossypium hirsutum
caacacttctctcctctctcaaaactccgcggcgcagatccgaggagtttgggaaaccctatctctctctaaatatcaaccgaaaaaagctcaaaaaactaccctttcttccccctctctctctctctcccctctctcacacacttcctctcattctctttctttccaacctttctacactccttttttccccatcgctcctactgttttcatctgcttcaagtcatggcaggtttggcaccggaaggatcccaatttgatgctcgccaatatgatcagaaaatgactgagttgctccaaactgatggagatgattttttcacaagttatgatgaagtttatgacagttttgatgcaatgggacttcaagagaatcttctgaggggtatctatgcgtatggttttgagaagccttctgcaattcaacaacgaggtattgttccattttgcaagggtcttgatgttattcagcaagcacagtccggaactgggaagacagcaactttctgctctggaattctacaacaacttgattatgctatggtccaatgccaggctctggttttggcacccactagggagttggcacaacagattgagaaagtgatgcgggcacttggtgattaccttggtgttaaggtccacgcttgtgttggtgggacaagtgttcgtgaggaccagcgcattcttcaaagtggtgttcatgttgttgttggaactcctggtcgtgtctttgacatgttgaggaggcagtcactccgcccagattatattaagatgtttgttttggatgaggctgatgaaatgctttctcgtggttttaaggatcagatctacgatatcttccagctgctgccagccaagattcaggtgggagtattttctgccacaatgccacctgaagcccttgagatcactaggaagttcatgaacaaaccagtgagaattttggttaagcgtgatgagctcaccctcgagggtatcaagcagttttatgtgaatgttgaaaaggaggaatggaagcttgaaactctttgtgatctctatgagacccttgccatcacccagagtgtcattttcgtgaacacaagacgcaaggttgactggctaactgacaagatgcgaagccgtgaccacacagtttctgccacccatggagacatggaccagaacactcgtgacatcatcatgcgtgaattccgctccggttcttctcgtgttctcatcacaactgatctccttgctcgtggtattgatgtgcagcaagtgtctctagtcataaactatgatctgccgactcaaccagaaaactacctccaccgtatcggacgaagtggaaggtttggaaggaaaggtgttgccattaactttgtgactaatgatgacgagagaatgctgtatgacatccagaagttctacaatgtgatcattgaggagctgccgtcaaacgtcgctgatctcctttgatgagattaccttttttggaagattatttgaggcaaagggttttgttgttttgcaagtcctattttaacgtgcgcttttcttgtttctttctttattttttttttcttcctttctagtttcttaagttaatgttgttcttaaaaacatatttgaccattttaatgatatggttcctgcacattttctagataa

SEQ ID NO: 4724 - DNA, 1599 bp, Nicotiana benthamiana
  misc_feature (25)..(25): n is a, c, g, or t
  misc_feature (264)..(264): n is a, c, g, or t
  misc_feature (270)..(270): n is a, c, g, or t
  misc_feature (285)..(285): n is a, c, g, or t
  misc_feature (324)..(324): n is a, c, g, or t
  misc_feature (333)..(333): n is a, c, g, or t
  misc_feature (342)..(342): n is a, c, g, or t
  misc_feature (351)..(351): n is a, c, g, or t
  misc_feature (528)..(528): n is a, c, g, or t
  misc_feature (534)..(534): n is a, c, g, or t
  misc_feature (1465)..(1465): n is a, c, g, or t
gcacgagggtagatccgagaagttngggaaaaaaaccctaacttctcttattactcacaaccgcagcatctcttctcttcctctacatcttcagtcatggcaggtgcagctcctgaaggatcacagtttgatgctcgtcagtatgattcgaaaatgacagaattgctaaatgctgaagggcaagatttctttacctcatacgatgaggtctatgatagttttgatgccatgggattgaaggagaacctcctcaggggcatttangcatanggttttgagaaaccntcagcaattcaacaaagaggaattgtacctttctgcaanggtcttgangtgattcancaggctcantctggaactggaaagactgctactttttgctctggaattctgcaacaactagactatgaactactagactgtcaagctttggtcttggcacctactcgtgagcttgcacagcaaattgaaaaggtcatgcgagcacttggagactatcttggtgtcaaggttcatgcttgtgtgggnggcacnagtgtccgtgaggatcaacgcatcctttcaagtggggttcacgttgttgtgggaacccctggacgtgtatttgacatgctaaggagacagtctctccgccctgaccacattaagatgtttgtattagacgaggctgatgaaatgctttccagaggcttcaaggatcagatctacgatattttccagctcttgcctcctaagattcaggttggtgttttctctgctacaatgcctcctgaggcccttgagatcacaaggaagttcatgaacaaacccgtgaggattcttgtgaaacgtgatgaactgaccttagaaggtattaaacagttttatgtgaatgtggacaaggaagaatggaagcttgagaccctttgcgatttgtatgaaaccttggccatcacacagagtgtgatatttgtgaatactcgtcgcaaagttgattggttgactgacaagatgcgaagcagagatcatacagtttcggccactcatggtgacatggatcagaatactagggatattataatgcgcgaatttcgttctggttcctctcgtgttctcatcaccactgatcttttggccagaggaattgatgtccaacaagtttcccttgtcataaattatgatctccccactcaacctgagaattaccttcatcgtattggacgtagtgggaggtttggtaggaagggtgtttcgatcaacttcgtaaccaacgacgatgagagaatgctgtctgacattcagaggttttacaatgtggtgattgaggagctcccagcaaatgttgctgatctcctgtaaccagctttggacattcagaggttttacaatgtggtgcttttgctgtgtctcgaaacttcccctcctttctttttcatcttcttgatatccttcttaccttttgtttgtttaatagtttctgtgattntgaactaatgagtaatgcatattagcattttgtaatccatcatattattcagtggtgggcttttgctagtgtttgacatccaaagtttgtattttgaaggtgatgtcagagtacattttaaatttgcaatttta

SEQ ID NO: 4725 - DNA, 1839 bp, Populus trichocarpa
aaacaccctcaaattggtacatagttaagcaagtccatctctctggctcccacacagtgctctatctatctatctaaacaaacagagtgttccttaaactcctccagcacaaacaacaaaagatccgaggagtttagggataagaaaccctaaccctaagtcaatctatctcttttctctctaatcaaacgtcgttatttccagttatggctggtttggcacctgaaggatcccaattcgatgctcgtcaattcgattctaagatgaatgagttgctcacaactgatgggcaagatttctttacttcatacgatgaggtgtatgacacttttgatgctatgggtttgaaggagaaccttctgaggggtatttatgcatatggttttgagaagccatctgcaattcaacaaagggggattgtcccattctgcaagggacttgatgtaatccagcaagcacaatcaggaactggaaaaacagctaccttttgctctggaattttgcagcagcttgattatgatgtagttgaatgccaagcactagttcttgcacctactcgagaactagcacaacagattgaaaaggttatgagagcactaggtgattatctgggtgtcaaggttcatgcttgtgttggtggaactagtgttcgtgaggaccagcgcattctctcagctggggttcatgttgtagttggtacccctggtcgtgtgttcgacatgttgcggagacaatcacttcggcctgactatatcaagatgtttgtattggatgaagcagatgaaatgctctcacgaggtttcaaggatcagatatatgatattttccagttgctgcccccaaagattcaggttggggttttctccgctactatgccacctgaggcactagaaattacaaggaagttcatgaataaacctgtgaggattttagtgaagcgtgatgagcttacgcttgagggtatcaagcaattctatgttaatgttgacaaggaggaatggaagcttgagacgctttgtgatctatatgagaccttggcaataacccaaagtgtcatctttgtgaacactaggcgcaaggtagattggcttacagacaagatgcgcagtcgcgatcacacagtctctgccactcatggagatatggaccaaaacacaagggacattattatgcgggaatttcgctctggttcctctcgtgtgctgatcactactgatctgttagcccgtggtattgatgtccagcaagtatcacttgtgatcaattatgatctgccaacacagccagagaactacctccatcgtattggtcgtagtggacgttttggaaggaagggtgttgctataaattttgttaccaaggatgatgaaagaatgctttctgacatccagagattttataatgtgacagttgaggagctgccgtcaaatgttgctgatcttctttgaagcaattttggttcaccaagttaaaagacttttgagtttggaagttcaaattattatcctcgttgtaggtttggggcctctatttagcttggatttgacttacccttcagacttggttctgtgcattttagattggggcgaatcccattgtgtgcagaataatccattgtgttaaatttttgcaagtttgttttcgcattttcctttgtgtcggagtaaagtttgcagaagtactgtagtgtctgtcgtagtatttggttccgtgcttggttttttattttatgcaagggaagttcttgtaggttaaaacaattgattaagctattacttcagaatatttgactctccattactgttcttttcggcaattttaattcgtgtttcttgattc

SEQ ID NO: 4726 - DNA, 1836 bp, Populus trichocarpa
aaacaccctcaaattggtacatagttaagcaagtccatctctctggctcccacacagtgctctatctatctatctaaacaaacagagtgttccttaaactcctccagcacaaacaacaaaagatccgaggagtttagggataagaaaccctaaccctaagtcaatctatctcttttctctctaatcaaacgtcgttattttcagttatggctggtttggcacctgaaggatcccaattcgatgctcgtcaattcgattctaagatgaatgagttgctcacaactgatgggcaagatttctttacttcatacgatgaggtgtatgacacttttgatgctatgggtttgaaggagaaccttctgaggggtatttatgcatatggttttgagaagccatctgcaattcaacaaagggggattgtcccattctgcaagggacttgatgtaatccagcaagcacaatcaggaactggaaaaacagctactttttgctctggaattttgcagcagcttgattatgatgtagttgaatgccaagcactggttcttgcacctactcgagaactagcacaacagattgaaaaggttatgagagcactaggtgattatctgggtgtcaaggttcatgcttgtgttggtggaactagtgttcgtgaggaccagcgcattctctcagctggggttcatgttgtagttggtacccctggtcgtgtgttcgacatgttgcggagacaatcacttcggcctgactatatcaagatgtttgtattggatgaagcagatgaaatgctctcacgaggtttcaaggatcagatatatgatattttccagttgctgcccccaaagattcaggttggggttttctccgctactatgccacctgaggcactagaaattacaaggaagttcatgaataaacctgtgaggattttagtgaagcgtgatgagcttacgcttgagggtatcaagcaattctatgttaatgttgacaaggaggaatggaagcttgagacgctttgtgatctatatgagaccttggcaataacccaaagtgtcatctttgtgaacactaggcgcaaggtagattggcttacagacaagatgcgcagtcgcgatcacacagtctctgccactcatggagatatggaccaaaacacaagggacattattatgcgggaatttcgctctggttcctctcgtgtgctgatcactactgatctgttagcccgtggtattgatgtccagcaagtatcacttgtgatcaattatgatctgccaacacagccagagaactacctccatcgtattggtcgtagtggacgttttggaaggaagggtgttgctataaattttgttaccaaggatgatgaaagaatgctttctgacatccagagattttataatgtgacagttgaggagctgccgtcaaatgttgctgatcttctttgaagcaattttggttcaccaagttaaaagacttttgagtttggaagttcaaattattatcctcgttgtaggtttggggcctctatttagcttggatttgacttacccttcagacttggttctgtgcattttagattggggcgaatcccattgtgtgcagaataatccattgtgttaaatttttgcaagtttgttttcgcattttcctttgtgtcggagtaaagtttgcagaagtactgtagtgtctgtcgtagtatttggttccgtgcttggttttttattttatgcaagggaagttcttgtaggttaaaacaattgattaagctattacttcagaatatttgactctccattactgttcttttcggcaattttaattcgtgtttcttga

SEQ ID NO: 4727 - DNA, 1724 bp, Solanum tuberosum
aagcagtggtatcaacgcagagtggccattacggccggggacacacaaacacaacagtctcatctttctaatctattcctctttcctgaactcctgcggcgtagatccgaggagtttcagacagtctttacaaaccctaacccccaatcgcttttacccacttctcctcctactctttactctttattcctcagatctttaactcatctttatcagtcatggctggcttggcaccggaaggttctcaatttgatgctcgtcaatttgatgctaaaatgaccgagctgcttgggactgaacagcaggagttcttcacatcatatgatgaggttcatgacagttttgatgccatgggtttgcaagaaaaccttcttaggggaatctatgcctatggttttgagaagccatctgctatccagcaaaggggtattgttcctttttgcaagggtcttgatgtgatccaacaggcacaatctggtacaggaaagactgcaactttctgctctgggattctccagcagcttgattacagcttagtcgaatgtcaggctctggttctggctccaacccgtgagcttgcccaacagattgagaaggttatgcgagcacttggtgactatcttggtgtgaaggttcatgcctgtgtaggaggtaccagtgtccgtgaggatcagcgtatccttcaaagtggtgttcatgtggttgttggtactcctggtcgtgtatttgacatgttgcgcaggcagtctcttcgccccgaccacatcaagatgtttgttctggatgaagctgatgaaatgctctcaagaggtttcaaggatcagatttatgatattttccaattgctgccaccaaagattcaagttggtgttttctctgccacaatgccaccagaggcccttgaaattactaggaagttcatgaacaagcctgtgaggatccttgtgaagcgtgatgagctcactcttgaaggtatcaagcaattttatgtcaatgttgacaaggaagagtggaagcttgaaactctttgcgatctttacgagaccttagccatcacccagagtgtgatctttgtgaacaccaggcgtaaggttgattggctcactgataagatgcgcagccgtgatcacacagtatctgccactcatggagacatggaccagaacaccagagatatcattatgcgagagttccgatctgggtcatctcgtgtgcttatcactaccgatcttctggcacgtggtattgatgtgcagcaagtatcccttgtgattaactatgaccttcctactcagccagaaaactacttgcatcgtattggtcgtagtggacgatttggaaggaagggtgtagctatcaattttgtcacaaaggatgatgaaaggatgctttttgacattcagaagttttacaatgttgtagtggaggagctaccagccaatgtggccgatcttctttgaggtggtggttttggttgtctgagctgaattcttccttatattaagtaatttaatattttattcttaggttagttagaaccgcactggactaaaagttggaaactgcagtttctgtgattcgtcgtacttttccaattttgttggttttgtctttttgtattgcaagtccacaacaacttcaggttttggatgtctttgaatttttaagtatatttgatttatacttttggcctcaacacaaaaataaaaactggagggggcccg

SEQ ID NO: 4728 - DNA, 1709 bp, Nicotiana tabacum
gcacattattgtatcgtatatctctacaaactccagggagccgtagatccgagaagtttgggaaaaaaaccctaacttctcttattactcacaactgcagcatctcttctctccctctacatcttcagtcatggcgggtgcagctcctgaaggatcacagtttgatgctcgtcagtatgattcgaaaatgacagagttgctaaatgctgaagggcaagatttctttacctcatacgatgaggtctatgatagttttgatgccatgggattgaaggagaacctcctcaggggcatttatgcatacggttttgagaaaccctcagcaattcaacaaagaggaattgtacctttctgcaaaggtcttgatgtgattcaacaggctcagtctggaactggaaagactgctactttttgctctggaattctgcaacaactagactatgaactactagactgtcaagctttggtcttggcacctactcgtgagcttgcacagcaaattgaaaaggtcatgcgagcacttggagactatcttggtgtcaaggttcatgcttgtgtgggaggcaccagtgtccgtgaggatcaacgcatcctttcaagtggggttcacgttgttgtgggaacccctggacgtgtatttgacatgctaaggagacagtctctccgccctgatcacattaagatgtttgtattggacgaggctgatgaaatgctttccagaggcttcaaggatcagatctacgatattttccagctcttgcctcctaagattcaggttggtgttttctctgccacaatgcctcctgaggcccttgagatcacaaggaagttcatgaacaaacccgtgaggattcttgtgaaacgtgatgaactgaccttagaaggtattaagcagttttatgtgaatgtggacaaggaagaatggaagcttgagaccctttgcgatttgtatgaaaccttggccatcacacagagtgtgatatttgtgaatactcgtcgcaaagttgattggttgactgacaagatgcgaagcagagatcatacagtctcggccactcatggtgacatggatcagaatactagggatattataatgcgcgaatttcgttctggttcctctcgtgttctcatcaccaccgatcttttggccagaggaattgatgtccaacaagtttcccttgtcataaattatgatctccccactcaacctgagaattaccttcatcgtattggacgtagtgggaggtttggtaggaagggtgtttcaatcaacttcgtaaccagcgacgatgagagaatgctgtctgacattcagaggttttacaatgtggtgattgaggagctcccagcaaatgttgctgatctcctgtaaccagctttggacattcagaggttttacaatgtggtgctttagctgtgtcgcgaaacttcccctcctttctttttcatcttcttgatatccttcttaccttttgtttgtttagtagtttctgtgattctgaactaatgagtaatgcatattagcattttgtaatccatcatcctatttagtggtgggcttttgctagtttttgacatccaaagtttttgtatttgaagaatgatatcgagtacatttagcggccgctaaaatgataacatcttactatgcttcgagatcgtgcccagcactctcctactttctctttgataacgatgttctaatatta

SEQ ID NO: 4729 - DNA, 1699 bp, Nicotiana tabacum
  misc_feature (27)..(27): n is a, c, g, or t
  misc_feature (31)..(31): n is a, c, g, or t
gaattcggcacgaggatcgcagtctcnctcncaaaaactcccaatacgttcaagatccgaggagcttgcgtaaaaccctaattttcatcactttctcttttgtcatatctccatcttactttcatcttcagtcatggcgggtgcagctccagaaggatcacagtttgatgctcgtcaatttgacacaaaaatgaatgagttgctttcagctgatgggcaagatttctttacttcatatgatgaggtttatgatagttttgatgccatgggtttgcaggagaaccttctgaggggcatttatgcatacggttttgagaaaccttcagcaatccagcaaagaggaattgtacccttttgcaaaggtcttgatgtaattcaacaggcgcaatctggaactgggaaaactgctactttttgttctggaattctgcagcaacttgcctatgaactgttggaatgtcaagctttagtcttggcgcctactcgtgagcttgcacaacaaattgaaaaggtcatgagggcacttggtgactaccttggtgtgaaggtacatgcatgtgtgggagggaccagcgtacgagaggaccaacgcatcctttcaagtggtgttcatgttgttgtgggaacgcctggacgtgtatttgacatgctgagaagacagtcacttcgccctgatcatataaagatgttcgtattggacgaggccgatgaaatgctttccagaggtttcaaggatcagatctatgatattttccagcttctgcctcctaagattcaggttggtgtattctctgctactatgcctcctgaggcacttgaaatcacaagaaagttcatgaacaaacctgtaaggattcttgtgaagcgtgatgagctgaccttagaaggtatcaaacagttttatgtcaatgtggataaggaagaatggaagctcgaaaccctgtgcgacctgtatgaaacattagccattacacagagtgtgatctttgtgaatacccgtcgcaaagttgattggctgacagacaagatgcgaagcagagaccatacagtgtcagctacccatggtgacatggaccagaacactagagatattataatgcgtgaattccgttccgggtcctcccgtgttctcatcactactgatcttttggcccgaggaattgatgtccaacaagtctccctagttataaactttgatcttcccacgcagcctgagaattatcttcatcgcattggacgtagtggacggtttggtaggaagggtgtggccatcaacttcgttacaaaggatgatgagaggatgctgtctgatattcagaggttttacaacgttgttattgaggagctgccagcgaatgttgctgatctcctgtaacaagcttttttcttgcttcagtggcaaaaatatagaagctggtactgtttgggcgggttctctctccacacatctacctcttttcttcccccggccctctcctttcattttcatattttcttgtgtaatgaatgtctaatttaatggtcctagtgtctgagattatgaacttgtgagtaatttacactagcgttgtttaatatatcactatattatacattggtagctgctgctagtttttgacatcaaagggttgtatctgaagtacaatgtcaaagtatgaaatcattcacttatgtcgaagtataatatcaaaaaaaaaaa

SEQ ID NO: 4730 - DNA, 1667 bp, Solanum lycopersicum
aaaacataacataatcataaaaactctctttcacacaatattgtcttcctgaactacgcggcgtagatccgaggagtttttggaaaaaagctgcagtctttacaaaccctaattctcaagaatcccctttttctcaaatcttcagatctctctttaacaatcttcttgttagctacaagtatggcaggctcggcaccagagggttctcagtttgatgctcgtcaattcgatgcgaaaatgacggagctacttggtactgaacaacaagattttttcacatcatatgatgaggtttatgacagctttgatgccatgggtttgcaagaaaaccttctgagaggcatctatgcctatggttttgagaagccatcagctattcagcaaaggggcatcgttcccttttgcaagggccttgatgttatccagcaggcacaatcgggaactggaaagacggcaactttctgctctggagttctccagcaacttgattacagtttagttgaatgtcaggctcttgttcttgcaccaacccgtgagctggcacaacagattgagaaggttatgcgtgcgctcggagactatctgggcgtgaaggttcatgcgtgtgttgggggtaccagtgtccgtgaggatcagcgtatccttcagagtggtgttcatgtggtagttggtactccaggccgtgtctttgacatgttgcgcagacagtctcttcgccccgaccacatcaagatgtttgttttggatgaagctgatgaaatgctctctagaggtttcaaggatcagatttatgatatattccagcttttgccaccaaagatccaagtgggtgttttctctgctacaatgccaccagaggctcttgagattactagaaaattcatgaacaagccagtgagaattctcgtgaagcgtgatgagctcactcttgaaggtattaagcaattctatgtcaacgtcgataaggaagagtggaaacttgaaacactttgtgatctttacgagaccttggccatcacccagagtgtcatctttgtcaacaccaggcgaaaggttgattggctcactgacaaaatgcgtggtcgtgatcacacagtatctgcaactcacggagacatggatcagaacactagggatatcattatgagggagttccgatctggctcatctcgtgtgcttatcaccaccgatctccttgctcgtggtattgacgtccaacaagtctcccttgtcatcaactatgacctgccaactcaaccagaaaactacctgcatcgtattggtcgtagtggacgatttggaaggaagggtgttgctatcaactttgttaccaaggatgatgaaaggatgctttttgacattcaaaagttttacaacgtcgtaatcgaggagctcccagccaatgttgctgatctcctttgaggtgattttggctctgtgagggggaattgttccttccctacaagtagtagtctaatatatttattcagagtgaacaactgcaaattttgtctggtttttgtgttattttgtttttggaagtgtccaaataactttggatttggtggttgttttgaattgtttatttgaactatttttctatgaatgttaggcttttagttatgttttctaatgtttgatgctatatttatgtcccactgtttctt

SEQ ID NO: 4731 - DNA, 1595 bp, Solanum lycopersicum
atattgtcttcctgaactacgcggcgtagatccgaggagtttttggaaaaaagctgcagtctttacaaaccctaattctcaagaatcccctttttctcaaatcttcagatctctctttaacaatcttcttgttagctacaagtatggcaggctcggcaccagagggttctcagtttgatgctcgtcaattcgatgcgaaaatgacggagctacttggtactgaacaacaagattttttcacatcatatgatgaggtttatgacagctttgatgccatgggtttgcaagaaaaccttctgagaggcatctatgcctatggttttgagaagccatcagctattcagcaaaggggcatcgttcccttttgcaagggccttgatgttatccagcaggcacaatcgggaactggaaagacggcaactttctgctctggagttctccagcaacttgattacagtttagttgaatgtcaggctcttgttcttgcaccaacccgtgagctggcacaacagattgagaaggttatgcgtgcgctcggagactatctgggcgtgaaggttcatgcgtgtgttgggggtaccagtgtccgtgaggatcagcgtatccttcagagtggtgttcatgtggtagttggtactccaggccgtgtctttgacatgttgcgcagacagtctcttcgccccgaccacatcaagatgtttgttttggatgaagctgatgaaatgctctctagaggtttcaaggatcagatttatgatatattccagcttttgccaccaaagatccaagtgggtgttttctctgctacaatgccaccagaggctcttgagattactagaaaattcatgaacaagccagtgagaattctcgtgaagcgtgatgagctcactcttgaaggtattaagcaattctatgtcaacgtcgataaggaagagtggaaacttgaaacactttgtgatctttacgagaccttggccatcacccagagtgtcatctttgtcaacaccaggcgaaaggttgattggctcactgacaaaatgcgtggtcgtgatcacacagtatctgcaactcacggagacatggatcagaacactagggatatcattatgagggagttccgatctggctcatctcgtgtgcttatcaccaccgatctccttgctcgtggtattgacgtccaacaagtctcccttgtcatcaactatgacctgccaactcaaccagaaaactacctgcatcgtattggtcgtagtggacgatttggaaggaagggtgttgctatcaactttgttaccaaggatgatgaaaggatgctttttgacattcaaaagttttacaacgtcgtaatcgaggagctcccagccaatgttgctgatctcctttgaggtggttttggctctgtgagggggaattgttccttccctacaagtagtagtctaatatatttattcagagtgaacaactgcaaattttgtctggtttttgtgttattttgtttttggaagtgtccaaataactttggatttggtggttgttttgaattgtttatttgaactatttttctatgaatgttaggcttttagttaatgttttct

SEQ ID NO: 4732 - DNA, 1903 bp, Solanum lycopersicum
ccgagtacgacagcgtattgacccgcattgtaatttgtaagtccgtttggggtcaaaataatcgaaatcggggctatagtagtagtagtaaatacacaagagtctcatctttctaatctattcttctttactgaactcctgcggcgtagatccgaggagtttcagacaaaaaaccctaacccccaatcgcttctctttccctcagatcttttactcttctttatcagtcatggctggcttggcaccggaaggttctcaatttgatgctcgtcaatttgatgctaaaatgacagagctgcttgggactgaacagcaggagttctttacatcatatgatgaagttcatgacagtttcgatgccatgggtttgcaagaaaatcttcttaggggcatctatgcctatggttttgagaagccatctgctatccagcaaaggggtattgttcctttttgcaagggtcttgatgtgattcaacaggcacaatctggtacaggaaagacagcaactttctgctctgggattctccagcagcttgattacagcttagtcgaatgtcaggctctggttctggctccaacccgtgagcttgcccaacagattgagaaggttatgcgagcacttggtgactatcttggtgtgaaggttcatgcctgtgtaggaggtaccagtgtccgtgaggatcagcgtatccttcaaagtggtgttcatgtggttgttggtactcctggtcgtgtatttgatatgttgcgtaggcagtctcttcgccctgaccacatcaagatgtttgttctggatgaagctgatgaaatgctctcaagaggtttcaaggatcagatttatgatattttccaattgctgccaccaaagattcaagttggtgttttctctgctacaatgccaccagaggctcttgaaattactaggaagttcatgaacaagcctgtgaggatccttgtgaagcgtgatgagctcactcttgaaggtatcaagcaattttatgtcaatgttgacaaggaagagtggaagcttgaaactctttgcgatctttacgagaccttagccatcacccagagtgtcatctttgtgaacaccaggcgcaaggttgattggctcactgataagatgcgcagccgtgatcacacagtatctgccactcatggagacatggaccagaacactagagatatcattatgcgagagttccgatctggatcatctcgtgtgctcatcactactgatcttctggcacgtggtattgatgtgcagcaagtatcccttgtgattaactatgacctgcctactcagccagaaaactacttgcatcgtattggtcgtagtggacgatttggaaggaagggtgtagctatcaattttgtcacaaaggatgatgaaaggatgctttttgacattcagaagttttacaatgttgtagttgaggagctgccagccaatgtggccgatcttctttgaggtgattttggttctgtgaggtgaatttttcgttatattaagtaatttaatattttattgttaggttagttagagccgcagtggactaaaacttggaaactgcagtttctgtgattcgccgtgggaattgtagttttccaatttagttggacttatttacaaattttgttggttttgtctttttgtattgtaagtccacaacaacttcaggttttggatgtctttgaatttagtatatttcattttaatccttggccttttttcttcttctttttttttcgttttgttgtatgggaacgcttttgacgacaatatgttcgttcatctgtattgtgtgatagtttctgtttgtgatgccttgtataggtttttttttcctgtgttgatgacttgtatcatacttggaacttgaattggataatatttttatca

SEQ ID NO: 4733 - DNA, 1797 bp, Solanum lycopersicum
ccgagtacgacagcgtattgacccgcattgtaatttgtaagtccgtttggggtcaaaataatcgaaatcggggctatagtagtagtagtaaatacacaagagtctcatctttctaatctattcttctttactgaactcctgcggcgtagatccgaggagtttcagacaaaaaaccctaacccccaatcgcttctctttccctcagatcttttactcttctttatcagtcatggctggcttggcaccggaaggttctcaatttgatgctcgtcaatttgatgctaaaatgacagagctgcttgggactgaacagcaggagttctttacatcatatgatgaagttcatgacagtttcgatgccatgggtttgcaagaaaatcttcttaggggcatctatgcctatggttttgagaagccatctgctatccagcaaaggggtattgttcctttttgcaagggtcttgatgtgattcaacaggcacaatctggtacaggaaagacagcaactttctgctctgggattctccagcagcttgattacagcttagtcgaatgtcaggctctggttctggctccaacccgtgagcttgcccaacagattgagaaggttatgcgagcacttggtgactatcttggtgtgaaggttcatgcctgtgtaggaggtaccagtgtccgtgaggatcagcgtatccttcaaagtggtgttcatgtggttgttggtactcctggtcgtgtatttgatatgttgcgtaggcagtctcttcgccctgaccacatcaagatgtttgttctggatgaagctgatgaaatgctctcaagaggtttcaaggatcagatttatgatattttccaattgctgccaccaaagattcaagttggtgttttctctgctacaatgccaccagaggctcttgaaattactaggaagttcatgaacaagcctgtgaggatccttgtgaagcgtgatgagctcactcttgaaggtatcaagcaattttatgtcaatgttgacaaggaagagtggaagcttgaaactctttgcgatctttacgagaccttagccatcacccagagtgtcatctttgtgaacaccaggcgcaaggttgattggctcactgataagatgcgcagccgtgatcacacagtatctgccactcatggagacatggaccagaacactagagatatcattatgcgagagttccgatctggatcatctcgtgtgctcatcactactgatcttctggcacgtggtattgatgtgcagcaagtatcccttgtgattaactatgacctgcctactcagccagaaaactacttgcatcgtattggtcgtagtggacgatttggaaggaagggtgtagctatcaattttgtcacaaaggatgatgaaaggatgctttttgacattcagaagttttacaatgttgtagttgaggagctgccagccaatgtggccgatcttctttgaggtgattttggttctgtgaggtgaatttttcgttatattaagtaatttaatattttattgttaggttagttagagccgcagtggactaaaacttggaaactgcagtttctgtgattcgccgtgggaattgtagttttccaatttagttggacttatttacaaattttgttggttttgtctttttgtattgtaagtccacaacaacttcaggttttggatgtctttgaatttagtatatttcattttaatccttggccttttttcttcttctttttttttcgttttgttgtatgggaacgcttttgacgacaatatgttcgttcatc

SEQ ID NO: 4734 - DNA, 1453 bp, Solanum phureja
tcatggcaggctcagccccagaaggatcacagtttgatgttcgtcaattcgactcaaaaatgaatgagttgctttcagctgatgatggccaagatttctttacctcatacgatgagatttatgatagttttgatgccatgggtttgcaggagaaccttctcagggggatttatgcatacggttttgagaaaccctccgcaatccagcaaagaggaattgtacccttttgcaaaggtcttgatgtaattcaacaggctcagtctggaactgggaagactgccacattttgttctggaattctgcagcaacttaactatgaacttctggaatgtcaagctttggtcttggcacctactcgggagcttgcacaacaaattgaaaaggtcatgagggcactaggtgactaccttggtgtcaaggtacatgcctgtgtgggaggaaccagtgttcgggaggatcaacgcatcctttcaagtggtgttcatgttgttgtgggaacacctggacgtgtatttgacatgctgagaagacagtcacttcgccctgatcatataaagatgtttgtattggatgaggctgatgaaatgctttctagaggcttcaaggatcagatctatgatattttccagctcttgcctcctaagattcaggttggtgtcttctctgctactatgccccctgaggcacttgaaatcacaagaaaattcatgaacaaacctgtgaggattcttgtgaagcgtgatgagctgacgttagaaggtatcaagcagttctatgtgaatgtggacaaggaagaatggaagcttgaaaccctgtgtgacctgtatgaaacattagccattacccagagtgtgatctttgtgaatactcgtcgcaaagttgactggttgacagacaagatgcgaagcagagaccatacagtgtcagctacccatggtgacatggaccagaacactagagatattataatgcgtgaattccgttctgggtcctcgcgtgttctcatcaccactgatcttttggcgcgaggaatcgatgtccaacaagtctcgctggtcataaattatgatctcccgactcagcctgagaattatcttcatcgtattggacgcagtggaaggtttggtaggaagggtgtggccatcaactttgtaacaaaggatgatgagaggatgctgtctgatattcagagattttacaacgttgttattgaggagctgccagcaaatgttgctgatctcctgtaagaagctattttcctacaaaataggagcgggtgggtgggttatacacacttcaatctcttttcctttttacattttctgtggtatctaaattatgcacattggccttgtgtaatccattattaaatgctagctgttgacctcaagggttgtatctcaagagtattagaaaatgattctacttcacgctacatttgaagttgccttac

SEQ ID NO: 4735 - DNA, 1709 bp, Malus domestica
ttacgaggactcgtcaaacgcccaaaccctctctctctctcttcctccttcgcgcattccttaactccgcggcttagatccgaggagtttgggaaaccctaatttccagaaaaaccagtacaaagctctcttccgttgctctctatctctcttcgccttcaactttctgactcatcacccgcagtcatggcagcagcacctgaaggatcgcaatttgacactcgtcagtatgataccaaaatgagcgaattacttgcaactgatgggcaggaattctttacatcatacgatgaagtttatgatagttttgacgctatgggtcttcaagagaatcttctcaggggaatctatgcttacggttttgaaaaaccctcggctattcagcagaggggaattgttcccttctgcaagggtcttgatgtgattcagcaggctcagtctggaactggaaagacagcaactttctgttccggtatccttcaacagcttgattatagtttgacagaatgccaagccttggttcttgcacccactcgagagcttgctcaacagattgagaaggttatgagggctcttggagactatctaggtgtaagggtgcatgcttgtgttggtggaaccagtgtccgtgaggaccaacgcattctgtcaaatggagtgcatgttgttgttggaactcccggtcgtgtttttgacatgcttagaaggcagtcacttcgtcctgatagtatcaagatgtttgttttggatgaggctgatgaaatgctttcccgtggtttcaaggatcagatctacgatatattccagcttcttccatcaaagattcaggttggtgtgttctctgcgacaatgccgcctgaggctcttgagatcacaaggaagttcatgaacaaacctgtgaggattctagtgaagcgtgatgagctcaccctggaaggtataaagcagttctatgtcaatgtcgacaaggaggaatggaagcttgagactctttgcgatctttatgagaccttggccattacccagagtgtcatttttgtcaatactcgacgcaaggttgactggttgactgacaagatgaggagcagagaccatacagtttctgccacccatggagacatggaccagaacaccagagacatcatcatgcgggaattccgttctgggtcatctcgtgtgttgatcaccactgatcttttggctcgtggtattgacgtgcagcaagtctcccttgttattaactatgatctgcccacccagcccgagaactacctccacagaattggtcgtagtggacgttttggaaggaagggtgttgccatcaacttcgtaacaaaggatgatgagaggatgctgtttgacatccagaagttctataacgtggttgtggaggagctgccatcaaacgtcgctgatctcctctgatgagattttgtcttcttaattactcaaggaaaaatccggtagtaagtgttgatttgattgaagtttattttctgtttttcgtccattgaggccgccacatcccgccattttgtgtcttctcttatattattatagagtctagttatttaatttacggttgttggattaatttaattaaagtcgcacaagttaaacttgcaatgtgaaaaccttcattgcctgaattggttgtggtggccaatctgttgttgcatactttctaccatattattaatgtatgtatt

SEQ ID NO: 4736 - DNA, 1599 bp, Cichorium intybus
cggccccccttttctttcaccgcactaaaattccctcaactccacggccaccccgaggagtttgagaaaaccctaaaaagcctccccaaaaatctctctgctttctctttaaatctttcaatcaatctgcaaatcagtcatggcaggcgctgcaccagaaggttcccagttcaatgctcagcaatttgattccaaaatgaatgaattgctttcaactgacggacaagactttttcacctcatacgatgaagtttatgatagttttgatgccatgggtttgcaagaaaacctcttaagaggcatctatgcatatggttttgaaaaaccatctgcaattcaacaaaggggaattgtcccattctgcaaaggtctcgatgtgatccaacaagctcaatcaggaacaggaaagactgcaactttttgctctggtattcttcaacaactcgactacaatacagtcgagtgtcaagctttggttctcgcaccaactcgtgaacttgcccaacaaattgaaaaagtcatgcgggccctaggggactaccttggggtcaaggtgcacgcgtgtgttggtgggaccagtgtccgtgaggaccaaaggatcctctcagctggtgtccatgtggttgttggtacacctggacgtgtctttgatatgcttaggaggcaatcactacgcgctgattatatcaagatgtttgttttggatgaagctgatgaaatgctttcaagaggtttcaaagatcagatctatgacatcttccagttgttaccctcaaaagtccaagtcggtgtcttttccgccacaatgccacccgaagccctcgaaatcacccgaaaattcatgaacaaacccgtaagaatcctcgtaaaacgagacgaattaaccctcgaaggtatcaaacaattttacgtcaacgtcgaaaaagaagaatggaagctcgaaaccctctgcgatctttacgaaaccctcgccatcacccaaagtgtcattttcgtaaatacccgccgaaaagtcgactggctaaccgacaaaatgcggtcccgcgatcacaccgtctccgccacccacggtgacatggaccaaaacacgcgtgacatcatcatgcgcgagtttcgatccggatcttcacgtgtcttaatcactacagatcttttggcacgtggaattgatgtccaacaagtgtcacttgttatcaactatgatcttcctacacagcccgagaattaccttcacaggattggtcgaagtgggcggtttggaagaaagggtgtggcgattaattttgtgactttggatgatgaaaggatgcttgcggatattcagaagttttataatgttgtggtggaggagttgccgtcgaatgttgcggatctgatttagaggaaaaaggttagaaagaaagttggttttgtgatccggttttgtttgtttttttttttttttaagttatggtgatgatgatggtggaagactttttgtgttataagatattgtgcggattggcgatgggtttcttcttgtactgttgccaatttttgcgacttgtgtttgtactctaaaagtttcttttttacccatgaaagtgtatggatttgttt

SEQ ID NO: 4737 - DNA, 1685 bp, Trifolium pratense
  misc_feature (599)..(599): n is a, c, g, or t
  misc_feature (623)..(623): n is a, c, g, or t
  misc_feature (904)..(904): n is a, c, g, or t
acaaaaaaaaaaaaacgctcttcgctctctctctttcctcaactccgcggcttagatctgaggagttttggaaaccctaataaccattctccgatcaacaacttcatcgcactttttctctccgatcaataactctttcatctccttaagcaatcatggcaggcgttgcaccagagggttctcagtttgatgctaagcaatttgattccaaaatgaatgagttgctcacaactgatgcacaggacttcttcacatcttatgatgaggtttatgatagttttgatgctatgggcttgcaagagaatcttcttagaggcatttatgcatatggttttgagaagccatcagcaattcagcaacgtggaatagttccattttgcaagggacttgatgttatacaacaggctcagtctggaacaggaaagacagcaaccttctgctctgggattctgcagcaacttgactacagtttgacagaatgccaagccttggtcttggcaccaactcgtgagcttgctcagcagattgagaaggtcatgcgtgcacttggagattatctaggtgtgaaggtgcatgcctgtgtgggaggaaccagtgtncgtgaagaccaacgcattctgtcnagtggtgttcatgtcgttgttggtacccctggtcgtgtatttgacatgctgcgcagacagtcgcttcgacctgatgtcatcaaaatgtttgtattggatgaagctgatgaaatgctttctcgtggttttaaggatcagatctatgatatattccagctgttgccatctaagattcaagtgggagttttctctgctaccatgcctcctgaggctcttgagatcacaaggaagtttatgaacaaacctgtgagaattcttgtgaagcgtgatgagctcacctnggagggtattaaacaattttatgtcaatgttgataaagaggaatggaagctcgacacactctgtgatctttatgagacattggcaatcactcagagtgtcatttttgtcaacaccagacggaaggttgactggctgactgacaagatgagaagccgtgaccacactgtctcagcaacacacggagacatggaccagaatactagagacattattatgcgtgaattccgttctggatcttcccgtgttttaattactactgatcttcttgcacgtggtattgatgtgcagcaagtgtctttagttataaattatgatctccccacacagcctgaaaactacctccatcgtattggtcgtagtggaaggttcggtaggaaaggtgttgccattaactttgtgacaacagatgatgaaagaatgctgagtgacatccagaagttctacaatgtgataattgaggagctgccttccaatgttgccgaacttctgtgatgagattttttcttcgatcatactagagggaagttggtttctgaggtaagtggtatgtaatgtttcccccctttttggcccatttgttgtatttctgttttcaaaccttgtttgacctttttaataggtgtagtaatttattttacattttcagtctgaatatcctaagtgataagtactcgcaacatggaatccattattattgtctgaattggtgtgttgatcgtttttgcacctttcctaatgagcaagttttagatttaagtttttagttattattctgattct

SEQ ID NO: 4738 - DNA, 1752 bp, Vitis vinifera
atcaaacctcttctacattcctcttactctctctctctccctcgcacgcacactcaactcctctaggcgtagatccgaggagtttgggaaaccctaaaccgcttcaaaatcaaagctcaagtctctcttgttctctctcatctctctcttccaatcagctctctcgctcttcgtcgatcgtcacatctttcagtcatggcaggcgtagcaccagaaggatcgcagttcgatacccgtaattatgatgccaaaatgactgagctgctttcaactgatggacaggatttcttcacatcttatgatgaggtttatgatagttttgattctatgggtttgcaagagaatcttctcagaggcatttatgcatatggttttgaaaaaccttctgcaattcagcaaagaggaattgttcccttttgcaagggacttgatgtaattcagcaagctcagtcaggaacaggaaagactgcaactttctgctctggtatcctgcagcagcttgattatgggttggtggaatgtcaggccttggttctggcacccactcgtgagcttgcacaacagattgagaaggttatgcgagcacttggtgactaccttggagtgaaggtacatgcgtgtgttggtgggaccagcgtccgtgaggaccagcgcattctttcaagcggtgttcatgttgtcgttggcacacctggtcgtgtatttgacatgctgcgaagacagtcccttcgtcctgattacattaaaatgtttgtgttggatgaagcagatgaaatgctctctcgaggtttcaaggatcagatctatgatattttccaactcctgccatcaaaagttcaagttggagtgttctctgccacaatgccacccgaggcccttgagattacaaggaagtttatgaacaaacccgtaaggattcttgtgaagcgtgacgagctgacccttgaaggtataaagcagttctatgtcaatgttgataaggaggagtggaaacttgagacactctgtgacctttatgaaaccttagccattacccagagtgtcatcttcgtgaacacccgacgcaaagttgactggctgactgacaagatgaggagccgagaccacacagtctcagccacccatggagacatggaccaaaatactagagacattatcatgcgggaattccgttctgggtcttctcgtgttcttatcaccactgatcttctggctcgtggtattgatgtccagcaagtctcccttgtcataaactttgatctccctacccagcccgagaactatctccatcgtattgggcgtagtggacggtttgggagaaaaggtgttgccattaactttgtgaccagggatgatgagagaatgctgtttgacatccaaaggttttacaatgtggtaatcgaggagctgccatcaaatgttgctgatctcctctaatgagattttgtcccttgggtcattagtagagaaaggtaagtgtcggattctatttggcaaagactatttaatatgctttttttttttttataatcatgtttaataggtctagtgtctaaatttaagatgtttgaattactgtcgagtgatatggctactgcatatgtttgcaatgtggagtccatcattacatgcttgtgtgtgatgggcatctgttgccaaatttcttgcagctaaggtttgtattgtatgtgtctttatatattgctcggactatagttttctctttatcagtttgcttttcttcaatgcttc

SEQ ID NO: 4739 - DNA, 1628 bp, Lactuca sativa
  misc_feature (894)..(894): n is a, c, g, or t
  misc_feature (897)..(897): n is a, c, g, or t
  misc_feature (900)..(900): n is a, c, g, or t
  misc_feature (984)..(984): n is a, c, g, or t
  misc_feature (1065)..(1065): n is a, c, g, or t
cactcaaattccctcaactccacggccacccgaggagtttgagaaaaccctaaaaagcctcctcaaaaatctcaactttttctctaaatctttccaccaatctgcaaatcagtcatggcaggcgctgcaccagaaggttcccagtttaatgctcagcagttcgattccaaaatgaatgaattgctttcaaccgatggacaagactttttcacctcatacgatgaagtttacgatagtttcgatgccatgggcttacaagaaaacctcttgagaggcatctacgcatatggttttgaaaaaccatctgcaattcaacaaaggggaatagtcccattctgcaagggtctagatgtgatccaacaagctcaatcaggaacaggaaaaaccgcaactttttgctcaggaatccttcaacaactcgactacaatgtagtcgagtgtcaagctttggttctcgcacccactcgtgaactcgcacaacaaattgaaaaagtcatgcgggccctcggcgactacctcggagtcaaagtccatgcgtgcgtgggcgggaccagtgtccgtgaggatcaaagaatcctctcggctggggtccacgtggttgttgggacacctggacgtgtcttcgacatgcttaggaggcagtcacttcgcgctgattacatcaaaatgtttgttttggacgaagctgatgaaatgctctcacgtggtttcaaagatcagatctatgatatcttccagttgcttccatcgaaagtgcaagtcggtgtgttttccgctacaatgccacccgaagccctagaaatcacccggaaattcatgaacaaacccgtgagaattttggtgaaaagagacgaacttacccttgaaggaatcaaacaattttatgtcaatgtnganaangaagaatggaaactcgaaacactctgtgacctttacgaaaccctagcaatcacccagagtgtcattttcgtaaatacgcgtcgnaaggttgactggttgaccgacaaaatgcgttcccgggaccacactgtgtccgccacccacggtgacatggaccaaaacacncgtgacatcatcatgcgggagtttcgatcgggatcttcacgcgtgttgatcactacagatcttttggcacgtgggattgatgtgcaacaggtgtcacttgttatcaattatgatcttccaacacagcctgagaattatcttcataggattgggcgaagtgggaggtttgggagaaagggtgtggccattaattttgtcactttggatgatgaacggatgcttgcggatattcagaagttttataatgttgtggtggaggagttgccttcgaatgttgcggatctcatataagattgtgaagtaagaaagaaaaaggtttagaggttgtttttgggatttactaatactatttactattattattattattattattgttattgttatcggttttgtttgttttaagttatgtttatgatgatggtggaagactttttgtgttataagatattatgcgaattggcaatgtgtttcttcttgttgtgttgccaatttttgcgacttgtgtttgtacttttgaaagtttcttttttagacgtgaatgtgtatggatttgtttgttt

SEQ ID NO: 4740 - DNA, 1529 bp, Quercus alba
aaaaaaaaaaaaaaaggaccttctttgctatcgttcctcaactccgcggcgtagatccgaggagtttgggaaaccctaattacttcacacaacaaaaaccaatactacttcccctctcttctacttcacttttcaccgatcaacagtcatggcggcaccagaggggtcacaatttgatgctcgtcagtttgatgctaaaatggatgagttactttcagctgatgctcaggacttcttcacatcatatgatgaggtttatgaaagttttgatgctatgggattgcaagagaatcttctgagggggatttatgcttatggtttcgaaaaaccctctgctattcagcaaaggggaattgtacccttctgtaagggtcttgatgttattcaacaggctcaatctggaactggaaagacagcaactttctgctctggtgttttgcaacaacttgactatagtttgacggaatgccaagctttggtcctggcacccactagagagcttgctcaacagattgagaaggtgatgcgggcacttggagactatcttggtgtaagagtacatgcttgtgttggtggaacaagtgttcgtgaagatcaacgcattctgtctagtggggttcatgttgttgttggcactcctggtcgtgtgtttgatatgctgcgaagacagtcacttcgtcctgattacatcaagatgtttgtattggatgaggctgatgaaatgctttcccggggtttcaaggatcagatctatgatattttccagcttctaccatcaaagattcaggttggggtattctctgccacaatgccacctgaggcccttgagattactaggaagttcatgaacaaacctgttagaattcttgtgaagcgtgatgagctcaccctggagggtataaaacagttttatgttaatgttgataaggaggagtggaaacttgagacactctgtgatctttatgaaactttggccatcacccagagtgtcattttcgtgaacacgaggcgcaaggttgattggcttacagacaagatgcggagccgtgaccacacagtctcagccacccatggtgatatggaccagaatacaagagacattatcatgcgggaattccgttctggatcatctcgtgtccttataacaactgatcttttggcacgtggtattgatgtccagcaagtctcccttgttattaattatgatctccctacacagccagagaactatctgcatcgtattggacgtagtggacggtttggtaggaagggtgttgccatcaactttgtaacaaaggatgatgagaggatgctgtttgacatccagaagttctataatgttgtagttgaggagctgccatcaaatgttgctgatctcctctaaagagattttgttttgtttagtagagaaagacagattctgtttggtaagtgtcatttgatatgtttctttgttttcctttgccaagtcttgtcttataggtctactgtctttattttaagatgttcgagtttcggactgtttaagt

SEQ ID NO: 4741 - DNA, 1582 bp, Elaeis guineensis
  misc_feature (620)..(620): n is a, c, g, or t
  misc_feature (632)..(632): n is a, c, g, or t
  misc_feature (635)..(635): n is a, c, g, or t
  misc_feature (647)..(647): n is a, c, g, or t
  misc_feature (671)..(671): n is a, c, g, or t
  misc_feature (881)..(881): n is a, c, g, or t
  misc_feature (1414)..(1414): n is a, c, g, or t
  misc_feature (1432)..(1432): n is a, c, g, or t
catcccttgagaaccccctccgcttgtctctctctcaccagagaagaatcgactttgcacgctctgtatctctctctcccccgccccctctccccgctcccagttcgaatcacttcctcttttccccggctcgagggtcgactgatctctggagaactacagacatggcaggagtggcaccagaaggatctcaattcgatgctcgccaatatgattccaagatgaatgagctgcttacgcaagatggccaagaattttttaccacatatgatgaggtctatgacagttttgattccatgggtcttcaagaaaatcttttgagaggcatttatgcatatggttttgagaagccatctgcaattcagcaaagaggaattgttcctttctgcaagggacttgatgttattcagcaggcacaatcagggacagggaaaactgcaactttctgttctggaattctgcagcagcttgactatggattggttgaatgccaggccttggttcttgcaccaactagagaattagcacagcaaattgagaaggttatgcgagcgcttggtgactatcttggtgtgaaagttcatgcttgtgtaggtggaactagtgttcgtgaggatcancgtattctttcnagnggggttcatgtngttgtgggtacaccaggtcgtgtntttgacatgttacggaggcagtctctccgccctgactatattaggatgtttgtgttggatgaagcagatgaaatgctttcacgtggtttcaaggatcagatatacgacatcttccagcttcttccttcaaaaattcaggttggggtattctctgccacaatgcccccagaagctcttgagattactcgcaagtttatgaacaaacctgtnaggatccttgtaaagcgagatgagcttaccttggagggtattaagcagttctatgtcaatgttgagaaggaagattggaagctggagaccctctgtgacctctatgagaccttggccattacacagagtgtgatcttcgtcaacacccggcgcaaggtggactggcttaccgacaagatgaggagcagggatcacacagtctcagctacccatggtgacatggatcagaacgctagggatattatcatgcgggagttccgttctggttcttctcgtgtacttatcaccactgatctcctggctcgtggtattgatgtccagcaggtgtccctggtcataaattatgatctgccaacccaaccagagaactatctccatcgtattggacgaagtggacgtttcggaaggaagggtgttgctatcaactttgtcacccgggatgatgaaagaatgctgtttgacattcagaggttctacaatgtggttattgaggagctgccatccaatgttgctgacctcctctgatgagtttngttgttgaacttcacatntattctgtatgtcctaccgggtttatcaataatcacgtcaaagttgtccctgactattcctagtcgcatgattagcaagacctttgagtggtgtcgggttcatttgcaatgatgataactcaaagataataattgtatgcctcatctttg

SEQ ID NO: 4742 - DNA, 1734 bp, Arachis hypogaea
ttgtttcttttctcacttcacaaacacactcttattctctcctcaactccgcggcgtagatccgaggagtttgggaaaccctaactccgctcgatcttcttccactgcaaacatcttcgtcttcttcatcatcaacatcaacatcaatatcaacatcatcatccgcagtcatggcaggagctgcacctgagggaacacagttcgatgctcgtcaatttgatgcaaaaatgaatgatttactcacagctgatggacaggacttcttcacatcttatgatgaggtgtacgatagctttgatgctatgggtttgcaagagaatctcctcagaggcatttatgcctatggttttgaaaagccatcagctattcagcaaaggggaatagtcccattttgcaagggacttgatgttattcaacaggcccaatccggaactggaaaaactgcaactttctgctctggaatcctgcaacaacttgactacagcctgactgaatgtcaggccttggttttagcgccaacccgtgagcttgctcagcagattgagaaggttatgcgggcgcttggagattatctaggtgtgaaggttcatgcctgtgtgggaggcaccagtgttcgtgaagaccaacgcattctcgccagcggtgttcatgttgttgttggtactcctggacgtgtctttgatatgctgcgcagacagtcacttcagccggatcacattaaaatgtttgtgttggatgaggccgatgaaatgctttcaaggggttttaaagaccagatctacgatatattccagttgctgccatctaagattcaggtaggagttttctctgccacaatgccacctgaggcccttgaaattactaggaagttcatgaacaaacctgtgaggatccttgtgaagcgtgacgagctcactttggagggtataaagcagttttatgtcaattgtgagagagaggaatggaagctcgacacactttgtgatctgtacgagacattagccattacccagagtgtcatttttgtcaacaccagaaggaaggtcgattggttgactgacaagatgcgaagccgagaccacacggtgtcagccacccacggagacatggaccagaatacgagggacatcattatgcgggaattccgatctgggtcttcccgtgttcttataacaaccgatcttctggcacgtggtattgatgttcagcaagtgtctcttgttataaactatgatctccctacacagcctgagaactatctccaccgtattggtcgtagtggtcggtttggtaggaagggtgttgccatcaactttgtcacgaaggatgatgaaagaatgctgtttgacatccagaagttttataatgtgcaaatcgaggagctgcctgcaaatgttgctgaactcctctgatgagattgtcttccaacatgtctgagaaaagctagtttatgtttggttgtgttatgtaatgtttcttctcccccttccccaacccctctttttttcctcgttcggtatttcctttgaaacccttttttaatgggcctagtaagtttatttagattgtcagtcgtttggatatccaaagtgtaaggtacttgaaattagaaaccgattattgcccattttggtgtatggctgtgtcgcacgtttctgtaaggtaatttatctaatggtactttttgtggcatatgtttggccttttctttaagtatatatattctcggtgtcg

SEQ ID NO: 4743 - DNA, 1566 bp, Solanum tuberosum
cacatattgtcttcctgaactccgcggcgtagatccgaggagtttttggaaaaaagctgcagtctttacaaaccctaattctcaaaaatccccttttcctcaaatcttcagatctctctttaactatcttcttattagctataagtatggcaggctcggcaccagaaggttctcagtttgatgctcgtcaattcgatgcgaaaatgacggagctacttggtactgaacaacaagaatttttcacatcatatgatgaggtttatgacagttttgatgccatgggtttgcaagaaaaccttctgagaggcatctatgcctacggttttgagaagccatcagctattcagcaaaggggcatcgttcccttttgcaagggccttgatgttatccagcaggcacaatctggaactggaaagacagcaactttctgctctggtgttctccagcaacttgattacagtttagttgaatgtcaggctcttgttcttgcaccaacccgtgagcttgcacaacagattgagaaggttatgcgtgcactcggtgactatctgggtgtgaaggttcatgcgtgtgttgggggtaccagtgtccgtgaagatcagcgtatccttcagagtggtgttcatgtagtggttggtactccaggccgtgtctttgacatgttgcgcagacagtctcttcgccccgaccacatcaagatgtttgttttggatgaagctgatgaaatgctctccagaggtttcaaagatcagatttatgatatattccagcttttgccaccaaaaatccaagtgggtgttttctctgccactatgccaccagaggctcttgagattactagaaagttcatgaacaagcctgtgagaattcttgtgaagcgtgatgagctcactcttgaaggtattaagcaattctatgtcaacgtcgataaggaagagtggaagctcgaaacactctgtgatctttacgagaccttggccatcacccagagtgtcatctttgttaacaccaggcgaaaggttgattggctcactgataaaatgcgtggccgtgatcacacagtatctgcaactcacggagacatggatcagaacactagagatatcattatgagggagttccgatctggctcatctcgtgtgcttatcacaaccgatctccttgctcgtggtattgatgtccaacaagtctctcttgttattaactatgacctgccaactcaaccagaaaactacctgcatcgtattggtcgtagtggacgatttggaaggaagggtgttgcaatcaactttgttaccaaggatgacgaaaggatgcttttcgacattcaaaagttttacaacgtcgtaattgaggagctcccagccaatgttgctgatctcctttgaggtgattttggctctgtgaggggaattgttccttccctactggaagttgtctaatatatttattcaaagtgaacaactgcaaattttgtctggtttttgttattttgtttttggaagtgtccaaataactttgggtttggttgtttgaattttgtttatttgaactatttttctatgg

SEQ ID NO: 4744 - DNA, 1636 bp, Solanum tuberosum
ctctctcacacatattgtcttcctgaactccgcggcgtagatccgaggagttttaggaaaaaagctgcagtctttacaaaccctaattctcaaaaatcccctttttctcaaatcttcagatctctctttaacaatcttcttattagctataagtatggcaggctcggcaccagaaggttctcagtttgatgctcgtcaattcgatgcgaaaatgacggagctacttggtactgaacaacaagaatttttcacatcatatgatgaggtttatgacagttttgatgccatgggtttgcaagaaaaccttctgagaggcatctatgcctatggttttgagaagccatcagctattcagcaaaggggcatcgttcccttttgcaagggccttgatgttatccagcaggcacaatctggaactggaaagacagcaactttctgctctggagttctccagcaacttgattacagtttagttgaatgtcaggctcttgttcttgcaccaacccgtgagctggcacaacagattgagaaggttatgcgtgcactcggtgactatctgggcgtgaaggttcatgcgtgtgttgggggtaccagtgtccgtgaagatcagcgtatccttcagagtggtgttcatgtagtggttggtactccaggccgtgtctttgacatgttgcgcagacagtctcttcgccccgaccacatcaagatgtttgttttggatgaagctgatgaaatgctctccagaggtttcaaggatcagatttatgatatattccagcttttgccaccaaaaatccaagtgggtgttttctctgccactatgccaccagaggctcttgagattactagaaagttcatgaacaagcctgtgagaattcttgtgaagcgtgatgagctcactcttgaaggtattaagcaattctatgtcaacgtcgataaggaagagtggaagctcgaaacactctgtgatctttacgagaccttggccatcacccagagtgtcatctttgttaacaccaggcgaaaggttgattggctcactgataaaatgcgtggccgtgatcacacagtatctgcaactcacggagacatggatcagaacactagagatatcattatgagggagttccgatctggctcatctcgtgtgcttatcacaaccgatctccttgctcgtggtattgatgtccaacaagtctctcttgttattaactatgacctgccaactcaaccagaaaactacctgcatcgtattggtcgtagtggacgatttggaaggaagggtgttgcaatcaactttgttaccaaggatgacgaaaggatgctttttgacatacagaagttttacaacgtcgtaattgaggagctcccagccaatgttgctgatctcctttgaggtgattttggctctgtgagggggaattgttccttcccaactggaagtagtctaatatatttattcagagtgaacaactgcaaattttgtctggtttttgttattttgtttttggaagtgtccaaataactttggatttggttgtttgaattttgtttatttgaactatttttctatggacattaggcttttagttctattttctaatggtggtgctatatttatgccccactagttctt

SEQ ID NO: 4745 - DNA, 1886 bp, Prunus persica
caaaactttctctctctctctgtctctctctcgctcattccttaactccgcggcttagatccgaggagtttgggaaaccctaattttctgaaaacaagccaaagctctcttcggtcgctctctcttcgctttcaccttctcaccgatcatcggcagtcatggcagctccagaaggatcacaatttgatactcgtcagtatgattccaaaatgactgagctacttgcaactgatgggcaggaattctttacatcatatgatgaagtttatgatagttttgattctatgggtctgcaagagaatcttctgaggggcatttatgcttacggttttgaaaaaccctcagctattcagcaaaggggaattgttccattctgcaagggtcttgatgttattcaacaggctcagtctggaactgggaagacagcgactttctgttctggtattcttcaacagcttgattatggtttgacagaatgccaggccttggttcttgccccaactcgagagcttgctcaacagattgagaaggtcatgagggctctgggagactatctgggtgtgagggtccatgcttgtgttggtggaaccagtgttcgtgaagaccagcgcattctgtcaaacggggttcatgttgttgtgggcactcctggtcgtgtttttgacatgctaaggagacagtcgcttcgtcctgataacatcaaaatgtttgttttggatgaggctgatgagatgctttcccgaggtttcaaggatcagatctatgatatatttcagcttctgccatcaaagattcaagttggggtgttctctgccacaatgccacccgaggcccttgagatcacaaggaagttcatgaacaaacctgtgaggattcttgtgaagcgtgatgaactcaccctggagggtataaagcaattttatgtcaatgttgacaaggaggaatggaagcttgagactctttgtgatctttatgaaactttggccattacccagagtgtcattttcgtcaatactcgacgcaaggttgattggttgactgacaaaatgcggagccgagaccatacagtttctgccacccatggagacatggaccagaacaccagagacatcatcatgcgggagttccgttctgggtcatctcgtgtcttgatcaccactgatcttctggctcgtggtattgacgttcagcaagtctcccttgttataaactatgacctgcctacccagccagagaactacctccacagaattgggcgtagtggacgattcggcaggaagggtgttgccatcaactttgtaacaaaggatgatgagaggatgctgtttgacatccagaagttctataacgtgcttgtggaggagctgccatcgaatgttgctgatctcctctgatgagattttgtcctctttagaaaattaccaaggaaaagctggtttctgcttagtagtaagtgttgttttgtttgaagtttatttttctgtttttcgtcgttccagccgccacatccaccattttgtgtcttctcctttattattattattaccttatcattattataggtctagttcttttataatttatggttgttggatactattttaagtggtacaagtgcacttgcaatgtgaaaaccatcattgccttgatcggttgtggtagcaactgttgttgcataacatatcttctagctactaatatgtatgtattttttgagttgaactttggtttttttgatgttttaattttggttttgatggctgttgtgattcgatgattgtaatggatggtcaaacgctagttttgtagaattgttggcaaccgaagcaactttctccaaatatcttgtagagatacacacaagttgctattgccttaattatgta

SEQ ID NO: 4746 - DNA, 1580 bp, Glycine max
accctttcgaatataacactccctcttcctccctattcgcctccctttaactccacggtgcagatccgaggagttaccctttcttttcttttttcttttttctctttcctcattctacttaaaactcccaccagtgatggcaggtttggctccagagggaacacaattcgatggtcgccaatatgatgctaagatgagtgaattgctttccactgatgggcaagaattcttcacctcttatgatgaagtgtatgacagctttgatgcaatgggattgcaagagaatcttctgcgaggcatatatgcttatggttttgagaggccttctgctatacagcaaaggggaattgttcctttctgcaaaggactggatgtgattcaacaggctcagtctggaacaggaaagacagcaacattttgttctggaattttgcagcagcttgattatggattggttcagtgccaggctttggttttggcaccaacaagggagctagcacagcagatcgagaaagttatgcgagctcttggtgattacttgggagttaaggtccatgcttgtgttggtgggacaagtgttcgtgaggatcagcgcattctccaagctggtgtccatactgttgttggcactcctgggcgagtgtttgacatgctgcggaggcagtctcttcgcccagattgcataaagatgtttgttttggatgaggctgatgaaatgctttcacgtggtttcaaggatcagatctatgacatcttccagctgctgccatccaaaattcaggttggagtgttctctgctacaatgccgccagaagcccttgaaattacaaggaagttcatgaataagccagtgagaatcctggtaaagcgtgatgaactgaccctggagggtataaagcagttttatgtcaatgttgacaaggaagagtggaagctggagacattatgtgacctttatgagactctggctatcactcagagtgtcatttttgtgaataccaggcgcaaggtggactggctcactgacaagatgcgaagcaatgaccacacagtctctgccacccatggtgacatggaccaaaacacacgtgatattatcatgcgtgaattccggtccggctcttctcgagttctcattaccacggaccttctggcccgtggtatcgatgtgcagcaagtgtctctggtcataaactatgatctgccaacccaacctgaaaactatctccaccgcataggacgtagtggtcgatttggaagaaaaggagttgctataaactttgtcacgacagatgattccaggatgctgtctgatattcagaagttctacaatgtgactgtagaggagctgccatcaaatgttgctgatttactctgatgagttaatgtttgttctctgttaagtcatcaggttcttattctatttggcaagtattatttgtgctcattttctctctatatattttacccattagagatcaaagacatgtgatctgatgctatttgtattggattctataaattttgtttaatcaattaattagcaggttgctgctcaagcctgcatttactttcttgtc

SEQ ID NO: 4747 - DNA, 1576 bp, Glycine max
aatacaatacgacaacaacataaaacaaacataacaaaaacctaaattcactcattcactcctacgattctcttccgcctcccttcccttcgactccacggcgcagatccgaggagtttgggaaaccctaattcattcctctttgcttctatctctattaccctaacaccagtcatggcaggtttggctccagaaggatcgcagtttgatgctcggcaatatgactctaagatgaatgaattgctttccgctgatggacaagaatttttcacttcatatgatgaagtctatgatagttttgatgcaatgggccttcaagaaaatcttctcagaggcatatatgcttatggttttgagaggccttctgcaatacagcaaaggggaattgttcctttctgcaagggtctggatgtgattcagcaggctcagtctggaactggaaagacagcaacattctgttcggggattttgcaacagcttgactatggattggtacagtgtcaggctttggttttggcaccaacaagggagcttgcacaacagattgagaaggttatgcgagctctaggtgattaccttggtgtcaaggttcatgcttgtgttggtgggaccagtgttcgtgaggatcagcgcattctccaagctggtgtccatactgttgttggcactcctggacgtgtgtttgacatgctacgaagacaatctcttcgcccagatcacataaaaatgtttgttttggatgaggctgatgaaatgctttcacgtggtttcaaggaccagatctatgacatcttccagctactgccaggtcaaattcaggttggagtgttctctgctacaatgccacctgaggccctggagattacaaggaagttcatgaataagccagtgagaatcctggtaaagcgtgatgaattgacgcttgagggtatcaagcagttttatgtgaatgttgataaggaagattggaaactggagacattatgcgacctttatgagactttggctatcactcagagtgtcatctttgtgaacaccaggcgcaaggtggactggctcactgacaagatgcgaagcaatgaccatacagtctcagccacccatggagacatggaccaaaacactcgcgatatcatcatgcgtgaatttcgctctggctcttctcgagttctaattaccactgacctcttggctcgtggtatagatgtacagcaagtgtctttggttataaactatgatcttcctacccaacctgaaaattatcttcatcgcataggacgaagtgggcgttttggaagaaaaggtgttgccataaactttgtgactttggatgatgcaagaatgctgtctgatattcagaagttctacaatgtgactgtagaggagttgccatcaaatgtggctgatctgctctgatgggttaatttttattctttgttaagtcatcagagctattactttttgacaattattattttgtgctctttattttctttttcaatttttaccgttagagttcaaagacaccttactttatttataatggattctataaaatttgtttatttgcttaatt

SEQ ID NO: 4748 - DNA, 1711 bp, Glycine max
acaacataaacataacaaaaacctaaactcactcagtcctacgatacgattctcttccgcctcccttcccttcaactccacggcgcagatccgaggagtttgggaaaccctaattcattcctctttgcttcttctatctctattcctctaacaccagtgatggcaggtttggctccagaaggatcgcagtttgatgctcggcaatatgattctaagatgaatgaattgctttccgccgatggacaagaatttttcacttcatatgacgaagtctatgatagttttgatgcaatgggccttcaagaaaatcttctgagaggcatatatgcttatggttttgagaggccttctgcaatccagcagaggggaattgttcctttctgcaagggtctggatgtgattcagcaggctcagtctggaactggaaagacagcaacgttctgttcaggaattttgcagcagcttgactatggattggttcagtgtcaggctttggttttggcaccaacaagggagcttgcacagcagattgagaaggttatgcgagctctaggtgattaccttggtgtcaaggttcatgcttgtgttggtgggaccagtgttcgtgaggatcagcgcattctccaagctggtgtccatactgttgttggcactcctgggcgtgtatttgacatgctacggagacagtctcttcgtccagatcacataaagatgtttgttttggatgaggctgatgaaatgctttctcgtggtttcaaggaccagatctatgacatcttccagcttctgccgggtcaaattcaggttggagtgttctctgctacaatgccacctgaggccttggagattacgaggaagttcatgaataagccagtgagaatcctggtaaagcgtgatgaattgacccttgagggtatcaaacagttttatgtgaatgttgataaggaagactggaaactagagacattatgtgacctttatgagactttggctatcacccagagtgtcatctttgtgaacacaaggcgtaaggtggactggctcactgacaagatgcgaagcaatgaccatacagtctcagccacccatggagacatggaccaaaacactcgtgacatcatcatgcgggaatttcgctctggctcttctcgagttctaattaccactgacctcttggctcgtggtatagatgtacagcaggtgtctttggttataaactatgatctgccaacccaacctgaaaattatcttcatcgcataggacgaagtgggcgttttggaagaaaaggtgttgccataaactttgtgactttggatgatgcaagaatgctgtctgatattcaaaagttctacaatgtgactgtagaggagttgccatcaaatgttgctgatctgctctgatgggttaattttcattctttgttaagtcatcagagggctattactttttgccaattattattttgtgctctttgtttttctttttcaaattttagcattagagttccaatacacctgactttatttttataatggattctataaaatttgtttatttgcttaattgttgttcaagcctttttgtttataattttgtgtttatgtattttgtatttgaacaatgccttcatcaactcttgtatctacggttactaggggtgtttgtggggtggttgagactgattttggttaaatttaaaactcaattcaa

SEQ ID NO: 4749 - DNA, 1667 bp, Nicotiana tabacum
ctgaactcctgcggcgtagatccgaggagtttcagacaaaaccctaaccccccaatcgcttttacccacttttcatttcactctctctttcctattcctcagatcttttcctcatctctatcagtcatggctggcttggcaccggaaggttctcagtttgatgctcgtcagtatgatgccaaaatgactgagctgcttgggactgaacaggaggagttcttcacatcatatgatgaggtttatgacagttttgatgccatgggtttgcaagaaaacctgcttaggggcatctatgcttatggttttgagaagccatctgctatccagcaaaggggtattgtcccattttgcaagggtcttgatgtgatccaacaggcacaatccggaaccggaaagactgcaactttctgctctggagttctccagcagcttgattacagcttagtcgaatgtcaggctctggttctggctccaacccgtgagcttgcccaacagattgagaaggttatgcgagcacttggtgactatctcggtgtgaaggttcatgcttgtgtaggaggtaccagtgtccgtgaagatcagcgtatccttcaaagtggtgttcatgtggtggttggtactcctggccgtgtctttgacatgttgcgcaggcagtctcttcgccctgaccacatcaagatgtttgttctggatgaagctgatgaaatgctctcaagaggtttcaaggatcagatttatgatattttccaattgctaccaccaaagattcaagtgggtgttttctctgccactatgccgccagaggcccttgaaattactaggaagttcatgaacaagcctgtgaggattcttgtaaagcgtgatgagcttacgcttgaaggtatcaagcaattttatgtcaatgttgataaggaagagtggaagcttgaaactctttgcgatctttacgagaccttagccatcacccagagtgtcatctttgttaacaccaggcgtaaggttgattggctcactgacaaaatgcgcagccgtgatcacacagtatctgcaactcacggagacatggaccagaatactagagatatcattatgcgagagttccgatctgggtcgtctcgtgtgctcatcaccactgatcttctggcgcgtggtattgacgtgcagcaagtttcccttgtgattaactacgaccttccaactcagccagagaactatctgcatcgtattggtcgtagtggacgttttggaaggaagggtgttgctatcaactttgtcacaaaggatgatgaaaggatgctttctgacattcagaagttttataatgttgtcatcgaggagttgccagccaatgtggccgatctcctttgaggttgttttggttatgtgaggtgaattcttccttacatgaagtaatttaatatcttattcttaggttagttagaattctaccgggtttagaattgggaaatgcaggtgccatgattcaccatggaacctgtaaatcttcaactttggttggactatctactatcaattttatcggtttgccttttgtattgtaagtctacaataacttcagtttttggatgttctttgaaattttattgagatttaactcttgaccttgttattgtgtatgaggaaagcttttagaggcaaattgtttg

SEQ ID NO: 4750 - DNA, 1635 bp, Solanum phureja
ctctctcacacatattgtcttcctgaactccgcggcgtagatccgaggagtttttggaaaaaagctgcagtctttacaaaccctaattctcaaaaatcccctttttctcaaatcttcagatctctctttaacaatcttcttattagctataagtatggcaggctcagcaccagaaggttctcagtttgatgctcgtcaattcgatgcgaaaatgacggagctacttggtactgaacaacaagaatttttcacatcatatgatgaggtttatgacagttttgatgccatgggtttgcaagaaaaccttctgagaggcatctatgcctatggttttgagaagccatcagctattcagcaaaggggcatcgttcccttttgcaagggccttgatgttatccagcaggcacaatctggaactggaaagacagcaactttctgctctggagttctccagcaacttgattatagtttagttgaatgtcaggctcttgttcttgcaccaacccgtgagctggcacaacagattgagaaggttatgcgtgcactcggtgactatctgggcgtgaaggttcatgcgtgtgttgggggtaccagtgtccgtgaagatcagcgtatccttcagagtggtgttcatgtagtggttggtactccaggccgtgtctttgacatgttgcgcagacagtctcttcgccccgaccacatcaagatgtttgttttggatgaagctgatgaaatgctctccagaggtttcaaggatcagatttatgatatattccagcttttgccaccaaaaatccaagtgggtgttttctctgccactatgccgccagaggctcttgagattactagaaagttcatgaacaagcctgtgagaattcttgtgaagcgtgatgagctcactcttgaaggtattaagcaattctatgtcaacgtcgataaggaagagtggaagctcgaaacactctgtgatctttacgagaccttggccatcacccagagtgtcatctttgttaacaccaggcgaaaggttgattggctcactgataaaatgcgtggccgtgatcacacagtatctgcaactcacggagacatggatcagaacactagagatatcattatgagggagttccgatctggctcatctcgtgtgcttatcacaaccgatctccttgctcgtggtattgatgtccaacaagtctcccttgttattaactacgacctgcctactcaaccagaaaactacctgcatcgtattggtcgtagtggacgatttggaaggaagggtgttgctatcaactttgttaccaaggatgacgaaaggatgctttttgacattcaaaagttttacaacgttgtagttgaggagctcccagccaatgttgctgatctcctttgaggtgattttggctctgtgaggggaattgttccttccctactggaagtagtctaatatatttattcagagtgaacaactgcaaattttgtctggtttttgttattttgtttttggaagtgtccaaataactttggatttggttgtttgaattttgtttatttgaactatttttctatggacgttaggcttttagttctattttctaatgttggtgctatatttattccccactatttctt

SEQ ID NO: 4751 - DNA, 1713 bp, Malus domestica
ctctctctctcgctttctccctcgcgcaatcctcaactccgcggcttagatccgaggagtttgggaaaccctaatttccagaaaaccagcacaaagctctcttccgacgctctctctctctctctctcctcgccttcaactttctcactcatcgctcgcagtcatggcagcagcacctgaaggatcgcaatttgacactcgtcagtatgataccaaaatgagtgaaatacttgcaactgatgggcaggaattctttacatcgtatgatgaagtttatgatagttttgatgctatgggtcttcaagagaatcttctgaggggaatctatgcttacggttttgaaaagccctcggctattcagcaaagaggaattgttcccttctgcaagggtcttgatgtgattcaacaggctcagtctggaactggaaagacagcaactttctgttctggtattcttcaacagcttgattatagtttgacggaatgccaagccttggttcttgcacccactcgagagcttgctcaacagattgagaaggttatgagggctcttggagattatctaggtgtgagggtgcatgcttgtgttggtggaactagtgtccgtgaggaccaacgcattctgtcaaatggagttcatgttgttgttggaactccaggtcgtgtttttgacatgcttagaaggcagtcacttcgtcctgatagcatcaagatgtttgttttggatgaggctgatgaaatgctttcccgtggtttcaaggatcagatctacgacatatttcagcttcttccatcaaagattcaggttggtgtgttctctgccacaatgccacctgaggccctcgagatcacaaggaagttcatgaacaaacccgtgaggattcttgtgaagcgtgatgaactcaccctggaaggtataaagcaattctatgtcaatgtcgacaaggaggaatggaagcttgagactctttgtgatctgtatgagaccttggctattacccagagtgtcatttttgttaatactcgacgcaaggttgactggttgactgacaagatgaggagccgagaccatacagtttctgccacccatggagacatggaccagaacaccagagacatcatcatgcgagagtttcgttctggatcatctcgtgtcttgatcaccactgatcttttggctcgtggtattgatgttcagcaagtctccctagttattaactatgatctgcccacccagcccgagaactaccttcacagaattggtcgtagtggacgttttggaaggaagggtgttgcaatcaacttcgtaacaaaggatgatgagaggatgctgtttgacatccagaagttctacaacgtggttgtggaggagctgccatcaaacgtcgcggatcttctgtgaagagattttgtcttcttaattacccaaggaaaaagccggtatctgcgtagtaagtgttgctttgtattgaagtttattttctgtttttcgtcctttgagccctccacatccccccaccattttgtgtcgtctcttatattatttaggatctagttacttaatttatggttgttggattaatatttaagtggtacaagttaaaaagtgcaatgtgaaaaccatcgttgcctgaattgtttgtggtggccactctgttgttgcatactttctaccaactaatgttattaatgtatgtattcttttgaggtatg

SEQ ID NO: 4752 - DNA, 1677 bp, Artemisia annua
aaaaaaacacattcagtctcctctcttcttcagtttttatatttattatttttcctcaactccacggcctacatccgaggagtttgagaaaaccctttaaaaaacaatcttactacttttctcttaatctctctaatcaatcatcagtcatggcggccgcaccagaaagttctcagtttgatactcgtcagtttgactccaaaatgaatgagctgctctcaaccgacgggcaggacttctttacatcttatgacgaggtttatgatagttttgatgctatgggtctacaagaaaaccttttgagaggcatctatgcttatggttttgagaagccatctgcaattcaacaaaggggtatcgttcccttcaccaagggtcttgatgttattcaacaagctcagtccggaaccggaaagactgctaccttttgctctggtatccttcaacagctcgactacagcgttgtggagtgtcaagcgttggttttggctcctactcgtgagcttgcacagcaaattgagaaggttatgcgagcacttggtgactaccttggtgtgaaggtacatgcttgtgttggtggaaccagtgttcgtgaggaccaacgtatcctctcagctggtgttcatgttgttgttggtacccccggtcgtgtctttgacatgctccgaaggcagtctcttcgttctgattacatcaagatgtttgtgcttgatgaggctgatgaaatgctttcaagaggtttcaaggaccagatttacgatatattccagctgttgccttcgaaggttcaggttggagtgttctctgctactatgcctcctgaggctctcgagatcacaagaaagttcatgaacaaacctgtaaggattcttgtgaagcgtgatgaactcactcttgaaggtattaagcagttttatgtcaatgtcgaaaaagaagaatggaagcttgagaccctttgtgatctttacgagaccttggccatcacccaaagtgtcatcttcgtgaacacccggcgaaaggtcgattggttgacagacaagatgagaagccgagaccacactgtctcagccactcacggagacatggaccaaaacactagagatatcatcatgcgtgagttccgttctggatcttcacgtgttttgatcaccactgatcttttggctcgtggtattgatgtccaacaagtgtctcttgttatcaactacgatcttccaacccagcctgaaaactacctccatcgtattggtcgaagtggaaggtttgggagaaagggtgttgctattaactttgtgactttggatgatgaaaggatgcttgcagatatccagaaattctacaatgtggttgtcgaggaacttccatcaaatgttgctgatcttatatagaaaaagattttgggtttgtgttgtgttcagtaagaaaggttagaacctgtttttttgatatctatcggttttgtttgttttaagatactactattattgtcagacttggtgctaaaagataattgcaactcgtgcttgtactcttaaagttttatgttaccccgaagtgtatggatttatttatttttatcttctggtacaactgcatttgtgggttaagtttctgttcttatgtatggctggttcccgtaccaacaggaaaatgcttgacgtttcaaaacgcactcgt

SEQ ID NO: 4753 - DNA, 1629 bp, Manihot esculenta
gcagttgttaagttatcgattttcttacttaactacacggtttagatccgaggagtttggggaatcctaattccgaacaagcaaaaacgagcaagcaagcaaggtagctaaaactctcttcttcaagcccatcctctcatcgccgatcatcagtcatggctggactagcaccagaaggatcccagtttgatgcgaaacactatgatgccaaaatgaatgaattactcacaactgaaggagaggaatttttcacatcctatgatgaagtttatgatagttttgattctatgggtttgcaagagaatcttctgaggggcatctatgcttatggttttgaaaagccctcagcaatccagcagcgaggaattgttcccttctgcaaaggacttgatgttattcaacaggctcaatctggaacagggaaaactgcaactttctgttctggtattctccaacaacttgattatggtttggtggagtgccaggccttggtcctggcacccactcgggagcttgcacaacagattgaaaaggttatgcgggcacttggagattatcttggtgtcaaggtacatgcctgtgttggtgggaccagtgtccgtgaagatcaacgcattctttcaagtggagtgcatgttgttgttggcactcctggccgtgtatttgacatgctgcgaagacagtcacttcgtcctgattacatcaggatgtttgtgttggacgaggcagatgaaatgctttcacgtggtttcaaggatcagatttatgatatttttcagcttctgccatcaaaaattcaagttggtgtgttctctgccacaatgccaccggaggctttagagatcacaaggaagtttatgaacaaacctgtgaggattcttgtaaagcgtgatgagctcaccttggagggtataaagcagtttcatgtcaatgtggagaaggaggaatggaagcttgagacactatgtgatctctatgaaaccttagccattacccaaagtgttatttttgtgaacactagacgtaaggttgattggctgacggacaagatgcggagtagagaccacactgtctctgccactcatggtgatatggaccagaacacaagagatatcataatgcgtgaatttcgatctgggtcatctcgtgttctaatcaccactgatcttttggctcgtggcattgatgtccagcaagtgtcccttgttataaattatgatcttcctacccagccagagaactatctccaccgaattggacgtggtggacggttcgggaggaaaggtgttgctatcaattttgtgacaaaggatgatgacaggatgctgtttgacatccagaggttctataatgtggtgatcgaggagctgccatcaaatgttgctgatcttctctaatgaggtttttgtattccattattagtagagagacaaatccctggaatttgttgtgttcttttttaaattcttgttttataggtctagttctagcatctatctaaatttgactgcctatcagtaagtgatatttgattctcaaatcttaaatttagcaatgctgctaaatatggcattgtggatttttgttgcacatgttctgataatggagatatgatggattatcatgctc

SEQ ID NO: 4754 - DNA, 1595 bp, Castanea mollissima
ttcttcgctatcgttcctcaactccgcggcgtagatccgaggagtttgggaaaccctaattacttcacacaacaaaaaccaatactactacccttctcttctacttcacttttcaccgatcaacagtcatggcggcaccagaggggtcacaatttgatgctcgtcagtttgatgccaaaatggacgagttactttcagctgatgctcaggacttcttcacatcatatgatgaggtttatgaaagttttgatgctatgggattgcaagagaatcttctgagggggatttatgcttatgggttcgaaaaaccctctgctattcagcaaaggggaattgtacccttctgtaagggtcttgatgttattcaacaagctcaatctggaactggaaagacagctactttctgctctggtgttttgcaacaacttgactatagtgtgacggaatgccaagctttggtcctggcacccactagagagcttgctcaacagattgagaaggtgatgcgggcacttggagactatcttggtgtaagagtacatgcttgtgttggtggaacaagtgttcgtgaagatcaacgcattctgtctagtggggttcatgttgttgttggcactcctggtcgtgtgtttgatatgctgcgaagacagtcacttcgtcctgattacatcaagatgtttgtattggatgaggctgatgaaatgctttcccggggtttcaaggatcagatctatgatattttccagcttctaccatcaaagattcaggttggggtattctctgccacaatgccacctgaggcccttgagattactaggaagtttatgaacaaacctgttagaattcttgtgaagcgtgatgagctcaccctggagggtataaaacagttttatgttaatgttgataaggaggagtggaaacttgagacactctgtgatctttatgaaaccttggccatcacccagagtgtcattttcgtgaacacgaggcgcaaggttgattggcttacagacaagatgcggagccgtgaccacacagtctcagccacccatggtgatatggaccagaatacaagagacattatcatgcgggaattccgttctggatcatctcgtgtccttataacaactgatcttttggcacgtggtattgatgtccagcaggtctcccttgttattaattatgatctcccaacacagccagagaactatctgcatcgtattgggcgtagtggacggtttggtaggaagggtgttgccatcaactttgtaacaaaggatgatgagaggatgctgtttgacatccagaagttctataatgttgtagttgaggagctgccatcaaatgttgctgatctcctctaaagagattttgttttgtttagtagagaaagacagattctgtttggtaattgtcatttgatatgtttctttgttttcctttgccaagtgttgtcttataggtctagtgtctttattttaagatgttcgagttttggactgttttaagtggtacttgcagtgtagaaaccatctttgcctgacatggtatgatgtttgtatgtgtttttaatataaagcagttgcaattttgtt

SEQ ID NO: 4755 - DNA, 1859 bp, Castanea mollissima
tttttagcctcttcttcttcttcttcttcctctctctctctctgcgtttcattgctttattcccttaactcctccaacctaaagagatccgaggagtttgggaaaagaaaccctaacccttaaaaccccttttaatcaaacaatctctctttctctctcgttatcgctttcagttcaagtcatggctggtgtggcaccagagggatcgcaatttgacgctcgtcaatatgatgctaaaatgagcgaattattgggaactgatgggcaagagttcttcacatcatatgatgaagtttttgagagttttgatgctatggggttgcaagagaacctcctaagaggaatctatgcctatggttttgagaagccctctgcaattcagcaaagggggattgttcctttctgcaagggactcgatgtgattcaacaagcacagtctggaactggaaaaactgctactttttgctctggaattttgcagcagcttgactatggcttggttgaatgccaggcattagttcttgctcccactagagagcttgctcaacagattgagaaggtcatgcgggcccttggtgattatttgggtgtcaaggttcatgcctgtgttggtggaactagtgtccgcgaggatcaaagaattctttctgctggggtccatgttgttgttggtaccccaggtcgtgtgtttgacatgctgcggaggcaatcacttcgccctgattacattaagatgtttgtgttagatgaagcagatgaaatgctttcacgagggttcaaggatcagatctatgatatcttccagctgctgccaccaaaaattcaggttggggttttctctgccacaatgccacctgaggcccttgagatcacaaggaagttcatgaataaacctgtgaggattcttgttaaacgtgatgagctaacccttgagggtatcaagcaattccatgtcaatgttgaaaaggaggaatggaagctcgagactctctgtgatctttatgaaaccttggcaatcactcaaagtgtcatttttgtgaacaccaggcgcaaggttgattggctgacagacaagatgcgcagtcgtgatcatacagtttctgccacccacggagacatggaccaaaacacaagggacatcatcatgcgggaattccggtctgggtcttctcgtgttctcatcactactgatctcttggccaggggtattgatgtccagcaagtttctcttgtgataaattatgatcttccaacacagccagagaactacctccatcgaattggtcgtagtggaaggtttgggaggaagggtgttgccatcaattttgtgaccaaggatgatgagaggatgctctttgacatccagaagttctacaatgtggtgattgaggagctgccagcaaatgttgctgatctcctttgatgtgcttttagctggcatgttcgaaggattctaatctggaagcaatatttattactttatttctcgtaggtctagggctttttataagcatggattgaacttgcctaaaaatggggggttttgggttctctgcatttgagatgggaggccattcccaatttgggcaaagtatccatttttgcaaattttgtcatgagtttgctttgtacttctgatgtcttattaaagtaaaagatttgcagaatcgattgtagctttgtttggtctcatttgagctaagcttggttttccgtgtatgtgtgagaggggatgttatgtagagttgaaacatgatttgattatgttgggatgttatgtagagctgaacttgctctagtgtttctctttgagctgttaacttgctatatctagtctatatctgcgactcttcacttta

SEQ ID NO: 4756 - DNA, 1872 bp, Gossypium hirsutum
  misc_feature (129)..(129): n is a, c, g, or t
  misc_feature (645)..(645): n is a, c, g, or t
  misc_feature (870)..(870): n is a, c, g, or t
  misc_feature (1660)..(1660): n is a, c, g, or t
  misc_feature (1677)..(1677): n is a, c, g, or t
catcaagcgtccgtacaccctcttcctctcccttacttgcccagagacagagatccaaggagtttggggccaaaaccctaacccccaaaacatcaccccagtaagctatctatcgtctctcaatcatcnttattatcagtcatggctgctgcagctccagagggttctcaatttgatgctcgccagtatgatgctaaaatggatgaacttgaagctgtggggcaagatttctttacctcatatgatgaggtttatgacacttttgatgttatgggattgcaagaaaatcttcttaggggcatttatgcttatggttttgagaagccatctgcaattcagcaaagaggaattgtacccttttgcaagggacttgatgtaattcaacaagcacaatccggaacaggaaaaactgcaactttttgctctggaattctacagcagcttgactacagcttagttcagtgccaagcattggtccttgcaccgacccgtgaactagcacaacaaattgagaaggtcatgcgggcattaggtgattaccttggtgtcaaggttcatgcttgtgtaggtgggaccagtgttcgtgaagatcaacgaattctctccagtggggttcacgtggttgttggtacacctggccgtgtntttgacatgttgaggcgacaatctctccgccctgatcatataaaaatgtttgttttggatgaagctgatgaaatgctctcaagaggcttcaaggatcagatctatgatattttccagttattgccacctaaaattcaagtaggagtgttttctgctacaatgcctcctgaagccctagaaatcacaaggaagttcatgaacaaacctgtgaggattctggtgaancgtgatgagcttacccttgagggtatcaagcaattttatgtcaatgttgagaaggaggaatggaagcttgagacactttgtgatctctatgagaccttagcaatcacccaaagtgtcatttttgtgaacactaggcgtaaggttgattggcttacagataagatgcgtagccgtgaccatacagtgtctgctacccatggagatatggaccaaaatgcaagggacattatcatgcgggaattccgatctggatcctctcgcgtgcttatcaccactgatctcttagctcgtggtattgacgttcagcaagtctcacttgtgatcaattatgatctcccaacacaaccagagaactaccttcatcgaattggtcgtagtggaagatttgggagaaaaggtgttgccatcaactttgtaaccacagatgatgagaggatgctatatgacatccagaggttttataatgttgtaattgaggagctgccatcaaatgttgctgatctaatttgattctggttcaggctggctaggtaaatggctctctgggaatgacaaagcttaggaggtccagttacaactgggagggatttcgttcctgcacatttagttgagctcccattaccatataaaaaacccaatgttcaaattttgatttggtgtgtgtctaagcaagaaatgtctgtagtattgttctagtttattctaaatcatgttgttttatctatgttcttatttctttccatctgtagtttctgtatgtgagacttgaggggagattatgtagaatggnaacgtgattattttagntcattggacttgcctttatggtaagtttttcgtctcccctatctttctatttcaatagcatatttttgtttgagaatttggatctgatcaggaaagtagtgacagtagattaatgtaaacctctttaggtggcttctagtcatctaggcattgttgcccattttatttatcattctttaaagtttcagctgtcga

SEQ ID NO: 4757 - DNA, 1408 bp, Lactuca sativa
cggggggttcatactcatctcaaaacacacaacccttttctttcactcgcactcaaattccctcaactccacggccacccgaggagtttgagaaaaccctaaaaagcctcctcaaaaatctctcaactttttctctaaatctttccaccaatctgcaaatcagtcatggcaggagcagcaccagaaggttcccagtttaatgctcagcaatttgattccaaaatgaatgaattgctttcaaccgatggacaagactttttcacctcatacgatgaagtttatgatagttttgatgccatgggtttgcaagaaaacctcttgagaggcatctatgcatatggttttgaaaaaccatctgcaattcaacaaaggggaatagtcccattctgcaagggtcttgatgtgatccaacaagctcaatcaggaacaggaaagactgcaactttttgctctggaatccttcaacagcttgactacaatgtagtcgagtgtcaagctttggttcttgcacccactcgtgaacttgctcaacaaattgaaaaagtcatgcgggccctaggggactaccttggagtcaaagtccacgcgtgcgtgggtgggaccagtgtccgtgaggatcaaaggatcctctctgctggggtccacgtggttgttggtacacctggacgtgtctttgacatgctcaggaggcagtcactacgtgccgattacatcaagatgtttgtcttggatgaagctgatgaaatgctctcaagaggtttcaaagatcagatttatgatatcttccagttgttgccatcgaaagtccaagtgggtgtgttctccgctacaatgccaccagaagctttagaaatcacccggaaattcatgaacaaacccgtgagaattctcgtgaaaagagacgaacttaccctcgaaggtatcaaacagttttacgtgaacgttgaaaaggaagaatggaaactcgaaacactctgtgacctttacgaaaccctagcaatcacccagagtgtcattttcgtaaatacgcgtcgaaaggttgactggttgaccgacaaaatgcgttcccgggaccacactgtgtccgccacccacggtgacatggaccaaaacacgcgtgacatcatcatgcgggagtttcgatcgggatcttcacgtgtgttgatcactacagatcttttggcacgtgggattgatgtgcaacaggtgtcacttgttatcaattatgatcttccaacacagcctgagaattatcttcataggattgggcgaagtgggaggtttgggagaaagggtgtggccattaattttgtcactttggatgatgaacggatgcttggggatattcagaagttttataatgttgtgggtgaggagttgccttccaatggtgcggatctcatataag

SEQ ID NO: 4758 - DNA, 1593 bp, Lotus japonicus
tgtcaaaagcaggcggcacggtccggaatcctcgagcatgcttgtaagtgggggcttcctcaactccacggcgcagatccgaggagttttctcttcgctattccctgcttccttctccgattccctattccgctaccaaccttcaacgctccctcagtgatggcaggtgttgctcccgaaggatctcaatttgatgctcgccagtatgacgctaagatgagtgatttgctttcttctgatgggcaagatttcttcacctcatatgatgaagtctatgatagctttgacgcaatgggattgcaagaaaatcttctgagaggcatttatgcttatggttttgagaggccttctgcaatccagcaaaggggaattgttcctttctgcaaaggtctggatgtgattcagcaggctcagtctggaactgggaagactgcaacattctgttctggaattttgcagcagcttgattatggattggttcagtgccaggctttggttttggcaccaacaagggagctggcacaacagattgagaaggtcatgcgagcacttggtgattaccttggtgttaaggttcatgcttgtgttggtgggacaagtgttcgtgaggatcagcgcattctccaagctggtgtccacacagttgttggcactccagggcgtgtgtttgacatgctgcggaggcagtctcttcgccctgatagcataaagatgtttgttttggatgaggctgatgaaatgctttcacgtggtttcaaggatcagatctatgacatcttccagctgctgccaggcaaaattcaggttggagtgttctctgctacgatgccacctgaagcacttgagattaccaggaagttcatgaacaagccagtgagaatcctggtaaagcgtgacgaactgaccctggagggtatcaagcagttctatgtcaatgttgagaaggaggagtggaagctggagacactatgcgacctctatgagaccttagctatcacccagagtgtcatctttgtgaacaccaggcgcaaggtggactggctcactgacaagatgcggagcaatgatcacaccgtctcagccacccacggtgacatggaccagaacaccagggacatcatcatgcgtgaattccggtccggctcctctcgagttctcatcaccactgacctcctggcccgtggtattgacgtgcagcaagtgtctctagtcataaactatgacctcccaactcagcctgaaaactatctccatcgtattggtaggagtgggcgtttcggaagaaaaggtgttgctataaactttgtgacattggatgattccaggatgctgtctgatattcagaagttctacaatgtgactgtggaggagctgccatccaatgttgctgatctgctctgatgagttaaatttttgctctctgttaagtcatcggggatttttctgctggaccagtgctattttaagttattcaggtcttctttttaatatattttactcatgagattaaagacatccatctgatgctatttgtagtggattctttaaaatttgtttgattagttatcaggattctgtttaagcctgcatgta

SEQ ID NO: 4759 - DNA, 1792 bp, Medicago truncatula
ataatctttggctattgtgacacagttctcactcactcgctttttcacaacgcaaaaacaaaaacgctctttgctctctctctttcctcaactccgcggcttagatctgaggagttttggaaaccctaataaccgttctcttcaacaacatcgttttatctctcaccgatcatcaactttttcatcatctcttaagtcatggcaggcgttgcaccagagggttcacagtttgatgctaagcagtttgattcaaaaatgaacgagttgctcacaaccgatgcacaggacttcttcacatcttatgatgaggtctatgatagttttgatgctatgggcttgcaagagaatcttctcagaggcatttacgcatatggttttgagaagccatcagctattcagcaacggggaatagttccatttatcaagggtcttgatgttatacaacaggctcagtctggaacagggaagactgcaaccttctgctctgggattttgcagcaacttgactacagtgtgacagaatgtcaagccttggtcttagcgcctactcgtgagcttgctcagcagattgagaaggtcatgcgcgctcttggagattatctaggtgttaaggtgcatgcttgtgtcggaggaaccagtgttcgtgaagatcagcgcattctatcaagcggtgttcatgttgttgttggtacccctggacgtgtatttgacatgctgcggagacagtcacttcggccagattacatcaaaatgtttgtactggatgaggctgatgagatgctttctcgtggttttaaagatcagatctatgatatattccagctgttgccatctaagattcaagtcggagttttctctgctacaatgcctcctgaggcacttgagatcacaaggaagttcatgaacaaacctgtgaggattcttgtgaagcgtgatgagctcaccttggagggtatcaagcagttctatgtcaatgttgataaggaggaatggaagcttgacacactctgtgatctttacgagactttggctatcactcagagtgtcatatttgtgaacaccagacgaaaggttgactggctgacagacaagatgagaagccgtgaccacacagtctcggcaactcacggagatatggaccagaacactagggacattatcatgcgtgaattccgttctggatcttcccgtgttttaataactactgatcttcttgctcgtggtattgatgttcagcaagtgtctttagttataaattatgatctcccaacacagcctgagaactatctgcatcgtattggtcgtagtggaaggtttggaaggaaaggtgttgctattaactttgtcacaactgatgacgaaagaatgctgagtgacatccagaagttctacaatgtgttgattgaggagctgccttccaatgttgctgaacttctgtgatgaaattttttcttccatcattacttagagggaagttggtttctgaggtaagtggtatgtaatgtttctcccctttttgccccatttgttgtatttctgttttaaaaccttgtttggcctttttaataggtgtagtaatttattttacattttccgtctgaacatcctaagtgataagtacttgcaatgtggaatgcattattgtctggaatggcttgttgattgttgttgcacctttttaacaagcaagtttttgaatttatcttgagttctaatatatatgctgaagtagtttgattgtatcgctggcacccccattttggtgactctattcggtcaaaggttacataag

SEQ ID NO: 4760 - DNA, 1782 bp, Medicago truncatula
gcacgagtgacacagttctcactcactcgctttttcacaacgcaaaaacaaaaacgctctttgctctctctctttcctcaactccgcggcttagatctgaggagttttggaaaccctaataaccgttctcttcaacaacatcgttttatctctcaccgatcatcaactttttcatcatctcttaagtcatggcaggcgttgcaccagagggttcacagtttgatgctaagcagtttgattcaaaaatgaacgagttgctcacaaccgatgcacaggacttcttcacatcttatgatgaggtctatgatagttttgatgctatgggcttgcaagagaatcttctcagaggcatttacgcatatggttttgagaagccatcagctattcagcaacggggaatagttccatttatcaagggtcttgatgttatacaacaggctcagtctggaacagggaagactgcaaccttctgctctgggattttgcagcaacttgactacagtgtgacagaatgtcaagccttggtcttagcgcctactcgtgagcttgctcagcagattgagaaggtcatgcgcgctcttggagattatctaggtgttaaggtgcatgcttgtgtcggaggaaccagtgttcgtgaagatcagcgcattctatcaagcggtgttcatgttgttgttggtacccctggacgtgtatttgacatgctgcggagacagtcacttcggccagattacatcaaaatgtttgtactggatgaggctgatgagatgctttctcgtggttttaaagatcagatctatgatatattccagctgttgccatctaagattcaagtcggagttttctctgctacaatgcctcctgaggcacttgagatcacaaggaagttcatgaacaaacctgtgaggattcttgtgaagcgtgatgagctcaccttggagggtatcaagcagttctatgtcaatgttgataaggaggaatggaagcttgacacactctgtgatctttacgagactttggctatcactcagagtgtcatatttgtgaacaccagacgaaaggttgactggctgacagacaagatgagaagccgtgaccacacagtctcggcaactcacggagatatggaccagaacactagggacattatcatgcgtgaattccgttctggatcttcccgtgttttaataactactgatcttcttgctcgtggtattgatgttcagcaagtgtctttagttataaattatgatctcccaacacagcctgagaactatctgcatcgtattggtcgtagtggaaggtttggaaggaaaggtgttgctattaactttgtcacaactgatgacgaaagaatgctgagtgacatccagaagttctacaatgtgttgattgaggagctgccttccaatgttgctgaacttctgtgatgaaattttttcttccatcattacttagagggaagttggtttctgaggtaagtggtatgtaatgtttctcccctttttgccccatttgttgtatttctgttttaaaaccttgtttggcctttttaataggtgtagtaatttattttacattttccgtctgaacatcctaagtgataagtacttgcaatgtggaatgcattattgtctggaatggcttgttgattgttgttgcacctttttaacaagcaagtttttgaatttatcttgagttctaatatatatgctgaagtagtttgattgtatcgctggcacccccattttggtgactctattcggtcaaaggttacataag

SEQ ID NO: 4761 - DNA, 1559 bp, Cucumis melo
  misc_feature (448)..(448): n is a, c, g, or t
  misc_feature (598)..(598): n is a, c, g, or t
  misc_feature (668)..(668): n is a, c, g, or t
  misc_feature (959)..(959): n is a, c, g, or t
ctctttcgctcgcttcgctttgcccaaacactcgcctccaactccacggatcagatccgaagagtttggcaaaccctagcttcctctcttcaatctccatctttttcttctctaacaatccacagctatggcaggtttagctccagaaggaacccaatttgattctcgccaatacgatgctaaaatgaatgagattctttcagccgaagggcaggaattttttacctcatatgatgaagtttatgaaagttttgattcgatggggctgcaagagaacctcctcagaggcatttatgcctatggttttgagaaaccatctgcaattcagcaaagaggtatagttcccttctgcaagggccttgatgtgattcagcaggctcaatctggaactggaaaaactgcaactttctgctctgggatacttcagcaactagattatggtctggtncagtgccaggcattagttttggcaccgactagggagctggctcaacaaattgagaaggttatgagagctcttggagattatcttggagttaaggttcatgcctgtgtgggaggaacaagcgtccgggaggatcaacgcattcttcaagcnggtgttcatgtagtagttggaacacctggtcgtgtgtttgacatgttgaggaggcagtctcttcgcccanattgtattaagatgtttgtattggatgaagctgatgaaatgctttcccgaggtttcaaagatcagatctatgatattttccagctgttgccatcaaaaattcaagttggggtgttctcagccacagtgccaccagaagcattggagatcactagaaagttcatgaacaagcctgtcagaatcttggtaaaacgtgatgagcttactttggaaggtatcaaacaattttacgtaaatgttgatagggaagattggaagcttgaaactctatgtgatctgtacgagactctgnctatcactcaaagtgttatctttgttaacacacgtcgcaaggtcgattggcttacggacaatatgagaagccgtgatcataccgtatcggccactcatggtgacatggaccagaacactcgtgatataatcatgcgtgaatttcgctctgggtcgtctcgtgttcttatcacaactgacttgttagctcgtggtatcgatgtccagcaagtgtcccttgtcataaattatgatttgccgacccaacccgaaaattaccttcatcgaattggtcgaagtgggcgttttggaagaaagggcgttgccatcaattttgttacaaatgatgatgagagaatgctttttgatattcagaagttctataatgtggtcattgaggagctgccagccaatgttgcagatctcctatgatgaggtttttgtttgtttttttttttgtttttgtttttgtttatagggatgggatttctctcttatctctgaatgacactatttagcctccccccacttgaactcctctatttttatcttccctttgttttcatatattagtattgtcaaactgacattttgttaatgatttatttcctgctttctgtgc

SEQ ID NO: 4762 - DNA, 1820 bp, Quercus alba
ttttagcctcttcttcctcgctctctctctctctctctctctgcgtttcattgctttattccctcaactcctccaacctaaagatccgaggagtttgggaaagaaaccctaatccttaaaaccccttttaatcaaacaatctctctttctcatctcgttatcgctttcacttcaagtcatggctgctttgacaccagagggatcgcaatttgatgctcgtcaatatgatgctaaaatgagtgaattattgggtactgatgggcaagagttcttcacgtcatatgatgaagtttttgagagttttgatgctatggggttgcaagagaacctcctaagaggaatctatgcttatggttttgagaagccctctgcaattcagcaaagggggattgttcctttctgcaagggacttgatgtgattcaacaagcacagtctggaactggaaaaactgctactttttgctctggaattttgcagcagcttgactatggcttggttgaatgccaagcattagttcttgctcccactagagagcttgctcaacagattgagaaggtcatgcgggccctcggtgactatttgggtgtcaaggttcatgcctgtgttggtggaactagtgtccgcgaggatcaacgaattctttctgctggggtacatgttgttgttggtaccccaggtcgtgtgtttgacatgctgcggaggcaatcgcttcgccctgattacattaagatgtttgtgttagatgaagcagatgaaatgctttcacgagggttcaaggatcagatctatgatatcttccagctgctgccaccaaaaattcaggttggggttttctctgccacaatgccacctgaggcccttgagatcacgaggaagttcatgaataaacctgtgaggattcttgttaaacgtgatgagctaacccttgagggtatcaagcaattccatgttaatgttgaaaaggaggaatggaagctcgagactctctgtgatctttatgaaaccttggcaatcacacaaagtgtcatttttgtgaacaccaggcgcaaggttgattggctgacagacaagatgcgcagccgtgatcatacagtgtctgccacccacggagacatggaccaaaacacaagggacatcatcatgcgggaattccggtctgggtcttctcgtgttctcatcactactgatctcttggccaggggtattgatgtccagcaagtctctcttgtgataaattatgatcttccaactcagccagagaactacctccatcgaattggtcgtagtggaaggtttgggaggaagggtgttgccatcaattttgtgaccaaggatgatgagaggatgctctttgacatccaaaagttctacaatgtggtgattgaggagctgccagcaaatgttgctgatctcctttgatgtgcttttagctggcatgttcgaaggattctaatctggaagcgataattattactttatttctagtagttctagggcttttgataagcatggattgaactttcctaaaaatggggggttttgggttctctgcatttgagatgggaggccattcccaatttgggcaaagtatccatttttgcaaattttgtcgtgagtttgctttgtacttctgatgtcttattaaagtaaaagatttgcagaatcgattgtagcttgggttggtctcatttgatctaagcttggttttacgtgtatgtgtgagaagggatgttttgtagagttgaaacatgatttgattatgttgggatgttatgtagagctgaacttgcttgagtgtttctctttgagcttaaaactt

SEQ ID NO: 4763 - DNA, 1665 bp, Carica papaya
ctcttcactttactcgcttcggcttctcttgttcctgaaaaaaccttcttcctcaactccgcggcgtagatccgaggagtttgggaaaaccctaaatcaaaagcttctcttcaatttgtctttattcaacgtcgatttgctatcagtcatggcaggacttgcaccagagggatcgcaatttgatgctcgtcaatatgatgccaaaatgaatgacttactttcagctgatggtcaggatttctttactagctatgatgaggtgtatgacactttcgattccatgggtctccaagagaatcttctgaggggaatttatgcatatggttttgaaaagccctcggcaattcagcaaaggggaattgttccgttctgtaaaggacttgatgtaatccaacaggcccagtctggaacagggaagactgccactttctgttccggagtacttcaacaacttgattatggtttggtggaatgccaggcattggtcttagctccaacacgtgagctggctcaacagattgagaaagttatgagagcattgggagactaccttggtgttcgggtgcatgcttgtgttggtggaactagtgttcgtgaagaccagcgaattttgtccagcggtgtccatgttgttgttggtacgcctggacgtgtctttgacatgctaaggaggcagtctctccgcccagattatataaagatgtttgtgttggatgaagctgatgaaatgctatcacgtggtttcaaggatcagatctatgacattttccagcttctgccagcaaaagttcaggtaggagtgttctctgccaccatgcccccagaggcccttgagattaccaggaagttcatgaacaaacctgtgaggattcttgtgaagcgtgatgaactcacattggaaggtataaggcagttttacgtgaatgttgagaaggaggaatggaagctggagacactgtgtgatctctatgagacattagcgatcacacaaagtgtgatatttgtgaacacccgaaggaaggttgactggctgactgacaagatgcgtgcccgagatcatacagtgtcagcaacccatggtgacatggaccagaacacacgagacataatcatgcgtgagtttaggtctgggtcgtcgcgtgttttgattacgacagatcttttggctcgtggtattgatgtgcagcaagtgtcgcttgtgataaattatgatctgcctacacagccggagaactatctgcatcgtattggacgaagtggaaggtttgggaggaagggagctgctattaattttgtgacattggatgatgagaggatgctggctgacatccagaagttctataacgtggttattgaggagcttccatcaaacattgctgatctcctctaaatgagaattttggttttccattattagtatggaaagtgggatcagtttggtaaagtgcaatttgttgtgcggttttctttcctttttggtcttcgaagtcttgtttcgtaggtctagtattttaaatttttatgtgttctggatatcctactactactctttattattaaattatattagtacttgcattttccaaactggaactccttgaacaatgtttattagtgagtgttttgttgttgcaaagtttctgttcattaattatgttgaacaaa

SEQ ID NO: 4764 - DNA, 1684 bp, Capsicum annuum
gcacgaggcacaagtctcctctttccattcttttcctctttcctgaactcctgcggcgtagatccgaggagtttcagacaaaaacagcagtctttgcaaaccctaactccccaatcccttttgcccacttctcctcacatcctctcctccttattcctcagatctttttctcatcttttaggtcatggctggcttggcaccagaaggttcacaatttgatactcgtcaatttgatgccaaaatgactgagctgcttgggactgaacagcaggagtttttcacatcatatgatgaggtttatgaaagtttcgatgccatgggtttgcaagaaaaccttcttaggggcatctatgcttatggttttgagaagccgtctgctattcagcaaaggggtattgttccgttttgcaagggtcttgatgtgatccaacaggcacaatctggaacaggaaagacggcaactttctgctctgggattctccagcagcttgattacagcttagtcgaatctcaggctctcgttcttgctccaacccgtgagcttgcccaacagattgagaaggttatgcgagcactcggtgactatcttggtgtgaaggttcatgcttgtgtaggaggtaccagtgtccgtgaggatcagcgtatccttcaaagtggtgttcatgtggttgtcggtactcctggccgtgtctttgacatgttgcgcaggcagtctcttcgccctgaccacatcaagatgtttgttctggatgaagctgatgaaatgctctcaagaggtttcaaggatcagatttatgatatattccaattgctgccaccaaagattcaagttggcgttttctctgccacaatgccaccagaggcccttgaaattactaggaagttcatgaacaagcccgtgaggattcttgtgaagcgtgatgagcttactcttgaaggcatcaagcaattttatgtcaatgttgaaaaggaagagtggaagcttgaaactctttgcgatctttacgagaccttagccatcacccagagtgtcatctttgtgaacaccaggcggaaggttgattggctcactgataagatgcgcagccgcgatcacacagtatctgcaactcatggagacatggaccagaacactagagatatcattatgcgagagttccgatctgggtcatctcgtgtgctcatcactactgatcttctggcacgtggtattgatgtgcagcaagtatcccttgtgattaactatgacctacctactcagccagaaaactacctgcatcgtattggacgtagtggacgattcggaaggaagggtgtggctatcaattttgtcacaaaggatgatgaaaggatgctttttgacattcagaagttttacaatgttgtaattgaggagctgccagccaatgtggctgatcttctttgaggggtttttggttctctcaggtgaattcttccttatattaagtaatttaatattttattcttaggttagttagaattgcactggactaaaaattgggaaatgcagcttaaatgattcgccatggaacctgtagttttccaattttggttggacttatgtagtattgcaaattttgttggtttgtcttcttatattgtaagtccacaacaacttcaggttttggatgttatttgaaattagtttatttgggtttaaaaa

SEQ ID NO: 4765 - DNA, 1824 bp, Populus trichocarpa
aaaaaaatcccttggttagggtcataatttaagcaagcccgtctccgtatcgtttcctcacatcacagtgctgctatcgatctaactatctaatcaaacagagtgttccttgaaactcctccaaaacaaactacaaaaagatccgaggagtttgtggattctcaatcaaatcttctatctcttttctcttatcaatcatcacttttttcagtcatggctagttcggcacctgaaggatcccagtttgatgctcgtcaatttgattctaagatgaatgagctgctcacagctgaaggacaggatttctttacctcatatgatgaggtgcatgaaacttttgatgctatgaatttgaaggagaaccttctgaggggtatttacgcatatggttttgagaagccatctgcaattcagcaaagagggattgtcccattctgcaagggacttgatgtaatccaacaagcacaatcaggaactggaaagacagctacgttttgctctgggattttgcagcagcttgattatgatatagttgaatgccaagcattggttcttgcacctacccgagaactagctcaacagattgaaaaggttatgagagcactaggtgattatctgggtgtgaaggttcatgcttgtgttggtggaaccagtgttcgtgaggatcagcgtattctctcagctggggttcatgttgtagtcggtactcctggtcgtgtgtttgacatgttgcggagacaatcacttcgccctgactatatcaagatgtttgtattggatgaagcagatgaaatgctctcaagaggattcaaggatcagatatatgatattttccaattactgcccccaaagattcaggttggggtcttctctgctactatgccacctgaggccctagaaattacgaggaagttcatgaataaacctgtgaggattttagtgaagcgtgatgagcttacccttgagggtatcaagcaattctatgttaatgttgacaaggaggaatggaagcttgagacactttgtgatctatatgagaccttggcaataacccaaagtgttatctttgtgaacaccaggcgcaaggtggattggctcacagacaagatgcgcagtcgtgatcacacagtctctgccactcatggagatatggaccaaaacacaagggacattattatgcgagaattccgctctggttcctctcgtgtgctgatcactactgatctgttggcccgtggtattgatgtccagcaagtctcacttgtgatcaattatgatctccctacccagccagagaactacctccatcgtattggtcgtagtggacgttttggaaggaagggtgttgctataaactttgttaccagggatgatgaaagaatgctttctgacatccagagattctataatgtaacggttgaggagctgccatcaaatgttgctgatcttctttgaagcaattttggttcaccaaggtaaatggctgagcttggaagttaaaactattatgctgtttgcagttttggggcctctatttagcatggattggactagccctgcaggtttggttctgagcatttgagattggggtcaatcccatttcgggtgcagaagtcccatgtgttaaattttgttgcaagtttgtttttgctttttcctttttgtgtcggagtaaaatttgcagaattatggtagtcaatcataatattttactctctgcgtggttttttattttatgcaagggaatttcatgtaggtaaaaaacttatgataaagtcattatgttataatattgggctctccgttgctgttctcttgagcaat

SEQ ID NO: 4766 - DNA, 1670 bp, Prunus persica
gcagatccgaggagtttgggaaaccctagctctcttttagcaacctactattctcctctgttttctctctctagcgctcatcaacatcatcagtcatggcaggtgttgcacccgaaggatcacagtttgatgcaaagcaatatgacactaaaatgagtgaattgctctcaactgatggacaagagtttttcacatcatatgatgaagtttatgaaagttttgattccatggggttgcaagaaaatcttctgaggggaatttatgcttacggttttgagaagccttctgcaattcagcaaaggggaattgttccattctgcaaaggcctcgatgtgattcaacaggctcagtctggaaccggaaaaactgcaaccttctgctctggaattttgcagcaacttgattatgctgtagtccagtgccaggctttggttttggcacctaccagggagttggcacagcagattgagaaggttatgcgagcacttggtgactatcttggcgtgaaggttcatgcctgtgtaggcgggacaagtgttcgtgaggatcagcgcattcttcaagctggtgttcatgttgttgttggaacccctggtcgtgtatttgacatgttgcggaggcagtctcttcgtccagattacatcaagatgtttgtgttggatgaggccgatgaaatgctttctcggggttttaaggaccagatctatgacattttccagcttctgccatcaaaagttcaggttggggtgttctctgctacaatgccacctgaagcacttgaaatcacgaggaagtttatgaacaaacctgtgaggatcttggtgaagcgtgatgagctcacccttgagggtatcaagcaattttatgtcaatgttgataaagaagaatggaagcttgagacactttgtgatctgtatgagaccctggccatcacccagagtgtcatttttgttaatacacggcgaaaggtggactggcttactgacaagatgcgaagccgtgaccacactgtctcagctactcatggtgacatggaccagaacactcgtgacattatcatgcgtgaattccgctctggctcgtcccgtgttctcataaccactgatcttttggctcgtggtattgatgtgcagcaggtatctctcgtcataaattatgatttgccgacccaaccagagaattaccttcatcgtattggtcgaagtggaaggtttggaaggaagggtgttgccattaactttgtgactagggatgacgagagaatgctctatgacattcagaggttttacaatgtggtcattgaggagctgccatcaaatgtcgctgatctgctctgaggagatgattttgttttgcttttctttttgaggcagattttctttatcctgttttgaaagtactattttaatgcttttttgtcattttgttttttttttcatcaatttatgctgtcaaacatatctaactgtttaatggtatgcgccttcttgctcaatttcgtcgtatgaaaaaaagacttttaggatgtctgtctcatactttggctgtgcttctggctttttgttatttggttttcagtcagttttctgttgtacctattattttgttcttaccttgagaatttagtacacaagaggggtaattttgctcttaccttgacaattttgtct

SEQ ID NO: 4767 - DNA, 1553 bp, Glycine max
tataacactccctcttcctctctattcgcctccctttaactccacggtgcagatccgaggagttaccccttagctttttctctttccttattctatttcaaacttccaccagtgatggcaggtttggctccagaaggaacacaatttgatggtcgccaatatgatgctaagatgagtgaattgctttccactgatgggcaagaattcttcacctcatatgacgaagtctatgacagctttgatgccatgggattgcaagagaatcttctgcgaggcatatatgcttatggttttgagaggccttctgcaatccagcaaaggggaattgttcctttctgcaaaggtctggatgtgattcaacaggctcagtctggaacaggaaagacagcaacattttgttctggaattttgcagcagcttgattatggattggttcagtgccaggctttggttttggcaccaacaagggagctagcacagcagattgagaaagttatgcgagctcttggtgattacctgggagttaaggttcatgcttgtgttggtgggacaagtgttcgtgaggatcagcgcattctccaagctggtgtccatactgttgttggcactcctgggcgtgtgtttgacatgctgcggaggcagtctcttcgcccagattgcataaagatgtttgttttggatgaggctgatgaaatgctttcacgtggttttaaggatcagatctatgacatctttcagctgctgccatccaaaattcaggttggagtgttctctgctacaatgccaccagaagcccttgagattacaagaaagttcatgaataagccagtgagaatcctggtaaagcgtgatgaactgaccctggagggtatcaagcagttttatgtcaatgttgacaaggaagagtggaagctggagacattatgcgacctttatgagactctggctatcacccagagtgtcatttttgtgaataccaggcgcaaggtggactggctcactgacaagatgcgaagcaatgatcacacagtctctgccacccacggtgacatggaccaaaatacccgtgatatcatcatgcgtgaattccggtccggctcttcccgagttctcattaccactgaccttcttgcccgtggaattgatgtacagcaggtgtctctggtcataaattatgatctgccaacccaacctgaaaactatctccaccgcatagggcgtagtggtcggtttggaagaaaaggagtttctataaactttgtcacgacggatgatgccagaatgctgtctgatattcagaagttctacaatgtgactgtagaggagctgccatcaaatgttgctgatttactctgatgagttaatttttgttctctgttaagtcatcaggatcttattctatttggcaagtattatttgttcttattttttctctatatattttacctattagagatcaaagacatgtgatctgatgctatttgtattggattctataaattttgtttaatcaattaattagcaggttgctgctcaagcctgcatttgctttc

SEQ ID NO: 4768 - DNA, 1571 bp, Helianthus annuus
cggggatctcctcactccacggccacacaccgaggagtttgagaaaccctaaaaaaagcctccaaaaaattctctcgtccttctcactaaatccttcaatcaacctttcaattcagtcatggcaggcgctgcaccagaaggttcccagtttgacactcgtcactttgattccaaaatgaacgagctgctttctactgatggacaggattttttcacatcgtatgatgaagtttatgatagttttgatgctatgggtttgcaagaaaatcttttaagaggcatctatgcatatggttttgaaaaaccatctgcaattcagcaacggggaattgttccattcaccaagggtctcgacgtaattcagcaagctcaatcaggaacaggaaagaccgcaaccttttgctccggcattcttcaacaacttgattataacgtagttgagtgtcaggctttggttttagctccaacgcgtgaacttgcacagcaaattgagaaggttatgcgcgccctaggtgactaccttggtgttaaggttcatgcttgtgttggtgggaccagtgttcgtgaggatcagcggattctttcagctggggtccacgttgttgttggtactcctggacgtgtttttgacatgcttaggaggcagtcgctacgttctgattatatcaaaatgtttgtgttggatgaagctgatgaaatgctttcaagaggtttcaaggatcagatctatgatatctttcagctgttaccttcaaaggtccaggtcggtgtgttttctgcaactatgccaccagaagctctagaaatcacaagaaagtttatgaacaaacctgtaagaattctcgtgaagcgtgatgaattaaccctagaaggtatcaaacaattttatgtcaatgtcgaaaaagaagagtggaagctcgaaactctatgcgatctttacgaaactctagcaattacccaaagtgtcatttttgtcaacacccggcgaaaggttgactggttgaccgacaaaatgcgtagccgagaccacacagtctccgccactcacggtgacatggaccaaaacacccgtgacatcatcatgcgagaattccgttcgggttcctcacgtgttctgatcaccactgatcttttggcacgtgggattgacgtacagcaagtgtcacttgtgatcaattatgatcttccaactcagcctgaaaactatcttcatcgtattggacgtagtggtcggtttgggaggaagggtgttgcgatcaactttgtgactttagacgatgaacggatgcttgcggatattcagaagttttataatgtggtggttgaggaattgccatctaatgttgctgatctgatttagaaaagattttgagatgtttggtttgtttgtttgttttgttataagtaagagatcaaaagttagaactttttttaaatcctttggttttggctgttttaagttatttattattattattgtcatgactctggcctttgggtgttataagatatttgaaacttatgtttgtaccctaaattttcaagtgcaagtatttaagaaaaaaaaaaaa

SEQ ID NO: 4769 - DNA, 1628 bp, Helianthus annuus
cgcagagtggccattacggccggggatctttactctctcaacaactccacggccactccgaggagttttgagaaaaccctaaaaagcctccactaaaatctcttcactttctcttctaaatcttttcatcaatcttcgaatcagtcatggcaggcgcagcaccagaaggttctcagtttgacacccgtcactttgattcaaaaatgaacgagttgctttctactgatggacaggacttttttacatcatatgacgaggtttatgatagctttgatgctatgggtttgcaagaaaacttattaagaggcatctatgcatacggttttgaaaagccatcagcaattcaacaaaggggaattgtcccattcaccaagggtcttgatgtaattcaacaagctcaatcaggaaccggaaagacagcaaccttttgctccggtattcttcagcaacttgactacaatgtagtggagtgtcaggctttggttctggctccaacccgtgagcttgcacagcaaattgagaaagttatgcgggcccttggtgactaccttggtgtgaaggttcatgcttgtgtgggtggaaccagtgttcgtgaggaccaacgcatcctctcagctggggtccacgttgttgttggtacacctggacgtgttttcgacatgcttaggaggcagtcactacgtgctgattacatcaagatgtttgtgttggatgaagctgatgaaatgctttcaagaggattcaaggatcagatctatgatatctttcagctgttgccatcgaaggttcaggttggagtgttctctgcaaccatgccacctgaagccctcgaaatcacaagaaagtttatgaacaaacccgtaagaatccttgtgaaacgtgatgaactcaccctagaaggtatcaaacagttttacgtcaatgtcgaaaaggaagaatggaaacttgaaaccctatgtgatctttacgaaaccttagcaatcacacaaagtgtcattttcgtcaacacccgacgaaaagttgactggttgaccgacaagatgcgtagccgagaccacacagtctccgccacacacggtgacatggaccaaaacacccgtgacatcatcatgcgtgagttccgatctggttcatcacgtgtgttgatcaccactgatcttttggcgcgtggtattgatgtccaacaagtgtcacttgtgatcaattatgatcttcctacacaaccggaaaattatcttcaccgtatcggacgaagtgggcgatttgggagaaagggtgttgcgattaattttgtgacgttggatgatgaacggatgcttgctgatattcagaagttttataatgtggtggttgaggagttgccgtccaatgttgctgatctgatttagaaaatgatcttgggatgttgggctggcttgtttaagtaagaaaggtcaaaggttagaacctgttttttgaaatctatcggttttggttgttttaagtttaatgtatgacatggtgttctaagatatttggaacttatatttgtgtacccccggatgcggatttgtttattatttcatcttttggtataattattataatgtatttgtggcttcgcgaggaggaacaaaaggcataaaagc

SEQ ID NO: 4770 - DNA, 1681 bp, Nicotiana tabacum
  misc_feature (811)..(811): n is a, c, g, or t
ggccattacggccgggggaggagtttttggaaaaaaagaagcagcagtctttgaaaaaccctaatcctcaataatccctctcaaatcttcagatcttcctttaacacacttcatatctttatcagttatggcaggcttggcaccagagggttctcaatttgatgctcgtcagtatgacgccaaaatgacagagctgcttggtactgaacagcaagaattcttcacatcatacgatgaggtttacgaaagttttgatgccatgggtttgcaagaaaaccttctgaggggcatttatgcttatggttttgagaagccatctgctattcagcaaaggggcattgttcccttttgcaagggccttgacgttatccagcaggcacaatctgggactggaaagacggcaactttctgctctggaattctccagcagcttgattatagtttagttgaatgtcaggctctggttcttgcaccaacccgtgagctagctcaacagattgagaaggttatgcgggcacttggtgactatctgggtgtgaaggttcatgcttgtgttgggggtaccagtgtccgtgaggatcagcgtatccttcagagcggtgttcatgtcgtggttggtactccaggccgtgtctttgacatgctgcgcaggcagtctcttcgccctgacaacatcaagatgtttgttttggatgaagccgatgaaatgctctctagaggtttcaaggatcagatttatgatatattccaacttttgccaccaaaaatccaagtgggtgttttctctgccactatgccaccagaggccctngagattactagaaagttcatgaacaagcccgttaggattcttgtgaagcgtgatgagctcactcttgaaggtattaagcaattttatgtcaatgttgacaaggaagagtggaagcttgaaacactctgtgatctttacgagaccttggccatcacccagagtgtcatctttgttaacactaggcgaaaggttgattggctcactgataaaatgcgtggccgtgatcatacagtatctgcaactcatggagacatggatcagaacacaagagatatcattatgagggagttccgatctggctcatctcgtgtgcttatcactactgatctccttgctcgtggtattgatgtccagcaagtctcccttgttattaattacgatctgccgactcaaccagaaaactacctgcatcgtattggtcgtagtggccgatttggaaggaagggtgtttctatcaactttgtcaccaaggatgatgaaaggatgctttttgacatacaaaagttttataatgtcgtgattgaggagctgccagctaatgttgctgatctcctttgatgcgattttggttatggtgcggggaatttttccttacatgaagtagtttaatatatttattcttaggcttagtttcactttgcgctggacttggaattgggaaatgctggatccttgattttgccaaagcaccagctgctgtcccaatttagtagaactttgagtcgactattgcaaattttgtttggttttgtcagtttgtatgtttaagcgtctaatgacttaaaattttgttgctgtctgaattgactatattgagtttagcagagctatttttctctggaaggaaagctttttgctggtgaaaaaaaa

SEQ ID NO: 4771 - DNA, 1638 bp, Populus trichocarpa
ctataccgacctataaataatcacgcagacacgtgaacaaagcctctttcaaactccacggcgcagatccgaggagtttgggatttctgatatctcactacatacttcaacttcatacaatctctccacatttctttctagctatcaatcactcgcttcctaccagtcatggcaggtctggcaccagaaggatcgcaatatgatgctaagcaatatgatgccaaaatgaatgatctgcttgcaaatgatgggcaagatttcttcacaatgtatgaggaggtttttgaaacctttgattcgatgggattgcaagagaaccttctgaggggcatctatgcctatggttttgagaagccatctgcaatccagcaaagaggaattgttccattttgtaaaggccttgatgtgattcagcaggcacaatctggaactgggaaaacagcaactttctgttctggcattctccagcaacttgattatggtttggtgcaatgtcaagcattggtcctggctcccaccagggaactagcacaacagattgaaaaggttatgcgagcacttggtgattatcttggtgtcaaagttcatgcttgtgttggtggcacaagtgttcgtgaggaccaacgcattcttcaagctggtgttcatgttgttgttggcacacctggtcgtgtgtttgacatgttgagaaggcagtcacttcgtcaagattacattaaaatgtttgtcttggatgaggctgatgaaatgctttcacgtggttttaaggatcagatctatgatattttccagttgctgccatcaaaagttcaagttggtgtgttctccgctactatgccacctgaagctcttgagatcacaaggaagttcatgaataagcctgtgaggatcttggttaagcgtgatgagcttactcttgaaggtatcaagcaattttatgttaatgtcgataaggaggagtggaagctcgaaacactatgtgatctatatgagaccctagccatcactcagagtgtcatttttgttaacacccggcgcaaggttgactggctgacagacaagatgcgaggccgtgatcacacagtctcggctactcatggagatatggaccagaacactcgtgatatcattatgcgagaattcaggtccggctcttctcgtgttctcatcactaccgatctcttggctcgtggtattgatgttcagcaagtttcccttgtcataaattatgatctgccgactcaacctgaaaactatcttcaccgtattggacgaagtggacggtttggaagaaagggtgttgctattaactttgtgacaagtgatgatgacagaatgctgtttgatatccagaagttctataatgtggtcgtcgaggagctgccatcgaatgtggccgatctcctttgatgagatttttttgtgatggtcgaggaaaatggtatcttattttgcttgtactatttaacgtattgatttcttttcattcctgtttagggtcgttaaattttatgttcagagacatctctgacagtttaatctcacgtgggtcctccattattacaggttccacttgttatgaaaggattgtcaggtcgacttgttattttaaagccttgtttgcatgttgtgtttttc

SEQ ID NO: 4772 - DNA, 1787 bp, Coffea canephora
cgccacttcaaggcataaaaataaacaaagcagcagtctttgttttccctcttttcatcagttcacaatttctttcttttccttaactccgcggcgtagatccgaggagtttcggaaacaaaatcacagctttagcaaaaccctatttcggccttctttcgcaaacctttccttttctcttcagatcttcatctcatcgctactatttgcgagtcatggctggccttgcaccggagggatctcaatttgatgcgcgtcaatatgatgctaaaatgaccgagttgcttggtactgatggtggtcaggagttcttcacttcttatgatgaggtttatgacagttttgattcaatggggttgcaagagaaccttctcaggggcatttatgcttatggttttgagaagccctctgctattcaacaaaggggaattgttcctttttgcaagggactggatgttattcagcaggcacagtctggaaccggaaagactgcaactttctgttcaggaatcctccagcagctagactacagtgtggttgagtgtcaggctcttgttcttgcccccacccgtgagctcgcgcagcaaattgagaaggttatgcgtgctctgggtgactaccttggtgtgaaggttcacgcttgcgtgggaggtactagtgtccgtgaggatcagcgcattctttccagtggggttcatgttgtagttggtactcctggtcgtgtatttgacatgttgaggagacagtcacttcgccctgattacatcaagatgtttgtgctggatgaagctgatgaaatgctttccagaggtttcaaggatcagatttatgatattttccagctcttgccgcccaagattcaggttggtgtattctcagctacaatgccacctgaggcacttgaaatcacaaggaagttcatgaacaaaccggtaaggattcttgtgaagcgtgatgagcttactcttgaaggtatcaagcaattctatgtcaatgttgaaaaggaggaatggaagcttgaaacactttgcgatctttatgagacccttgccattacccagagcgtcatctttgttaacaccaggcgtaaggtggactggctcactgataaaatgcgtagccgcgaccacacagtctcagccacccacggggacatggaccagaacaccagagacatcatcatgcgggaattccgctctggttcctctcgtgtgcttatcacaactgatcttctggcccgtggtattgatgtccaacaagtctcacttgttatcaactatgatctcccaactcagccagaaaattacctccatcgtattggtcgtagtggacgatttggaaggaagggtgttgctatcaactttgttactcgtgatgacgagcgcatgctctttgacatacagaagttttataatgttgtaattgaggagctgccagccaatgttgctgatctcctttgaagaggttttggtaagggcaaggtaaatttttccttgtttggagtaattttatatcttatttcgtaggtttagctaaaaaagtgtaccagacttgaaattgggaggtgcgggtgcaatgatttaccaagggcacttgcatgtctcagtttggtttaaaatcagaacctgttcttggaaattttgttggttgtctttgtattgtaagtgctcaaaataactgctgatttggagttgtttgaatattattgagttctacagttagcttgtctttgtgtttgaccatgtatatgctgttcacaatttggtaggaattgttctttgatgttg

SEQ ID NO: 4773 - DNA, 1718 bp, Coffea canephora
cgccacttcaaggcataaaaataaacaaagcagcagtctttgttttccctcttttcatcagttcacaatttctttcttttccttaactccgcggcgtagatccgaggagtttcggaaacaaaatcacagctttagcaaaaccctatttcggccttctttcgcaaacctttccttttctcttcagatcttcatctcatcgctactatttgcgagtcatggctggccttgcaccggagggatctcaatttgatgcgcgtcaatatgatgctaaaatgaccgagttgcttggtactgatggtggtcaggagttcttcacttcttatgatgaggtttatgacagttttgattcaatggggttgcaagagaaccttctcaggggcatttatgcttatggttttgagaagccctctgctattcaacaaaggggaattgttcctttttgcaagggactggatgttattcagcaggcacagtctggaaccggaaagactgcaactttctgttcaggaatcctccagcagctagactacagtgtggttgagtgtcaggctcttgttcttgcccccacccgtgagctcgcgcagcaaattgagaaggttatgcgtgctcttggtgactaccttggtgtgaaggttcacgcttgcgtgggaggtactagtgtccgtgaggatcagcgcattctttccagtggggttcatgttgtagttggtactcctggtcgtgtatttgacatgttgaggagacagtcacttcgccctgattacatcaagatgtttgtgctggatgaagctgatgaaatgctttccagaggtttcaaggatcagatttatgatattttccagctcttgccgcccaagattcaggttggtgtattctcagctacaatgccacctgaggcacttgaaatcacaaggaagttcatgaacaaaccggtaaggattcttgtgaagcgtgatgagcttactcttgaaggtatcaagcaattctatgtcaatgttgaaaaggaggaatggaagcttgaaacactttgcgatctttatgagacccttgccattacccagagcgtcatctttgttaacaccaggcgtaaggtggactggctcactgataaaatgcgtagccgcgaccacacagtctcagccacccacggggacatggaccagaacaccagagacatcatcatgcgggaattccgctctggttcttctcgtgtgcttatcacaactgatcttctggcccgtggtattgatgtccaacaagtctcacttgttatcaactatgatctcccaactcagccagaaaattacctccatcgtattggtcgtagtggacgatttggaaggaagggtgttgctatcaactttgttactcgtgatgacgagcgcatgctctttgacatacagaagttttataatgttgtaattgaggagctgccagccaatgttgctgatctcctttgaagaggttttggcaagggcaaggtaaatttttccttgtttggagtaattttatatcttatttcgtaggtttagctaaaaaagtgtaccagacttgaaattgggaggtgcgggtgcaatgatttaccaagggcacttgcatgtctcagtttggtttaaaatcagaacctgttcttggaattttgttggttgtctttgtattgtaagtgctcaaaataactgctgatttggagttgtttgatattattgagttctacagtt

SEQ ID NO: 4774 - DNA, 1648 bp, Cleome gynandra
ctcttcgggttttctcaaatcttcactctctctatctctgtttctgtctctccccttcgcggatcagatccgagtttgggagattcaatcgctccaggaaacccagttcttttctctctctagcttccatctccatcagctaagctccagtcatggcaggattggcacctgagggttcacagtttgatgcacgtcagttcgaccagaagttgaatgatttgcttgagaccggtgatgaattcttcacatcttatgacgaggtttatgaaagcttcgactccatgggtttgcaagagaaccttctcaggggtatctatgcatatggttttgagaagccttctgcaattcagcaaagaggaattgtccctttctgcaaggggcttgatgttatccagcaggcccagtctggtactgggaagactgcaactttctgctctggaattttgcagcaacttgactacagccttgtccagtgccaggctctggttttggctccaaccagggagcttgctcagcagattgagaaagttatgagggcccttggtgattaccttggtgtcaaggttcatgcatgtgttggtggtactagtgttcgtgaggaccagcgtattctccaggctggtgttcatgtagtagttggaactcctggtcgtgtctttgacatgttgcgcaggcaatctctccgccctgactacatcaagatgtttgtccttgatgaggctgatgagatgctctctcgaggtttcaaagaccagatctatgacatcttccagcttctcccacctaagattcaggtcggtgtgttctcagccacaatgccaccagaggcgcttgagatcacaaggaagttcatgaacaagcccgtcaggatcttggtgaagcgtgatgagctcaccctggagggtatcaagcagttctatgtcaacatcgagaaggaagagtggaagcttgatacgctctgcgatctctacgagactcttgccatcacccagagtgtcatctttgtgaacacacgacgcaaggtggactggctcacagaccaaatgagaggccgtgaccacacagtctcagccactcatggtgacatggatcagaacacccgtgatatcatcatgcgagaattcaggtcaggctcctcccgtgttctcatcacaacagatctcctggcccgtggtatcgatgtccaacaggtgtctctggtcataaactatgacctaccaacccagccggagaactatctccaccgtattggaagaagtggaaggtttggaaggaagggtgtggccatcaattttgtgactcgggatgacgaaagaatgctgtttgatatccagaagttctacaatgtggtcgtggaggagctgccatcaaacattgctgatcttctgtgagagagaggccggctctctcggtcactcagtaatcgtcgccgctgtgtcctttcttgtttcgcaaggttctgtttgatatatttgataccctactatcaagcggttcccttttttcatatttatcttcttataaaatatccttcatatgatgtttgatgagagtattttatgttattccctctgggtctcttcttaagactctttatgtgattgtaaaattacatatctttgttctgctgtagtgtagcactaaaaat

SEQ ID NO: 4775 - DNA, 1919 bp, Theobroma cacao
cggggctctctttttcctctcagtctctctagtctctatccatcgaccctctctcgccctttacttactccaagagacagagagatccgaggtgtttgggccaaaaccctagccctaaaaaatcaccccccggctcacaaatttctctcaatcatcttcactaccagtcatggctgctgcagcaccagagggatctcaatttgatgctcgccagtatgatgctaaaatgaatgaacttgaggctgatgggcaagaattctttacaacatatgatgaagtttatgacacttttgattctatgggattgcaagagaatcttcttaggggcatttatgcttatggttttgagaagccatctgcaattcagcaaagggggattgtaccattctgcaagggacttgatgttattcaacaagcacagtccggaacaggaaaaacagcaactttttgctctggaattttacagcagcttgactacagcttagttcagtgccaagcattggtccttgcaccaactcgagaattagcacaacaaattgagaaggtcatgcgggcattaggtgattaccttggtgttaaggttcatgcttgtgtaggtgggaccagtgtccgtgaagatcaacggattctctccactggagttcatgtggttgttggtacacctggccgtgtgtttgacatgttgaggagacaatctctccgccctgatcacataaagatgtttgtgttggatgaagcagatgaaatgctctcacgaggttttaaggatcagatctatgacattttccagttactgccacccaaaattcaagtaggagttttctctgctacaatgcctcctgaagcccttgagatcacaaggaagttcatgaacaaacctgtaaggattctggtgaagcgtgatgagcttacccttgagggtatcaagcagttttatgtcaatgttgagaaggaggaatggaagcttgagacactttgtgatctctatgagactttggcaatcacccaaagcgtaatttttgtgaacactaggcgtaaggtagattggcttacagacaagatgcggagtcgtgatcatacagtctctgccacccatggagatatggaccaaaatacaagagacatcatcatgcgggaattccgatctggatcctctcgtgtgcttatcactacagatctcttggctcgaggtattgatgttcagcaagtctctcttgtgatcaattatgatctcccaacacaaccagagaactaccttcatagaattggtcgaagtggaagatttgggagaaaaggtgttgccatcaactttgtgaccagggatgatgagaggatgctatttgacatccagaagttctataatgttgtggttgaggagctgccgtcaaatgttgctgatcttatttgatgctgttttgggttggctagataaatggctacttggaggtgacaaagttttaaggtctggtgcccttacagttggaaggggtttttgttcctgcacatttagatgggttcccattaccatttagaaatctgatgttcaaattttgatttggtgtgtgtccaagtaagaaaaaaatgtagtattgttctagttttatgttaaattatgttgttttatgttattttttctcctctagtttctctatttgagaggatattatgtagagtggtaacttgattattttagattattggacttgccttttgttgacattttggtagttattcttgtctcctccccgtagctaattagttggcatgattgtttgagagtttcagtccgatcaagaaaggagggattggagtcattgaatgtaacctgttagcagctgtagaaggttgtattcatttaggctgcgcatgtgttatttagcattcattcagatatggaaaattgtgctaattggttggca

SEQ ID NO: 4776 - DNA, 3081 bp, Ricinus communis
aaattacaaaatgaggaaggcttttacattagatacgatgtcatgttacaatgttgtgcatattgaggaactttaaggacataaggagcataagtactaattataagaagattcttgtaatttgatatggtaaaatcaaacgacgccgttagtttagcttagaactcatatttccgattcccgttcccgtcgcttcatcgcagtactcacgctgctgagatagtaggactgaacgcccaaaacgcagaacagaaaacgtgaaacgcaaaatgtgcggtgacgcgacgaactgggacgaagatgcatacagagcaagcgtattaaaggatcgagaactccaaaccttaaccgtatttagaaccgcatgggctccctcttcaaaccctagccctgacacaatcgttatcgcctccagtgacggttcaatcgcttcttactctatctcctcttgcatatccaagctcccattaggatttaacaatgcagaagctcaacaggctgaacctgatgcgttgcttcggggacacgatggaccggcttatgatgtcaagttttatggcaattgtgaaaatactttgttattgagctgtggagatgatggtcggattcggggatggcgatggaaggaatttatacaattagaaggacatggcatacagccagtacttgacttggtgaacccacagcataaaggtccttgggatgctctttccccaattcctgaaaacaatgccatagctgtggatactcagaggggatgtattttttcagctgctggtgattcttgtgcatattgttgggatatggagacttctaagatcaaaacagtttttaagggacacttggactacttgcactgtatagttgcccgtaagtctaccaatcagattataactggttcagaggatgggactgcacgaatttgggattgcaaaagtggaaagtgtgttcaagtaattgatccggggaaggataagcagttgaaaggatcctcgtatgtcagctgcattgctcttgatgcaagtgagacctggttggcttgtagcaatggtcggagtttatcagtttggaatcttccagcttctgaatgtgtttcaaaggctgctgctcatgcatccatacaggatgtaatatttgatgacaaccaagttttagctgttggagcagagcctctactctgccgtttcgatataaatggagcaattcgttcacagataccttgtgctcctcagtcagcattttctgtctccgtacacacatcaggaatgactgcagttggaggttatggaggtcttgtagatgtaatatcccagtttggtagtcactattgcacattccgctgtaaatgcctatagaaaattccttgacttgagcagttctgataaatgaataagggatgagttgtgtgcaaaggtttacaagcattttttcacgtttacttgagaagaattttatactgtgtacaaagaggggtcatgatgggcattgccgcattgctgcagctatggcgggactagcaccagaaggatctcaatttgatgcgaagcattttgattcaaagatgaatgaattactaacagctgatggagaggatttcttcacaacatatgatgaagtttatgaaagttttgattctatgggtttgcaagagaatctcttgagaggcatttatgcatacggttttgagaagccctcagccattcagcagagaggaattgttccattctgcaagggacttgatgttattcaacaggctcaatctggaaccggaaagacggcaactttttgttccggtattctccaacaacttgattatgctttggtggagtgtcaggctttggtcttagcacctactagggagctcgcacagcaaattgaaaaggttatgcgagcacttggggattatcttggtgtcaaggtccatgcttgtgttggtggaactagtgttcgtgaagatcagcgcattctgtcaagtggggtgcatgttgttgttggcactcctggtcgtgtatttgacatgctgcgaaggcagtcacttcgtcctgattacataaaaatgtttgtgttggatgaggcagatgaaatgctttcacgtggtttcaaggatcagatctatgatattttccagcttctgccatcaaaaattcaagttggtgttttctctgcaactatgccgcccgaggctctagagatcactcggaagttcatgaacaaacctgttaaaattcttgtgaagcgtgatgagctcaccttggagggtataaagcagtttcatgtcaatgttgagaaggaagagtggaagctggagacattgtgcgacctgtacgagaccttagctattacccaaagtgtcatttttgtcaacactcgtcgcaaggttgattggctgacagacaagatgcgaagtcgagaccacacagtctctgccactcatggtgacatggaccagaacacaagagatatcatcatgcgtgaatttcgatctggatcatctcgtgttctcatcactactgatctattggctcgtggtattgatgtccagcaagtctcccttgttataaattatgatcttcctactcagccggagaactatctccatcgtattgggcgtggtggacggtttgggaggaaaggtgttgcgatcaattttgtaacaagggatgatgagaggatgctgtttgacatccagaagttctataatgtggtggttgaggagcttccatcaaatgttgcagatctcctctaaatgagattttgtcttttaatattattaggaagtagaatccatgttgtgcttttgtttttccctttcttaatttgaactcttgttcttataggtgtaggttcttttaaaagtttggttgctgactagttagtgatatttatttataatgttcccgcgatgctatatggtgttgtggatttttgttgcgtatattttgtgttgattaagatcctttgttatgggtttcttaggtgcttaaaaggtgggagcttggaaatgtttctcgtttctgttttcattgctacaatgttttagactgttacattatggatactgatatattaaattatcttggc

SEQ ID NO: 4777 - DNA, 2526 bp, Ricinus communis
gactgaacgcccaaaacgcagaacagaaaacgtgaaacgcaaaatgtgcggtgacgcgacgaactgggacgaagatgcatacagagcaagcgtattaaaggatcgagaactccaaaccttaaccgtatttagaaccgcatgggctccctcttcaaaccctagccctgacacaatcgttatcgcctccagtgacggttcaatcgcttcttactctatctcctcttgcatatccaagctcccattaggatttaacaatgcagaagctcaacaggctgaacctgatgcgttgcttcggggacacgatggaccggcttatgatgtcaagttttatggcaattgtgaaaatactttgttattgagctgtggagatgatggtcggattcggggatggcgatggaaggaatttatacaattagaaggacatggcatacagccagtacttgacttggtgaacccacagcataaaggtccttgggatgctctttccccaattcctgaaaacaatgccatagctgtggatactcagaggggatgtattttttcagctgctggtgattcttgtgcatattgttgggatatggagacttctaagatcaaaacagtttttaagggacacttggactacttgcactgtatagttgcccgtaagtctaccaatcagattataactggttcagaggatgggactgcacgaatttgggattgcaaaagtggaaagtgtgttcaagtaattgatccggggaaggataagcagttgaaaggatcctcgtatgtcagctgcattgctcttgatgcaagtgagacctggttggcttgtagcaatggtcggagtttatcagtttggaatcttccagcttctgaatgtgtttcaaaggctgctgctcatgcatccatacaggatgtaatatttgatgacaaccaagttttagctgttggagcagagcctctactctgccgtttcgatataaatggagcaattcgttcacagataccttgtgctcctcagtttacaagcattttttcacgtttacttgagaagaattttatactgtgtacaaagaggggtcatgatgggcattgccgcattgctgcagctatggcgggactagcaccagaaggatctcaatttgatgcgaagcattttgattcaaagatgaatgaattactaacagctgatggagaggatttcttcacaacatatgatgaagtttatgaaagttttgattctatgggtttgcaagagaatctcttgagaggcatttatgcatacggttttgagaagccctcagccattcagcagagaggaattgttccattctgcaagggacttgatgttattcaacaggctcaatctggaaccggaaagacggcaactttttgttccggtattctccaacaacttgattatgctttggtggagtgtcaggctttggtcttagcacctactagggagctcgcacagcaaattgaaaaggttatgcgagcacttggggattatcttggtgtcaaggtccatgcttgtgttggtggaactagtgttcgtgaagatcagcgcattctgtcaagtggggtgcatgttgttgttggcactcctggtcgtgtatttgacatgctgcgaaggcagtcacttcgtcctgattacataaaaatgtttgtgttggatgaggcagatgaaatgctttcacgtggtttcaaggatcagatctatgatattttccagcttctgccatcaaaaattcaagttggtgttttctctgcaactatgccgcccgaggctctagagatcactcggaagttcatgaacaaacctgttaaaattcttgtgaagcgtgatgagctcaccttggagggtataaagcagtttcatgtcaatgttgagaaggaagagtggaagctggagacattgtgcgacctgtacgagaccttagctattacccaaagtgtcatttttgtcaacactcgtcgcaaggttgattggctgacagacaagatgcgaagtcgagaccacacagtctctgccactcatggtgacatggaccagaacacaagagatatcatcatgcgtgaatttcgatctggatcatctcgtgttctcatcactactgatctattggctcgtggtattgatgtccagcaagtctcccttgttataaattatgatcttcctactcagccggagaactatctccatcgtattgggcgtggtggacggtttgggaggaaaggtgttgcgatcaattttgtaacaagggatgatgagaggatgctgtttgacatccagaagttctataatgtggtggttgaggagcttccatcaaatgttgcagatctcctctaaatgagattttgtcttttaatattattaggaagtagaatccatgttgtgcttttgtttttccctttcttaatttgaactcttgttcttataggtgtaggttcttttaaaagtttggttgctgactagttagtgatatttatttataatgttcccgcgatgctatatggtgttgtggatttttgttgcgt

SEQ ID NO: 4778 - DNA, 1543 bp, Cichorium intybus
ctttatctcacaaaaaacgcacacatattcctcaactccacggcgtcgatccgaggagtttgagaaaccctaatcaaaagcttctactctttccctcaatctcctcaacacaaccagtcatggcgggcatagcaccagaaggatcccaattcgatgcgcgacaatttgactccaaaatgagcgagctgctttcagctgatggacaagactttttcacatcatacgatgaagtctatgacagtttcgatgccatgggtctccaagaaaatcttcttagaggcatatatgcatacggttttgaaaaaccatcagctatccaacaaaggggaatcgtcccattcaccaagggcctagatgtaattcaacaagcccaatccggaaccggaaaaaccgcaaccttttgttccggaatcctccaacaactcgattacaatgtagttgaatgccaagctttggtattggccccgacccgtgaacttgcacaacaaattgaaaaagtcatgcgggccctaggcgactacctcggtgtcaaagtccacgcatgcgttggtgggaccagtgtccgtgaagaccaaaggattctttcagccggggtccacgttgttgttggtacacctggacgcgtgtttgatatgttgcgtaggcaatcactacgcgctgactacatcaaaatgtttgttcttgatgaagctgatgaaatgctttcaagaggttttaaagatcagatatacgatattttccagttgttgccctcaaaggtccaagtcggggtgttttccgccacaatgccgccagaagctctggaaatcaccagaaaattcatgaacaaaccggtgaggattctggtcaaacgtgacgagttgactttggaaggaatcaaacagttttatgtaaacgttgaaaaagaagattggaagctggagacactatgcgacctttacgagactttagcaatcacacaaagtgtgattttcgtgaacacacggcgtaaggttgactggttgaccgataagatgaggagccgtgatcacacggtgtcagccacacacggtgacatggaccagaacacgagagatataatcatgcgcgagtttcgatccgggtcttcccgtgttcttattactactgatttgttggcacgtgggattgatgtgcaacaggtgtctttggttattaattatgatctgcctacacagcctgagaattatcttcataggattggtcgaagtggaaggtttgggagaaaaggtgtggccattaattttgtgacgttggaagatgagaagatgcttgcggatattcagaagttttataatgtggttgttgaggagctgccgtcaaatgttgctgatttgatttgaggggttcatggttggttgttgtttctcttgggttccgtgtttctttctttcttttaagttattcgaagattttgaagtttttgttttttgtagtaaggatttggaaccgtggttgtattttggagtactaattcccctgaattttatgggttagcttatccgttatgcttgcatttttgatc

SEQ ID NO: 4779 - DNA, 1612 bp, Vigna unguiculata
  misc_feature (1481)..(1481): n is a, c, g, or t
gtggaaagctctatttactgttttgccccttctttcctcgttcctataacactcccttctccctctcattcgcctccctttaactccacggtgcagatccgaggagttacccctttgctcttttttctctttccttattccaatatcaacccttcaagcttccaccagttatggcaggtttggctccagaaggaacacaatttgatggtcgccaatatgatgctaagatgactgaattgctgtccactgatgggcaagaattctttacctcttatgatgaagtctacgacagctttgatgcaatgggattacaagaaaatcttctgcgaggcatatatgcttatggttttgagaggccttctgcaatccagcaaagaggaattgttcctttctgcaagggtctggatgtgattcaacaggctcaatctggaacaggaaagacagcaacattctgttctggaattttgcagcagcttgattatggattggttcagtgccaggctttggttttggcaccaacaagggagctagcacagcagattgagaaagttatgcgagctcttggtgattaccttggtgttaaggttcatgcatgtgttggtggaactagtgtccgtgaggatcagcgcattctccaagctggtgtccacactgttgttggcactcctggccgtgtgtttgacatgctgcggaggcagtctctccgcccagattacataaagatgtttgttttggatgaggctgatgaaatgctttcacgaggtttcaaggatcagatctatgacatcttccagctgctgccatccaaaattcaggttggggttttctctgctacaatgccaccagaagcccttgagattacaaggaagttcatgaataagccagtgagaatcttggtaaagcgcgatgaactgaccctggagggtatcaaacagttttatgtcaatgttgacaaggaagagtggaagctagagacactatgcgacctttatgagactctggctatcacccagagtgtcatttttgtgaataccaggcgcaaggtcgactggctcactgataagatgcgaagcaatgaccacacagtctctgccacccatggtgacatggaccaaaacacacgtgacatcatcatgcgtgaattccggtccggctcgtctcgagttctcattaccaccgaccttctggcccgtggcattgatgtgcaacaagtgtccctggtcataaactatgatctgccaacccagcctgaaaactatctccaccgcataggccgtagtggccggtttggaagaaaaggagttgctataaactttgtcacagctgatgattccagaatgctgtctgatattcagaagttctacaatgtgactgtagaggagctgccatcaaatgttgctgatttgctctgatgagttaatttttgttctctgttaagtcatcaggcccttttctattgttatcttgtgctcattctctcnctctttatatattttatccacattagagatcaaagacatatgatctgatgctatttgtattggattctataaattttgtttaatcaatcaattaattagcaggttgttgtttgaagcctgcatttacttta

SEQ ID NO: 4780 - DNA, 1801 bp, Actinidia deliciosa
  misc_feature (28)..(28): n is a, c, g, or t
  misc_feature (1531)..(1531): n is a, c, g, or t
  misc_feature (1538)..(1538): n is a, c, g, or t
cttctctctctctctctagcctccgccntcgaattccgtcaactccgcggtgcagatccgaggagttgggaaactccagtccttcgtcaagctccagacccctctatctctctgcatcgatcatcaccgatctctctcatcccttgcagcatggcaggtttgacacccgaaggatcacaatttgatactcgtcaatatgataccaaaatgagtgagttattgtcaactgatggccaagatttcttcacatcatatgatgaggtttatgaaagttttgattctatgggattgcaagagaacctccttaggggaatctatgcttatggttttgaaaagccatctgcaatccaacaaaggggaattgttccattttgcaagggccttgatgttatacagcaggctcagtctggaaccgggaaaacagctactttctgctctggaatcttacagcaacttgattatagcttagtccaatgccaggcattggttttggcacccactagagaactcgcccagcagattgagaaggttatgcgagcacttggtgactaccttggtgttaaagttcatgcttgtgtaggtgggaccagtgttcgtgaggatcaacgcattcttcaaagcggtgttcatgttgttgttggcacccctggacgggtgtttgacatgttgcgaagacagtcacttcgccctgattacattaaaatgtttgtgttggatgaggctgatgaaatgctgtcacgaggttttaaggatcagatctatgatattttccagcttcttccatctaaagttcaagttggagtattctctgccacaatgccacctgaagctcttgagatcaccagaaagttcatgaacaagcctgtgagaatcttggtaaaacgtgatgagctcaccctcgagggtattaagcagttttatgttaatgttgaaaaggaagagtggaagcttgaaacactctgtgatctctatgagaccctggccatcacccaaagcgtcatttttgtgaacaccaggcgcaaggtcgactggctcactgacaaaatgcgcagccgtgaccacactgtctctgccacccatggagacatggatcagaacactcgggatattattatgcgtgaatttcgttctggttcctctcgtgttctcatcaccactgatctcttggctcgtggtatagacgtgcagcaagtctcccttgtcataaactatgacctgccgactcagcctgaaaattacctccaccgtattggacgaagtggaagatttggaagaaaaggtgttgccattaactttgtgactaaggaggatgagagaatgctgtttgacattcagaggttctataatgtggtggttgaagagctgccatcgaatgttgctgatctcctctaaacctagttcagtgaggtatggggtttctggtcaagcaaagtactagttagtgttactgctatttatgttttattttattttacttttggttctattgtcttagtttaatgttgcaaacatatctgactgcctaatgatntgtgccntgcacatttgcattatggtggttgagtgttaacttgctcatttccagctggtgtgggcatatgatatgcaagttttgttgcagataggttttgtaccgtattcctttttctttctctcttcctgtttgtttgattattggaagtattgtagtttggattggtttcctcatgtttaaggtgttttagtttaattatgagggctacattacgaagttggttaaagaggctttttatgttggtggctagacctactccaaaaagga

SEQ ID NO: 4781 - DNA, 1854 bp, Medicago truncatula
gaataatacgcatgtaagtttaaaactatatattcttataaattttaattttgaacaaaatcaaaataatagatatttatgaattttaaatcttaacaaactatatttatcttttattaaaattaatttaaattttatctttttcccaaaacaaaattttaaaaaaatattattaaagatcatcttataaagggatcatgggcatggccatgggaagggtaatcgtggaaagtcataattaattaatcactttccttttaccttttttcgaatatataaaaactcctttcattctcattcgtgtctctttaactccgatccgaggagtttcccctttcgctttctcttcattccttcactccgtgttccattctctcaacttttcaatactcttaaccagtgatggcaggtttggctccagaaggatcacaatttgatgctaatcattatgactctaagatgaatgaactgcttgccactgatgggcaagaattcttcacctcgtatgatgaagtatatgatagctttgatgcaatggggctgcaagaaaatcttctgcgaggcatatatgcttacggttttgagaggccttctgcgatccagcaaaggggaattgttcctttctgcaaaggtctggatgtgattcaacaggctcagtctggaactgggaagacagcaacattctgctctggaattttgcagcagcttgattatggattagttcagtgccaggccttggttttggccccaacaagggagctagctcaacaaattgagaaagttatgcgtgctcttggtgattttcttggtgttaaggtccatgcttgtgttggtgggacaagtgttcgtgaggatcagcgcattctccaagctggtgttcacactgtcgttggaactccagggcgcgtgtttgacatgttgcggaggcagtctctacgctcagagtgcataaagatgtttgttctggatgaagctgatgaaatgctttcacgtggtttcaaggatcagatctatgacatcttccagcaactgccaggcaaaattcaggttggagtattttctgctacaatgccacctgaagcccttgagattactaggaagttcatgaataagccagtgagaatcctcgtaaagcgtgacgagctgacccttgaaggtatcaagcagttttatgtcaatgtcgataaggaagaatggaagcttgagacattgtgcgacctctacgagactctcgccatcactcaaagtgtcatttttgtgaataccaggcggaaagtggactggcttacggataagatgcgaagcagagatcatacagtctcagccactcatggtgacatggaccagaacactagggatatcatcatgcgtgagtttcggtctggctcttctcgagttctcataaccaccgacctcttggcccgtggtatcgatgtgcagcaggtatctttggtcataaactatgatctaccaactcaacctgaaaactatctccaccgtataggtcgtagtgggcgatttggaagaaaaggtgtttcaattaactttgtaacaggagaagatgctagaatgttggctgatattcagaaattctacaatgtgactatagaggagctgccatcaaatgttgctgatttgctctgatgagttaatttttgttctctgttaaatcatctgggattttttttttcttctcttggaaaagttttgattttcttttttttttatttttattaaacttttatattttaacaattagagatcaaactcatctgatctgatactatttgtattggaattccatcaaatttgttttgattaattagttaagagggtgttattcaggtttcattt

SEQ ID NO: 4782 - DNA, 1511 bp, Medicago truncatula
ctcttcattccttcactccgtgttccattctctcaacttttcaatactcttaaccagtgatggcaggtttggctccagaaggatcacaatttgatgctaatcattatgactctaagatgaatgaactgcttgccactgatgggcaagaattcttcacctcgtatgatgaagtatatgatagctttgatgcaatggggctgcaagaaaatcttctgcgaggcatatatgcttacggttttgagaggccttctgcgatccagcaaaggggaattgttcctttctgcaaaggtctggatgtgattcaacaggctcagtctggaactgggaagacagcaacattctgctctggaattttgcagcagcttgattatggattagttcagtgccaggccttggttttggccccaacaagggagctagctcaacaaattgagaaagttatgcgtgctcttggtgattttcttggtgttaaggtccatgcttgtgttggtgggacaagtgttcgtgaggatcagcgcattctccaagctggtgttcacactgtcgttggaactccagggcgcgtgtttgacatgttgcggaggcagtctctacgctcagagtgcataaagatgtttgttctggatgaagctgatgaaatgctttcacgtggtttcaaggatcagatctatgacatcttccagcaactgccaggcaaaattcaggttggagtattttctgctacaatgccacctgaagcccttgagattactaggaagttcatgaataagccagtgagaatcctcgtaaagcgtgacgagctgacccttgaaggtatcaagcagttttatgtcaatgtcgataaggaagaatggaagcttgagacattgtgcgacctctacgagactctcgccatcactcaaagtgtcatttttgtgaataccaggcggaaagtggactggcttacggataagatgcgaagcagagatcatacagtctcagccactcatggtgacatggaccagaacactagggatatcatcatgcgtgagtttcggtctggctcttctcgagttctcataaccaccgacctcttggcccgtggtatcgatgtgcagcaggtatctttggtcataaactatgatctaccaactcaacctgaaaactatctccaccgtataggtcgtagtgggcgatttggaagaaaaggtgtttcaattaactttgtaacaggagaagatgctagaatgttggctgatattcagaaattctacaatgtgactatagaggagctgccatcaaatgttgctgatttgctctgatgagttaatttttgttctctgttaaatcatctgggattttttttttcttctcttggaaaagttttgattttcttttttttttatttttattaaacttttatattttaacaattagagatcaaactcatctgatctgatactatttgtattggaattccatcaaatttgttttgattaattagttaagagggtgttattcaggtttcattt

SEQ ID NO: 4783 - DNA, 1674 bp, Petunia hybrida
cacacacaaaacagtctcatctctattattttcctgaactcctgcggcgtagatccgaaggagtttcaggcaaaaacagccgtcttttttacaaaccctaatacaatcttctcctttttcctcagatcttttactcaatcaatcatggcaggcttagcaccagagggttctcaatttgacgctaaacagtatgatgccaagatgactgagctgcttggaacggaaaccacggagttcttcacatcatatgatgaagtttatgaaagttttgatgccatgggtttgcaagaaaaccttcttaggggcatctatgcttatggttttgagaagccatctgctatccagcaaaggggtattgttccattttgcaagggtcttgatgtgatccaacaggcacaatctggtactggaaagactgcaactttctgctctggaatcctccagcagcttgattacagcttagtcgaatgtcaagctttggttttggctccaacccgtgagcttgcacagcagattgagaaggttatgcgagcacttggtgactatctgggtgtgaaggttcatgcatgtgttggaggtaccagtgtccgtgaggatcagcgtatccttcaaagtggcgttcatgttgtggttggtactcctggccgtgtttttgacatgttgcgcaggcagtctcttcgccctgaccacatcaagatgtttgttcttgatgaggctgatgaaatgctctcaagaggtttcaaggaccagatttatgacattttccaactgctgccaccaaagattcaagtgggtgttttctctgccacaatgccaccagaggcccttgaaattactaggaagttcatgaataaacctgtcaggattcttgtgaagcgtgatgagctcactcttgagggtatcaagcaattttatgtcaatgttgaaaaggaagagtggaagcttgaaactctttgtgatctttacgaaaccttagccatcacccagagtgtcatctttgttaacaccaggcgtaaggttgattggctcactgataaaatgcgcagccgtgatcacacagtatccgcaactcatggagacatggaccagaacactagagatatcattatgcgagagttcagatctgggtcgtctcgtgtgctcatcactactgatcttctggcacgtggtattgatgtgcagcaagtatcccttgtgattaactacgaccttccaactcagccagagaactacctgcatcgtattggtcgtagtggacgatttggaaggaagggtgttgctatcaactttgtcacaaaggatgatgaaaggatgctttttgacattcagaggttttacaatgttgtaatcgaggagctgccagccaatgtagccgatctcctgtaatgcggttttggttctggttctgtgaggtgaattcttctttatattaagtaatttaatatcttattcttaggttagcaagaattgggaagtgcaggtgctgtgattcgccatgggacttgtaattttacaatttggtcggacttatttactttgcaaattttgttggtttgtctttttgtattgcaagtgcaaaataacttcaggttttggatgttctttgaatttactttattgatattattaactattgaccattgtttttgtgtacggggaaggcttttagaggca

SEQ ID NO: 4784 - DNA, 1827 bp, Populus trichocarpa
aaaaaaatcccttgattagggtcataatttaagcaagcccgtctccgtatcgtttcctcacatcacagtgctgctatcgatctaactatctaatcaaacagagtgttccttgaaactcctccaaaacaaactacaaaaagatccgaggagtttgtggattctcaatcaaatcttctatctcttttctcttatcaatcatcactttttttcagtcatggctagttcggcacctgaaggatcccagtttgatgctcgtcaatttgattctaggatgaatgagctgctcacagctgaaggacaggatttctttacctcctatgatgaggtgcatgaaacttttgatgctatgaatttgaaggagaaccttctgaggggtatttacgcatatggttttgagaagccatctgcaattcagcaaagagggattgtcccattctgcaagggacttgatgtaatccaacaagcacaatcaggaactggaaagacagctacgttttgctctgggattttgcagcagcttgattatgatatagttgaatgccaagcattggttcttgcacctacccgagaactagctcaacagattgaaaaggttatgagagcactaggtgattatctgggtgtgaaggttcatgcttgtgttggtggaaccagtgttcgtgaggatcagcgtattctctcagctggggttcatgttgtagtcggtactcctggtcgtgtgtttgacatgttgcggagacaatcacttcgccctgactatatcaagatgtttgtattggatgaagcagatgaaatgctctcaagaggattcaaggatcagatatatgatattttccaattactgcccccaaagattcaggttggggtcttctctgctactatgccacctgaggccctagaaattacgaggaagttcatgaataaacctgtgaggattttagtgaagcgtgatgagcttacccttgagggtatcaagcaattctatgttaatgttgacaaggaggaatggaagcttgagacactttgtgatctatatgagaccttggcaataacccaaagtgttatctttgtgaacaccaggcgcaaggtggattggctcacagacaagatgcgcagtcgtgatcacacagtctctgccactcatggagatatggaccaaaacacaagggacattattatgcgagaattccgctctggttcctctcgtgtgctgatcactactgatctgttggcccgtggtattgatgtccagcaagtctcacttgtgatcaattatgatctccctacccagccagagaactacctccatcgtattggtcgtagtggacgttttggaaggaagggtgttgctataaactttgttaccagggatgatgaaagaatgctttctgacatccagagattctataatgtaacggttgaggagctgccatcaaatgttgctgatcttctttgaagcaattttggttcaccaaggtaaatggctgagcttggaagttaaaactattatgctgtttgcagttttggggcctctatttagcatggattggactagccctgcaggtttggttctgagcatttgagattggggtcaatcccatttcgggtgcagaagtcccatgtgttaaattttgttgcaagtttgtttttgctttttcctttttgtgtcggagtaaaatttgcagaattatggtagtcaatcataatattttactctctgcgtggttttttattttatgcaagggaatttcatgtaggtaaaaaacttatgataaagtcattatgttataatattgggctctccgttgctgttctcttgagcaattt

SEQ ID NO: 4785 - DNA, 1660 bp, Glycine max
ttgttctaacagttcccactcactttctcaaaaacgcattgtgtctctctttctgcggcgtagatctgagcagtttgggaaaccctaactgctctcaccactctctttgcttttttttctctccgatcaacgacctctttcttcgccctaagtcatggcaggacttgcacccgagggatcacagtttgatgctcgtcaatatgataccaagatgaatgagttgcttacatctgatggacaggattttttcacatcttatgatgaggtttatgacagttttgatgctatgggcttgcaagagaatctcctgagaggcatttatgcatatggttttgagaagccatcagctattcagcagagaggaatagttcctttctgcaagggacttgatgttatacaacaggcccagtctggaactgggaagacagcaactttctgctctggaattctgcagcaacttgactatagtgtgactgaatgccaagccttggttttagcacctactagggagcttgctcagcaaattgaaaaggttatgcgagcacttggagattatcttggtgtgaaggtgcacgcatgtgtgggaggtaccagtgttcgtgaagaccaacgcattctatcgagtggtgttcatgttgttgttggtactcctggtcgtgtatttgatatgctgcgcagacagtcacttcggccagactacatcaagatgtttgtattggatgaggctgatgaaatgctttcccgtggttttaaagatcagatctatgatatattccagttgcttccatctaagattcaagtgggagttttctctgctacaatgcctcctgaggcacttgagatcacaaggaagttcatgaacaaacctgtgaggatccttgtgaagcgtgatgagctcaccttggagggtatcaagcaatttcatgtcaatgttgagaaagaggaatggaagcttgacacactatgtgatctttatgagacattggcaattactcagagtgtcatttttgtgaacaccagaagaaaggttgattggctgactgacaagatgcgaagccgagaccacacagtctcagcaacccatggagacatggaccaaaataccagggacattattatgcgtgaattccgttctgggtcgtcccgtgttttaataactactgatcttttggcccgtggtattgatgtccagcaagtgtctctagttataaattatgatctcccaacacagcctgagaactatctccatcgtattggtcgtagtggaaggtttggtaggaaaggtgttgccattaactttgtcacaagggatgatgaaaaaatgctgtttgacatccagaagttttacaatgtgattattgaggagctgccttcaaatgttgctgaactcctttgatgagtttttttgttccatcatattagagggaagttggtttctgaggtaagtgttatgtaatgtttcttgttcctttttgccccttttgttgtatttctgctcttaaaccttgtttgaccttcttaataggtgtagtaatttaatttacatatcagtcgtctgaatgtcccaagtgatgagtacttgcaatgtggaatcacattattttctgaattgatgtattggtagttgttgcacctttctaacaagcaaggttttttttca

SEQ ID NO: 4786 - DNA, 1695 bp, Glycine max
acacacacatactcgcttccctctctctgcgttcggcaccagcgaaacgctcttcgttatctttttctcgactccgcggcgtagatccgaggagttcgggaaaccctaactcatcttccttcacaacagaacaacgcttcttttccctatccatcatctcaactgaagtcatggctggactagcacctgaggggtcacagttcgatgctcgtcaatatgattccaaaatgagtgacttactttcatctgatggacaggacttcttcacatcctatgacgaggtttatgatagttttgacgctatgggtttgcaggagaatcttctcaggggaatttacgcatacggttttgagaagccatcagccattcagcaaagggggatagttcccttctgcaagggacttgatgttattcaacaggctcaatctggaactgggaagacggctactttctgctctggtattctgcagcaacttgactatagcttgactcaatgccaggccttggttttggcaccaactcgtgagcttgctcagcagattgagaaagttatgcgggcacttggagattatcaaggtgtgaaggttcatgcttgtgtgggaggtaccagtgtgcgtgaggaccagcgcattctatctagtggtgttcatgttgtggttggtacccctggtcgtgtgtttgatatgctgcgccgacagtcacttcagccagaccacatcaagatgtttgtattggatgaggctgatgaaatgctttcccgaggtttcaaggatcagatctacgatatatttcagctgcttccatctaagattcaagtgggagttttctctgccacaatgcctcctgaggcccttgagatcaccaggaagtttatgaacaaacctgtgaggatccttgtgaagcgtgatgagctcaccttggagggtattaagcaattttatgtcaatgttgaaaaggaggaatggaagctggacacactctgcgatctttatgagacattagctatcactcagagtgtcatttttgttaacaccagaaggaaagttgattggttgactgacaagatgagaagccgtgaccacacagtctcagcaacccacggagacatggaccagaataccagggacattattatgcgtgaattccgttctgggtcttcccgtgtcttgataaccactgatcttttggctcgtggtattgatgtccaacaagtgtctctagttataaattttgatctcccaacacagcctgagaactatctccatcgtattggtcgtagtgggaggttcggaaggaagggtgttgcgatcaactttgtcacaaaggatgacgagaaaatgctgtttgacatccagaagttttacaacgtgcaagttgaggagctgccttcaaatgttgctgagctcctttgatcagattttgtcatccgtcgtattagatgaaattagtttgcgttttggaaactgttatgcaatgtttctcgctccccctttcgtttctttggttgtacttctgctcttaaactttgtttaataggcttagtaatttatgttaaattgtgagtttgtctgaatatccaagtaattattacttgctatgtggaaacccattattggcccaattggtgtacgactttcattgcatattcgattcttatgcaatcaacttagttcagttgtaatttggtcactaaat

SEQ ID NO: 4787 - DNA, 1655 bp, Glycine max
gtttgttctcatagctcccactcactttctcgcagaaacgtattgtttttctctctttccgcggcctagatctgagcagtttggaaaccctaactgctctcaccaacgacatcaccactctctccgatcaactacctctttcgtcgccctaagtcatggcaggaattgcacccgagggatcacagtttgatgctcgtcaatatgataccaagatgaatgagctgcttacgtccgatggtcaggatttcttcacatcctacgatgaggtttatgacagttttgatgctatgggcttgcaagagaatctcctgagaggcatttatgcatatggttttgagaagccatcagctattcagcaaaggggaatagttccattctgcaagggacttgacgttatacaacaggcccagtctggaactgggaaaacagcaactttctgctctggaattctgcagcaacttgactatagtgtgactgaatgccaagccttggttttagcaccaactagggagcttgctcagcaaattgaaaaggttatgcgggcactcggagattatcttggtgtgaaggtgcacgcatgtgtgggaggtaccagtgttcgtgaagaccaacgcattctatcaagtggtgttcatgttgttgttggtactcctggtcgtgtatttgatatgctgcgcagacagtcacttcggccagactatatcaagatgtttgtattggatgaggctgatgaaatgctttcccgtggttttaaagatcagatctatgatatattccagttgcttccatctaagattcaagtgggagttttctctgctacaatgcctcccgaggcacttgagatcacaaggaagttcatgaacaaacctgtgaggatccttgtgaagcgtgatgagctcaccttggagggtatcaagcaatttcatgtcaatgttgagaaagaggaatggaagcttgacacactgtgtgatctttatgagacattggcaattactcagagtgtcatttttgtgaacaccagaagaaaggttgattggctgactgacaagatgcgaagtcgagaccacacagtctcagcaacccatggagacatggaccagaataccagggacattattatgcgtgaattccgttctgggtcatcccgtgttttgataactactgatcttttggcccgtggtattgatgtccagcaagtgtctttagttataaattatgatctcccaacgcagcctgagaactatctccatcgtattggacgtagtggaaggtttggtaggaaaggtgttgccattaacttcgtcacaaaggatgatgaaaaaatgctgtttgacatccagaagttttacaatgtggtaattgaggagctgccttcaaatgttgctgaactcctttgatgagtttttgtgttccatcatattagtggaaagttggtttctgaggtaagtgttatgtaatgtttttctttttttgggcctttttgttgtatttctggttttgaactttgtttaaccttttaggtaggtgtagtaatttaatttacattattaatcgtctgaatgtttgaagtgataagtactttgtgatgtgaaatcccattattagtcgaattagtgtattggtcgttgttgcacctttctaacaagcaaggtttt

SEQ ID NO: 4788 - DNA, 1675 bp, Fragaria vesca
  misc_feature (1538)..(1538): n is a, c, g, or t
  misc_feature (1627)..(1630): n is a, c, g, or t
  misc_feature (1633)..(1633): n is a, c, g, or t
  misc_feature (1643)..(1643): n is a, c, g, or t
  misc_feature (1675)..(1675): n is a, c, g, or t
agtcttattgctgctgctgcgttccctcaactcctcacaaccaaatcacagagatccgaggagttcaggaaaaccctaactctcaactcagtcgccgactctcttacttctccgacctctcaactctctcgctttcagtcatggctggcgctgcaccggaagggtctcagtttgatactcgtcaatacgatgccaaaatgaccgagctacttggatctgatggacaagatttcttcacctcgtatgacgaggttcatgacagttttgatgtcatgggactgcaggaaaaccttcttaggggaatctatgcatatggttttgagaagccctctgcaattcagcaaaggggaattgttcccttctgcaagggacttgatgttatccaacaggcacaatctggaactggaaaaacagccactttctgctctggaattttgcagcagcttgattatgccatgctcgactgccaggcattagttcttgcacctacccgagaacttgctcaacagattgagaaggttatgcgggctctcggtgactacctcggtgtcaaggttcatgcttgtgttggtgggactagtgtccgtgaagatcaacgtgttctctctagcggagtccatgttgttgttggtacacctggccgagtctttgacatgttgcggaggcagtctctccgtccagattgcattaggatgtttgtgttagatgaagctgatgaaatgctctcaagaggtttcaaggatcagatctatgacattttccagctgctcccacccaaaattcaggtgggtgttttttctgccacaatgccaccagaagcccttgatatcaccaggaagttcatgaacaagcctgtgagaattttggtgaaacgtgatgagctcactcttgagggtattaagcagttccatgtcaatgttgacaaggaagagtggaagcttgaaacgctttgcgatctttatgagaccttggcaatcacccagagtgtcatctttgtgaacaccaggcgcaaagttgattggctgacagacaagatgcgcagccgtgatcacacggtctctgccacccatggtgacatggagcaaaacactagggacatcatcatgagagagtttaggtctggttcttctcgtgtgctcatcacaactgatctgttggcccgtggtattgatgtccagcaggtgtctcttgtgattaactatgaccttcctacacagccggaaaactacctgcatcgtattggtcgtagtggtaggtttgggaggaagggtgttgccatcaactttgtgaccaaggatgatgaaaggatgttgtttgacatccagaagttctacaatgtcgtaattgaggagctgcctgctaatgttgctgatcttctgtaagcaaggttttggtttggtgtggtaattggctttgtaattcagaaagccatatttattttcctccttgtaggtgtaagggctgttatttagcatggattacttgaaactggggtagtggtcctgtccgtttgtgactggattccatccccatttcangtgtggataaaccacttaaaaattttgtttagtattcgagacaagtttgcagtattaacttattttggattgcccttattgttctaagnnnnggntacgaggtanatattatgtagaaatttctcattgtttgtttn

SEQ ID NO: 4789 - DNA, 1250 bp, Manihot esculenta
tcatggccggacttgcaccagaaggatcccaatttgatgcgaagcactatgatgccaaaatgaatgaattactcacaactgaaggagaggattttttcacatcatatgatgaagtttatgatagttttgattctatgggtttgcaagagaatctcctaaggggcatttatgcatacgggtttgaaaagccatctgcaattcagcagagaggaattgttcccttctgcaatggacttgatgtgattcaacaggctcaatctggaacagggaaaactgcaactttctgttctggtattctccaacaactagattatggtttggtggaatgccaagccttggtcctggcacccactcgggagcttgcacaacagattgagaaggttatgcgagcacttggagattatcttggtgtcaaggtgcatgcttgtgttggtggaaccgttgttcgtgagtctcaacgcatcctgtcaagtggagtgcatgtagttgttggcactcctggtcgtgtatttgatatgctgcaaagacagtcacttcgtcctgattgtatcaagatgtttgtgttggacgaggctgatgaaatgctttcacgcggtttcaaggatcagatctatgatattttccagcttctgccatcaaaaattcaagttggtgtattttcagccacaatgccacctgaggcactagagatcacaagaaagtttatgaacaaacctgttagaattcttgtgaagcgtgatgagctcaccttggagggtataaaacagtttcatgtcaatgtggagaaggaggaatggaagcttgagacactatgtgatctttatgaaaccttagccattacccaaagcgttatttttgtgaacactagacgcaaggttgattggctgacagacaagatgcggagtcgagaccacacagtttctgccacgcatggtgacatggaccagaacacaagagacattatcatgcgtgaatttcgatctggatcatctcgtgttctaatcaccactgatcttttggctcgtggcattgatgtccaacaagtctcccttgttataaattatgatctccctacacaaccagagaattatctccatcgaattggccgtggtggacggtttggaaggaaaggtgttgcaatcaattttgtgactagagatgatgaaaggatgctgtttgacatccagaggttctataatgtggtgattgaggagctgccatcaaatgttgccgatctcctctagtgagat

SEQ ID NO: 4790 - DNA, 1646 bp, Pisum sativum
caacaacaaaacgctctttgctctctctctttcctcaactccgcggcttagatctgaggagttttggaaaccctaatccaccgttctcgtcatcaacctcaccgcgctttttctctccgatcatctactttttcacatccttaagtcatggcaggagttgcaccagagggttctcagtttgatgctaagcaatttgataccaaaatgaatgagttactcaccactgaaggacaggacttctacacattttatgaggaggtttatgatagttttgatgctatgggcttgcaagagaatcttctcagaggaatttatgcatatggttttgagaagccatcagctattcagcaaaggggaatagttccattttgcaagggacttgatgttatacaacaggctcagtctggaacgggaaagaccgctaccttctgctctgggattctgcagcaacttgactacagtgtaacagaatgccaggccttggtcttggcaccaacacgtgagcttgctcagcagattgagaaggttatgcgggcacttggagattatctaggtgtgaaggtgcatgcttgtgtgggagggaccagtgttcgtgaggaccaacgtattctgtcaagtggtgttcatgttgttgtaggtacccctggtcgtgtatttgacatgctgcgcagacagtcgcttaggccagattacatcaagatgtttgtattagatgaggctgatgaaatgctttctcgtggttttaaagaccagatctacgatatattccagctgttgccatctaagattcaagtgggggttttctctgccacaatgcctcctgaggcgcttgagatcacaagaaagttcatgaacaaacctgtgaggattcttgtgaagcgtgatgagcttaccttggagggtattaagcaattttatgtcaatgttgataaagaggaatggaagcttgacacactctgcgatctttatgagacattggctatcacccagagtgtcatttttgtgaacaccagacggaaagttgattggctaactgacaagatgcgaagccgtgaccatacagtctcagcaacacacggagacatggaccagaatactagagatattattatgcgggaattccgttctggatcttcccgtgttttaataactactgatcttctggctcgtggtattgatgtgcagcaagtgtctttagttataaattatgatctccccacacaacccgaaaactatctccatcgtattggtcgtagtggaaggtttggtaggaaaggtgttgcaattaactttgtcacgaaggatgatgaaagaatgctgggtgacatccagaagttctacaatgtgttgattgaggagcttccttccaatgtggctgaacttctgtgatgaaatttttcttccatcatactagaaggaagttggtttctgaggtaagttatatgtaatgtttcccacctttttgccctgtttgttgtatttctgttttgaaaccttgtttggcctttttaataggtgtagtaattttatttacattttcagttgtccaaacatcctaagtgataagtacttacaacgtggaatccattattgtctgaattggtgtattgatggttgtttcacctttcaaaaaaaaaaaaaaaaaa

SEQ ID NO: 4791 - DNA, 1441 bp, Artemisia annua
gcaccagaaagttctcagtttgatactcgtcagtttgactccaaaatgaatgagctgctctcaaccgacgggcaggacttctttacatcttatgacgaggtttatgatagttttgatgctatgggtctacaagaaaaccttttgaggggcatctatgcttatggttttgagaagccatctgcaattcaacaaaggggtattgttcccttcaccaagggtcttgatgttattcaacaagctcagtctggaaccgggaagactgctactttctgctctggtatccttcaacagctcgactacagcgttgtggagtgccaagcgttggttctagctcctactcgtgagcttgcacagcaaattgagaaggttatgcgagcacttggtgactaccttggtgtgaaggtacatgcttgtgttggtggaaccagtgttcgtgaggaccaacgtatcctctcagctggtgttcatgttgttgttggtacccctggtcgtgtctttgacatgctccgaaggcagtctcttcgttctgattacatcaagatgtttgtgctcgatgaggctgatgaaatgctttcaagaggtttcaaggaccagatttacgatatattccagctgttgccttcgaaggttcaggttggagtgttctctgctactatgcctcctgaggctctcgagatcacaagaaagttcatgaacaaacctgtgaggattcttgtgaagcgtgatgaactcactcttgaaggtatcaagcagttttatgtcaatgtcgaaaaagaagaatggaagcttgagaccctctgtgatctttacgagaccttggccatcacccaaagtgtcatcttcgtgaacacccggcgaaaggtcgattggttgacagacaagatgagaagccgagaccacactgtctcagccactcacggagacatggaccaaaacactagagacatcatcatgcgtgagttccgttctggatcttcacgtgttttgatcaccactgatcttttggctcgtggtattgatgtccaacaagtgtctcttgttatcaactacgatcttccaacccagcctgaaaactacctccatcgtattggtcgaagtggaaggtttgggagaaagggtgttgctattaacttcgtgactttggatgatgaaaggatgcttgcagatatccagaaattctacaatgtggttgtcgaggaacttccatcaaatgttgctgatcttatatagaaaaagattttgggtttgtggttgtgttcagtaagaaaggttagaacctgtttttttgatatctatcggttttgtttgtcttaagatactactattattgtcagacttggtgctaaaagataattgcaactcgtgcttgtactcttaaagttttatgttaccccgaagtgtatggatttatttatttttatcttctggtacaaaaaaaaaa

SEQ ID NO: 4792 - DNA, 1529 bp, Artemisia annua
ccttcctcaactccacggcgatccgaggagtttgagaaaaccctaatcaatcttctttcaaatctcttaacaaccaatcaatcagtcatggcaggtgttgcaccagaaggatctcaatttgatgctcgtcagtatgactccaaaatgagcgatttgctttcagctgatggacaggactttttcacatcatatgacgagtcatatgatacctttgatagtatgggtcttcaagagaatcttttgaggggcatttacgcctatggttttgaaaagccatcagctattcaacagaggggaattgtcccattcaccaagggtcttgacgttattcaacaagcacaatctgggacaggaaagactgctactttttgctcgggtatccttcaacaacttgattacaatgttgttgaatgccaggctttggttctagcacctactcgtgagcttgcccagcagattgagaaagtcatgagggcactcggtgactaccttggtgttaaggttcatgcttgtgttggtggaaccagtgttcgtgaggaccagcgtattctctcagctggtgtgcatgttgttgttggtactcctgggcgtgtgtttgacatgttgcgcaggcagtcgctacgttctgactacatcaaaatgtttgtgctggatgaagctgatgaaatgctctcaagaggtttcaaagaccagatttatgatatattccagctgttaccctcaaaggttcaagttggagtgttctctgcgacgatgccaccagaggcccttgagatcacgagaaagttcatgaacaaaccagtgagaattcttgtgaagcgtgatgaactcaccttggaaggtatcaagcagttctacgtgaatgtggaaaaagaagagtggaagcttgaaaccctctgtgatctttacgagactttggccatcacccaaagtgtcatcttcgtgaacacacgaagaaaggtcgactggttgactgacaagatgagaagccgagaccacactgtctctgccacacacggagacatggatcagaacactcgtgacatcatcatgagggagttccgttctggctcatctcgtgttctcatcaccactgatctgttggcacgtggtattgatgtgcaacaagtttcacttgttatcaactatgatcttcctacccaacctgagaactatcttcaccgtatcggtcgtagtggacgatttggaagaaagggtgtggctatcaactttgtcactttggatgatgagaagatgcttggtgatattcagaagttttacaatgtggtggtcgaggagctgccctcgaatgttgctgatctgatttgagttgaaagatttggttggtctctgttttgccggttttgaatttgatcgtttattttgttctgtctttaagttattgaaagatcgttggagttcgtcttttgatggtaggatttggaattatgtttgtaccgttaagttataaattcttgggattgtatgggttagtttattcgtttgaattccatctttcagtatgcttg

SEQ ID NO: 4793 - DNA, 1553 bp, Artemisia annua
  misc_feature (1538)..(1538): n is a, c, g, or t
cttccttcctcaactcccggcgatccgaggagtttgagaaaaccctaatcaatcttctttaaaatctcttaacaaccaatcaatcagtcatggcaggtgttgcaccagaaggatctcaatttgatgctcgtcagtatgactccaaaatgagcgatttgctttcagctgatggacaggactttttcacatcatatgacgagtcatatgatacctttgatagtatgggtcttcaagagaatcttttgaggggcatttacgcctatggttttgaaaagccatcagctattcaacagaggggaattgtcccattcaccaagggtcttgacgttattcaacaagcacaatctgggacaggaaagactgctactttttgctcgggtatccttcaacaacttgattacaatgttgttgaatgccaggctttggttctagcacctactcgtgagcttgcccagcagattgagaaagtcatgagggcactcggtgactaccttggtgttaaggttcatgcttgtgttggtggaaccagtgttcgtgaggaccagcgtattctctcagctggtgtgcatgttgttgttggtactcctgggcgtgtgtttgacatgttgcgcaggcagtcgctacgttctgactacatcaaaatgtttgtgctggatgaagctgatgaaatgctctcaagaggtttcaaggatcagatttatgatatattccagctgttaccctcaaaggttcaagttggagtgttctctgcgacgatgccaccagaggcccttgagatcacgagaaagttcatgaacaaaccagtgagaattcttgtgaagcgtgatgaactcaccttggaaggtatcaagcagttctacgtgaatgtggaaaaagaagagtggaagctcgaaaccctctgtgatctttacgagactttggccatcacccaaagtgtcatcttcgtgaacacacgaaggaaagttgactggttgactgacaagatgagaagccgagaccacactgtctcagccacacacggagacatggatcagaacactcgtgacatcatcatgagggagttccgttctggctcatctcgtgttctcatcaccactgatttgttggcacgtggtattgatgttcaacaagtttcacttgttatcaattatgatcttcctactcaacctgagaactatcttcaccgtatcggtcgtagtggacgatttggaagaaagggtgtggctatcaactttgtcactttggatgatgagaagatgcttggtgatattcagaagttttacaatgtggtggtcgaggagctgccctcgaatgttgctgatctgatttgagttgaaagatttggtcggtctgttttgccggttttgaatttgatcgtttattttgttctgtctttaagttattgaaagatcgttggagttcgtcttttgatggtaggatttggaattatgtttgtacccttaagttataatttcttgggattgtatgggttagtttattcgtttgaattccatctttcagtatgcttgcaattttgntcgaaatttgatttt

SEQ ID NO: 4794 - DNA, 1621 bp, Phaseolus coccineus
acttcgccgcctggttcaccttctttatcttttctcgactccgcggcgtagatccgaggagttcgggaaaccctaactctactcacaccctcccttttccctctccgtcttctccacaccaagtcatggctggacttgcgcctgaggggtcgaatttcgacacgcgtcactttgattccaaaatgagtgacctgctgtcttctgatgggcaggacttcttcacgtcctatgatgaggtttttgaaagttttgatgctatgggattgcaggagaatcttctgaggggcatttacgcatatggttttgaaaagccatcagccattcagcaaagggggatagttcccttctgcaagggacttgatgttattcaacaggctcagtctggaactgggaagacagctactttctgttccggtattctgcagcaacttgactatagcttgacgcaatgccaggccttggttttagcaccaactcgtgagcttgctcagcagattgaaaaggttatgcgggcacttggagattatcttggtgttaaggttcatgcttgtgtgggaggtaccagtgtccgtgaagaccaacgcattttgtccagcggagttcatgttgtggttggtacccctggtcgtgtttttgatatgcttcgtaggcaatcactccaacctgataatatcaagatgtttgtattggatgaggctgatgaaatgctttcccgaggttttaaggatcagatctatgatatattccagctgctgccatctaagattcaagtgggagttttctcagccacaatgcctcctgaggcccttgagatcacaagaaagttcatgaacaaacctgtgaggatccttgtgaagcgtgatgagctcaccttggagggtataaagcagttttatgtcaatgttgacaaagaggaatggaagctggacaccctctgtgatctttatgagacgttagcaatcacccagagtgtcatttttgtgaacacaagaaggaaagttgattggttgactgacaaaatgagaagccgtgaccacactgtctcagcaacccatggagacatggaccagaataccagggacattattatgcgtgaattccgatctggttcttcccgagtcttgattactactgatcttttggcccgtggtattgatgtccaacaagtgtctctagttataaattatgatctccctacacagcctgagaattatctgcatcgtattggtcgcagtggaaggtttggcaggaaaggtgtggctatcaactttgtcacaaaggatgacgataaaatgctgttcgacatccagaagttttataatgtggtagttgaggagctgccttcaaatgttgctgagctcctttaatcagattttgtcctccatcgtattagatgaaaattagtttgcgtttggaaaatgctatgtaatgtttctctccccctcccaactttcttccgttgcacttttgctctgaaacttggtttaataggctcttagtattttaatttatgacttgcgttgtggaaacccattattggcccagttggtgtattggttgtccttgcacatttttactaggcaacttttctagcgaaccttttaattttactaaattttag

SEQ ID NO: 4795 - DNA, 1558 bp, Zingiber officinale
  misc_feature (772)..(772): n is a, c, g, or t
  misc_feature (1111)..(1111): n is a, c, g, or t
  misc_feature (1237)..(1237): n is a, c, g, or t
  misc_feature (1250)..(1250): n is a, c, g, or t
gcacgagggttgctcccgcccgatctcgcgctcatcaagtcgatttctcctccctgcttcctcgatctagcgatcagatatggctggacaggcaccagaaggatcacagtttgatgctcgccaatatgataccaaaatgaatgagctgctaaatgctgatgggcaggactttttcacatcttatgatgaagtctatgaaagctttgatgatatgggtcttcaggagaatcttcttagaggcatttatgcctatggttttgagaagccctcagcaattcagcaaagaggaattgttcccttttgcaagggactagatgttattcagcaagcacaatcagggaccgggaaaaccgccaccttttgttctggtattctgcagcagcttgattatggtctggttcaatgccaagccttggttcttgctccaactagagaattagcccagcaaattgagaaggtcatgcgagcacttggtgactaccttggtgtaaaagttcatgcttgtgtcggaggaacaagtgttcgtgaggaccagcgtattctttcaagtggggttcatgttgtggtgggcactcctggtcgtgtttttgacatgttgaggaggcagtctcttcgccctgattatattaaaatgtttgtcttggatgaggctgatgaaatgctttcacgtggcttcaaggatcagatctacgacatcttccagctacttccttcaaagattcaggttggagtcttttctgccacaatgccacctgaagccctggagatcacncggaagttcatgaacaaacctgttaggattcttgtgaagcgcgatgaactcaccctcgagggtattaagcagttctatgtgaacattgagcaggaagattggaaactagataccctctgtgacctctacgagacactggccatcactcaaagtgtcatcttcgtcaacacccgccgcaaggtcgactggctcactgacaaaatgaggagcagagatcacaccgtctcagccactcacggcgacatggaccagaacaccagggacatcatcatgcgtgaattccgctcaggctcctctagagtcctcatcacaactgacctgcttgcccgtggtatcgangtccagcaagtctcactcgtcataaactacgatctaccaacgcagccagagaactacctccacaggatcggacgaagtggacggttcgggagaaagggtgtggcgataaactttgttgtccgtgangatgagaggatgntgtatgacatccaaaagttttacaacgttgtgatagaggagctgccttccaatgtcgctgatctcatctgagcctagaactgctgaagcgatagctggggttatttatgcactggtaggcctccatcagaaggcaggcctgttttgttttgttttttaattaagctctatctattttcagtggtaagaattgcgctttttgttttttgttttctttaacagtaatttgaaacaagtatgaaacttttagcttgtcttgtgagagctgttgaggactcttgtgagaggcaagtttaatgaatatttttg

SEQ ID NO: 4796 - DNA, 1693 bp, Prunus persica
tacattgttgccttcctcaactcctccatccaaaaaattataaagagatccgaggagtttgggaaaccctaaccctaaacacaatctacagcccgctatctaaacttcccacttcgtcgaactctctcactgccgctttcagttatggctgctgtggcaccggaaggatcccaatttgatgctcgtcagtatgatgctaaaatgagtgagttacttggagctgatgggcaagaattcttcacatcatatgatgaggttcatgagagctttgatgctatgggattgcaggagaaccttcttaggggcatttatgcatatggttttgagaagccctctgcaattcagcaaaggggaattgttcctttctgcaagggacttgatgtgattcaacaggcacagtctggaactggaaaaactgcgactttctgctctggaattctgcagcagcttgattatgccttacctgattgccaggcattggttcttgcacccacacgagaacttgctcaacagattgagaaggttatgcgagcactgggggactatcttggtgtcaaggttcatgcttgtgttggtgggaccagtgttcgtgaagatcaacgcattctctccagtggggtccatgtcgttgttggtacacctggtcgtgtatttgacatgttacggagacagtctcttcgtccagattacattaagatgtttgtcttagatgaagcagatgaaatgctttcacgaggtttcaaggatcagatctatgacattttccagctgctaccatcgaaaattcaggtgggggttttctctgccacaatgccaccggaggcccttgacatcactaggaagttcatgaataaacctgtgaggattttggtgaaacgtgatgagctcacccttgagggtatcaagcaattccatgtcaatgttgataaagaggaatggaaacttgagacactttgtgatctttatgagaccttggcaattactcacagtgtcatctttgtgaacaccaggcgcaaagttgattggctcactgacaagatgcgcagccgcgatcacacagtctctgccacccatggagacatggaccaaaacacaagagacattatcatgagagagtttcggtctggttcttctcgtgtgctcataacaactgatctcttggcccgtggtattgatgtccagcaggtctctttagtgattaattttgatcttccaacacaaccggaaaactacctccaccgcattggtcgtagtggtcgtttcgggaggaagggtgttgccatcaattttgtgaccaaggatgacgacaggatgttgtttgacatccagaagttttataatgttgtgattgaggagctgccggcaaatgttgctgatctgctttaaataaggttttgctttggtgcggtaattggcttctaatttggaagccatatttattttcttccttgtaggtgtagggggccattatttagcatggatcacttgaatctggggtatggacctgtgcataagagacgggcttccattcccatttttcaggtgtgcaaaaaccacatgaaaattttgttgcatttcttgtatttctagtatgtgagacaacttgcagcagtaactgtgtttggattgatttgttttaagtttggttctgagatggaatattatgtttggagtcaaaaaaaaacctgcagcc

SEQ ID NO: 4797 - DNA, 1642 bp, Glycine max
atctcttcatacactcacttccctctctaagttcggcaccagcgaaacgctcttcgttatcttttctcagactccgcggcgtagatccgaggagttcgggaaatcctaactcatcatctcaactcaagtcatggctggacttgcacctgagggatcacagttcgatgctcgtcaatatgattctaaaatgagtgacttactttcatctgatggacaggacttcttcacatcctatgacgaggtttatgatagttttgacgctatgggtttgcaggaaaatcttctcaggggaatttacgcatatggttttgagaagccatctgccattcagcaaagggggatagttcccttctgcaagggacttgatgttattcagcaggctcagtctggaactgggaagacggctactttctgctctggtattctgcagcaacttgactatagcttgacgcaatgccaggccttggttttagcaccaactcgtgagcttgctcagcagattgagaaggttatgcgagcacttggagattatctaggtgtgaaggttcatgcttgtgtgggaggtaccagtgtgcgtgaagaccaacgcattctatctagcggtgttcatgttgtggttggtacccctggtcgtgtgtttgatatgctgcgcagacagtcacttctgccagatcacatcaagatgtttgtattggatgaggctgatgaaatgctttcccgaggttttaaggatcagatctacgatatatttcagctgctgccatctaagattcaagtgggagttttctctgctacaatgcctcctgaggcccttgagatcactaggaagtttatgaacaaacctgttaggatccttgtgaagcgtgatgagctcaccttggagggtattaagcaattttatgtcaatgttgagagggaggattggaagctggacacactctgcgatctttacgagacattagctatcactcagagtgtcatttttgttaataccagaaggaaagttgattggttgactgacaagatgagaagccgtgaccacacagtctcagcaacccacggagacatggaccagaataccagggacattattatgcgtgaattccgttctgggtcttcccgtgtcttgataaccactgatcttttggctcgtggtattgatgtgcaacaagtgtctctagttataaactttgatctccctacacagcctgagaactatctccaccgtattggtcgtagtgggaggttcggaaggaaaggtgttgcgatcaattttgtcacaaaggatgacgagaaaatgctgtttgacatccagaagttttacaacgtgcaagttgaggagctgccttcaaatgttgctgagctcctttaatcagattttgtcctccatcgtattagatgaaattagtttgcgtttggaaaatgttatgtaatgtttctctactcacctctctcccccccatttcgtttctttctttgcacttcttctcttaaactttgtttaataggcttagtaatttaatttatgacttgctttgtggaaacccattattggcccaattggtgtatgactttcgttgcacatttctagcgtacgttttaatttttacataatcgaagaattgcatattcgattcttatg

SEQ ID NO: 4798 - DNA, 1742 bp, Glycine max
tccggcgccttctctgttacgtcgtcatctcatagccaccgccacaacccttcgagtttcgaaaaccctaaccccacaaccccctctcacaaactcactctttttcattgtttgataattcgaacttcctccatctttcccgaagtttgaaatcatggctgggttggcgccagaaggatcacaatttgatgctcgtcaatatgatgctaagatgaatgagttacttggaactgatgggcaagatttttttacttcttatgacgaagtttgtgaaagctttgatgctatgggattgcaggagaaccttctgaggggtatttatgcatatggttttgagaagccctctgcaattcaacaaagggggattgttcctttctgcaaggggcttgatgttattcagcaagcacaatctggaactggaaaaactgctaccttttgttctggagttttgcagcagcttgattacagcttagtagaatgccaggcactggttcttgctcccactcgtgaacttgcacaacaaattgaaaaggtcatgcgagcactaggggactatcttggtgtcaaggttcatgcttgtgttggtgggaccagtgttcgtgaagatcaacgcatcctctcaagtggggttcatgttgttgttggtactcctggacgtgtatttgacatgctgcgcaggcaatcattgcgctctgataacatcaggatgtttgtattggatgaggcagatgagatgctctctcgaggtttcaaggatcagatctatgatatttttcagctgctgccacctaagatccaggttggggttttctctgccacaatgcctcctgaagccctggaaatcacaaggaagtttatgaacaaacctgtgaggattctagtaaaacgtgatgagcttaccttggaggggatcaagcaattttttgtcaatgtagacaaggaggactggaagctcgagacactatgtgatctttatgaaactttggcaatcacccagagtgttatctttgtgaacaccagacgcaaggtagattggctgacagacaaaatgcggagtcgtgatcacacagtttcagccactcatggagatatggaccaaaacacaagggatatcatcatgcgggaattccgttctgggtcctcccgtgttcttattaccacagatcttttggcccgtggtattgatgtccaacaagtctcacttgttataaattatgatctgccaactcagccagagaactatctccatcgaattggtcgtagtggacggtttgggagaaagggtgttgctatcaattttgtgactggggatgatgaaaggatgctgtttgacatccaaaagttttataatgtgcagattgaggagctgccagccaatgtagccgatctcatttgatttggtcttcccatcattggtatgctttttgttatggaggccgctgtcattattttatttttcacggcccagggcctttctctagcaagacttgaacttaaccccaaaccggtgatttgaatttgccattcttctctctaattttgggtttagcagaatgcgttgctgcaattttgttgcttgcttgtttgtttgtcttattactaaagattgtagattgctgctttctctttctctgtgttttgttttaatatccgtgaggtggttctgtaaatttgaaacttgtttaacgttacgttggaaatatactggatttattttcattatcaccccgttgatttgactc

SEQ ID NO: 4799 - DNA, 1671 bp, Solanum lycopersicum
attctacttcagatattgtggttcctcaactccgcggcgtagatccgaggagtttttgtaaaactgcagtctttgaaaaccctaattctcaaatctttcagatctttctttgacaaacttcaaatcaccatcaatcatggcagcagaaggttctcagtttgatgctcgtcaattcgatgcaaaaatgacagaactgcttggtactgaacaacaggaattcttcacatcatatgatgaggttcacgacagttttgatgccatgggtttgcaagaaaatctcctgaggggcatctatgcctatggttttgagaagccatctgctattcagcaaaggggcattgttcctttttgcaagggccttgatgtcatccagcaggcacaatctggtactggaaagacggcaactttctgctctggaattctccagcagcttgattacagtttagttgagtgtcaggctctggttcttgcaccaacccgtgagcttgcacaacagattgagaaggttatgagagcacttggtgactacctgggtgtgaaggttcatgcttgtgttgggggtaccagtgtccgtgaggatcagcgcatccttcagagcggtgttcatgttgtggttggtactccaggccgtgtctttgacatgttgcgcaggcagtctcttcgccccgaccacatcaagatgtttgttttggatgaagctgacgaaatgctctctagaggtttcaaggatcagatttatgatatattccagcttttgccaccaaaaatccaagtgggtgttttctctgcgactatgccaccagaggctcttgagattactagaaagttcatgaacaagcctgtgagaattctcgtgaagcgtgatgagctcactcttgaaggtattaagcagttttatgtcaatgtcgataaggaagagtggaagcttgaaacactatgtgatctttacgagaccttggccatcacccagagcgtcatctttgttaacactaggcgaaaggttgactggctcactgataaaatgcgtggacgtgaccacacagtatctgcaactcatggagacatggatcagaacacaagagatatcatcatgagggagttccgatctggctcatctcgtgtgcttatcacaaccgatctccttgctcgtggtattgatgtccaacaagtctcccttgttattaactatgacctgccaactcaaccagaaaactacctgcatcgtattggtcgtagtggacgatttggaaggaagggtgttgctatcaactttgtcaccaaggatgatgaaaggatgctttttgacatacagaagttttacaacgtcgtaattgaggagctcccagccaatgttgctgatctcctctaaggcgatttttggtatatttattcttagatttagtatcagtttgtactagacttggaattaggaaatgctggtagccatggtttgccacagcaccagttcctttcctgattcaaatgaaactcttttttttttttgcaaattttgtttggtttgtcattttatacctttaaagtatccaaataactttgtatttggtgttgtttgaattgtttaattgatctatttccctatggaaggtaaagcttttagttggattatctgtttttttctcattttgatgctatatttcatatttgtactcc

SEQ ID NO: 4800 - DNA, 1630 bp, Solanum lycopersicum
attctacttcagatattgtggttcctcaactccgcggcgtagatccgaggagtttttgtaaaactgcagtctttgaaaaccctaattctcaaatctttcagatctttctttgacaaacttcaaatcaccatcaatcatggcagcagaaggttctcagtttgatgctcgtcaattcgatgcaaaaatgacagaactgcttggtactgaacaacaggaattcttcacatcatatgatgaggttcacgacagttttgatgccatgggtttgcaagaaaatctcctgaggggcatctatgcctatggttttgagaagccatctgctattcagcaaaggggcattgttcctttttgcaagggccttgatgtcatccagcaggcacaatctggtactggaaagacggcaactttctgctctggaattctccagcagcttgattacagtttagttgagtgtcaggctctggttcttgcaccaacccgtgagcttgcacaacagattgagaaggttatgagagcacttggtgactacctgggtgtgaaggttcatgcttgtgttgggggtaccagtgtccgtgaggatcagcgcatccttcagagcggtgttcatgttgtggttggtactccaggccgtgtctttgacatgttgcgcaggcagtctcttcgccccgaccacatcaagatgtttgttttggatgaagctgacgaaatgctctctagaggtttcaaggatcagatttatgatatattccagcttttgccaccaaaaatccaagtgggtgttttctctgcgactatgccaccagaggctcttgagattactagaaagttcatgaacaagcctgtgagaattctcgtgaagcgtgatgagctcactcttgaaggtattaagcagttttatgtcaatgtcgataaggaagagtggaagcttgaaacactatgtgatctttacgagaccttggccatcacccagagcgtcatctttgttaacactaggcgaaaggttgactggctcactgataaaatgcgtggacgtgaccacacagtatctgcaactcatggagacatggatcagaacacaagagatatcatcatgagggagttccgatctggctcatctcgtgtgcttatcacaaccgatctccttgctcgtggtattgatgtccaacaagtctcccttgttattaactatgacctgccaactcaaccagaaaactacctgcatcgtattggtcgtagtggacgatttggaaggaagggtgttgctatcaactttgtcaccaaggatgatgaaaggatgctttttgacatacagaagttttacaacgtcgtaattgaggagctcccagccaatgttgctgatctcctctaaggcgatttttggtatatttattcttagatttagtatcagtttgtactagacttggaattaggaaatgctggtagccatggtttgccacagcaccagttcctttcctgattcaaatgaaaccttttttttttttttgcaaattttgtttggtttgtcattttatacctttaaagtatccaaataactttgtatttggtgttgtttgaattgtttaattgatctatttccctatggaaggtaaagcttttagttggattaaaa

SEQ ID NO: 4801 - DNA, 1665 bp, Jatropha curcas
attcctccaaggcgcagatccgaggagtttgggattagaaaccctaatttcctctctctactttctaaaagcctccaatcgctctatttctctatcaatctctctctctcactagcagtcatggcaggtttggcaccagaaggatcacagtttgatgctaagcaatatgacgccaaaatgaatgaattgctctcaagtgatggacaagatttcttcaccacatatgatgaggtttatgacagttttgatgcaatgggattgcaagagaaccttctgagaggcatctatgcttatggttttgagaagccttctgctatccaacaaaggggaattgttccattttgtaagggtcttgatgttattcagcaggcccaatctggaactggaaaaacggcaacattttgctccggcattctgcagcaacttgattatgctacagttcaatgtcaagcgttggtgttggctccgactagagaactggcacagcagattgagaaagttatgcgtgcccttggtgattatcttggtgtgaggttctgcttgcgtggtggaacaagtgttcgtgaggaccagcgcattcttcaagcaggtgttcatgttgttgtgggcactcctggtcgtgtgtttgacatgttgagaaggcagtctcttcgcccagattacattaagatgtttgtactggatgaggctgatgagatgctttcacgtggtttcaaggatcagatttatgatattttccagttgctgccagcaaaagttcaggtaggagtgttctctgctaccatgccaccagaagctcttgagatcacaaggaagttcatgaacaagcctgttaggatcttggttaagcgtgatgagcttacccttgagggtatcaagcagttctatgtcaatgttgagaaagaagaatggaaacttgaaacactctgcgatctgtatgagaccctagccatcacccagagtgtcatttttgtcaacacacggcgcaaggtggactggctcactgacaagatgcgtggccgtgaccatacagtctcggccacccatggggatatggaccagaacacccgtgatatcattatgcgggaattccgttctggctcttctcgagttctcatcaccactgatctcttggcccgcggtattgatgtgcagcaagtctcccttgtgataaattatgatctgccgactcaacctgaaaactaccttcatcgaatcggaagaggtggacggtttggaagaaagggtgttgccattaacttcgtgacaagggatgatgagagaatgctgtttgacattcagaagttctacaacgtggttattgaggaactgccgtcgaatgttgctgatcttctgtgatgcgaatttttggtgcttgttgagaaagggtttcttattttgcaagtactatttaacgtgttgttttccatcctgtttagtgtcttaatttaatattttcagacatctgacagtttatctcatatcagccttctcaattgcaatctgaagggattgtctagttcttatttactttttatttttattttttgggtcctcttggaaagttttgcttgatgggtttttgtactatataccctttttacctttctataaattattgtcatattgtttactagtcaaaaaaaaagaattcgaattcctgca

SEQ ID NO: 4802 - DNA, 1679 bp, Vigna unguiculata
ggaaacccactcacttacttctctgcctcggccaccttctgttatcttttctcgactccgcggctagatccgaggagttcgggaaaccctaactctactctcttcacaaccaacaccgttccttttccttctccatcgtctcctcactgagtcatggctggacttgcacctgaggggtcacagttcgatgcgaacaaatatgattccaaaatgagtgacttgctatcttctgatggacaggatttcttcacatcctatgatgaggtttatgagagttttgatgctatgggactgcaggagaatcttctgaggggcatttatgcatatggtttcgaaaagccatcagccattcagcaaagggggatagttcccttctgcaagggacttgatgttattcaacaggctcagtctggaactgggaagacagctactttctgctccggtattctggagcaacttgactatagcttgacgcaatgtcaggccttggttttagcaccaactcgtgaacttgctcagcagattgaaaaggtcatgcgggcacttggagattatcttggtgttaaggttcatgcttgtgtgggaggtaccagtgtccgtgaagaccaacgcattttatctagcggtgttcatgtcgtggttggtacccctggtcgtgtgtttgatatgcttcgtaggcaatcactccaacccgatcacatcaagatgtttgtattggatgaggctgatgagatgctttcccgaggttttaaggatcagatatatgatatattccagctgttgccatctaagattcaagtgggagttttctcagccacaatgcctcctgaggcccttgagatcacgaggaagttcatgaacaaacctgtgaggatccttgtgaagcgtgatgagctcaccttggagggtataaagcagttttatgtcaatgttgagaaagaggaatggaagctggacaccctctgtgatctttatgagacgttagcaatcacccagagtgtcatttttgtgaacaccagaaggaaagttgattggttgactgacaaaatgagaagccgtgaccacactgtttcagcaacacatggagacatggaccagaataccagggacattattatgcgtgaattccgatctggttcttctcgtgtcttgattactactgatcttttggcccgtggtatcgatgtccaacaagtgtctctagttattaattatgatctccctacacagcctgagaactatctgcatcgtattggtcgtagtggaaggtttggcaggaaaggtgtggctatcaactttgtcacaaaggatgacgacaaaatgctgtttgacatccagaagttttataacgtggttgttgaggagctgccttcaaatgttgctgagctcctttaatcagattttgtcctccatggtatttagatgaaattagtttgcgtttgaaaaatgttatgtaatgtttctctaccccctccccccctcccaacttctgtctttctctgcacttgttctctgaaactttgtttaataggcttagtttttaatttatgacttgctttgtggaaacccattattggcccaattggtgtattggatgtctgtgcacatttttctaggcacttttccgagtttagtttttactaaattttagaattgcttgatgttatttttcttttcag

SEQ ID NO: 4803 - DNA, 1640 bp, Vigna unguiculata
aaaaagtagaactaattacataacaaaacctaaactgaacacattccttctattctattcattctcctttctcttcccttcaactccacggcgcagatccgaggagtttgggaaaccctaattcctcttttcgcttcccatacttcgcttttctctttctctctattccaacaacatcagtgatggcaggattggctccagagggtactcaatttgatactcggcattatgatactaagatgaatgagttgctttctgccgatggagaagagtttttcacctcatatgatgaagtctatgatagttttgatgcaatgggtttacaagaaaatcttctgagaggcatatatgcttatggttttgagaggccttctgcgatacagcaaagggggattgttcctttctgcaagggtctggacgtgattcagcaggctcagtctggaactggaaagacagctacattctgttctggaattttgcagcaactagattatggattggttcagtgccaggctttggttttggcaccaacaagggagcttgcacagcagattgaaaaggttatgcgagctctcggtgattatcttggcgtcaaggttcatgcttgtgttggtggaaccagtgtccgtgaggatcagcgcattctccaagctggtgtacatactgttgttggcactcctgggcgtgtgtttgacatgctgcgcagacaatctctccgtcctgatcacataaagatgtttgttttggacgaggctgatgaaatgctttcacgtggtttcaaggaccagatctatgacatcttccagctactgccgggtcaaattcaagttggcgtgttctctgctacaatgccaccggaggccctggaaattacaagaaagttcatgaataggccagtgagaatcctggtaaagcgtgatgaattgaccctggagggtatcaagcagttttatgtgaatgttgacaaggaagaatggaaactggagacattatgcgacctttatgagactttagctatcacccagagtgtcatctttgtgaacacaaggcgcaaggtggactggctcactgacaagatgcgaagcaatgatcacacagtctctgcgactcatggagacatggaccaaaacactcgtgatatcattatgcgtgaatttcgctctggctcttctcgagttctaatcaccactgacctcttggctcgtggtatagatgtacaacaagtgtctttggttataaactatgatctgcctacccaacctgaaaattatcttcaccgcataggacgaagtgggcgttttggaagaaagggtgttgccataaactttgtgacactggaagatgccagaatgctatctgatattcagaagttctacaatgtcactgtagaggagttgccctcaaatgttgctgatctgctctgatgggttaatttttattctctgttaagtcatcagagctattactttttgacaattattattttgtgtctttcttttctttttcaatttttaccggttagagttcaatgacgccttactttatttataatggattctattaaaattgtttatttgcttattttagtaggttgctcaaagccatttctcttttaattgtggtatgtatcttatttctga

SEQ ID NO: 4804 - DNA, 1759 bp, Lotus japonicus
actcactttcgcaaaaacaaaacgcactcttcgcaatctctttctctttcctcaactccgcggcttagatctgaggagtttgggaaaccctaaccgcctctctccgataacactctccgcctccgctctcttctccgatcaaccaccgcttccatcaccgtcagtatggctggactcgcaccggaaggctcgcagtttgatgcaaagcattatgataccaagatgagtgaattgcttactactgaaggacaggacttcttcacctcctatgatgaggtttatgagagttttgatgctatgggccttcaagagaacttgctgagaggcatttatgcatatggttttgagaagccctcagctattcagcaaagaggaatagttccattctgcaagggacttgatgttatacaacaggctcagtctggaactgggaaaacagcaactttctgttctgggattttgcagcaacttgactacagtttgactgaatgccaagccttggttctagcaccaactcgggagcttgctcagcagattgagaaagttatgcgagcacttggagactatctaggtgtcaaggtgcatgcttgtgttggaggtaccagtgttcgtgaagaccaacgcattctatcaagcggtgttcatgttgttgttggtactcctggtcgtgtatttgatatgcttcgcaggcagtcacttcgaccagataacatcaagatgtttgtattggatgaggctgatgaaatgctttcacgtggttttaaagatcagatctacgatatattccaactgctgccatccaagattcaagttggagttttctctgctacaatgcctcctgaggctcttgaaatcaccaggaagtttatgaacaaacctgtaaggatccttgtgaagcgtgatgagctcaccttggagggtattaagcagttttacgtcaatgttgaaagagaggaatggaagctcgatacactctgtgatctttatgagacattggcaatcactcagagtgtcatttttgtgaacaccagaaggaaagttgattggctgactgacaagatgcgaagcagagaccacacagtctcggcaacccatggagacatggaccagaataccagagatattattatgcgagaattccgttctgggtcttcccgtgttttaatcactactgatcttttggctcgtggtattgatgtgcagcaagtatctttggttataaattatgatctcccaacacagcctgagaactatctccatcgtattggtcgtagtggaaggtttgggaggaaaggtgttgccatcaactttgtcacaaaggatgatgaaagaatgctgtttgacatccagaagttctacaatgtggtagttgaggagctgccttcaaatattgctgaactactttgaggtgttagtcttcaaacataattagtggaaagttggtttctgaggtactgaatgcaattgatggcactctgttatgaacgttgactgggggcagttaacttaatttttgagtattctgatgtttaaaatcgtgttggctactctttgaccagctttacaacatttttgtgtgattatcggcaatgctagcttagtacccccttatttttcattgttttttgaagtcaatgtttcaaaaagtgatcaagatgtggagtctatttaatgtttgttgacattgttgttgttttgtgttagtgacggtttggttactattatgtctagtagcattgaagatgtctcctttgttctc

SEQ ID NO: 4805 - DNA, 1706 bp, Lotus japonicus
acgactggctgactcactttcgcaaaaacaaaacgcactcttcgcaatctctttctctttcctcaactccgcggcttagatctgaggagtttgggaaaccctaaccgcctctctccgataacactctccgcctccgctctcttctccgatcaaccaccgcttccatcaccgtcagtatggctggactcgcaccggaaggctcgcagtttgatgcaaagcattatgataccaagatgagtgaattgcttactactgaaggacaggacttcttcacctcctatgatgaggtttatgagagttttgatgctatgggccttcaagagaacttgctgagaggcatttatgcatatggttttgagaagccctcagctattcagcaaagaggaatagttccattctgcaagggacttgatgttatacaacaggctcagtctggaactgggaaaacagcaactttctgttctgggattttgcagcaacttgactacagtttgactgaatgccaagccttggttctagcaccaactcgggagcttgctcagcagattgagaaagttatgcgagcacttggagactatctaggtgtcaaggtgcatgcttgtgttggaggtaccagtgttcgtgaagaccaacgcattctatcaagcggtgttcatgttgttgttggtactcctggtcgtgtatttgatatgcttcgcaggcagtcacttcgaccagataacatcaagatgtttgtattggatgaggctgatgaaatgctttcacgtggttttaaagatcagatctacgatatattccaactgctgccatccaagattcaagttggagttttctctgctacaatgcctcctgaggctcttgaaatcaccaggaagtttatgaacaaacctgtaaggatccttgtgaagcgtgatgagctcaccttggagggtattaagcagttttacgtcaatgttgaaagagaggaatggaagctcgatacactctgtgatctttatgagacattggcaatcactcagagtgtcatttttgtgaacaccagaaggaaggttgattggctgactgacaagatgcgaagcagagaccacacagtctcggcaacccatggagacatggaccagaataccagagatattattatgcgagaattccgttctgggtcttcccgtgttttaatcactactgatcttttggctcgtggtattgatgtgcagcaagtatctttggttataaattatgatctcccaacacagcctgagaactatctccatcgtattggtcgtagtggaaggtttgggaggaaaggtgttgccatcaactttgtcacaaaggatgatgaaagaatgctgtttgacatccagaagttctacaatgtggtagttgaggagctgccttcaaatattgctgaactactttgaggtgttagtcttcaaacataattagtggaaagttggtttctgaggtaagtgttatgtaatgtttttctttttttgggcctttttttgttgtatttctggttttgaactttgtttaaccttttaggtaggtgtagtaatttaatttacattattaatcgtctgaatgtttgaagtgataagtactttgtgatgtgaaatcccattattagtcgaattagtgtattggtcgttgttccttttctaacaagcaagcttcttaatatatgtttaagttataaccatgtgttg

SEQ ID NO: 4806 - DNA, 1610 bp, Quercus alba
tgttttcacctttcgcctcctctttaactttccattcaaactccacggcgcagatccgaggagtttggaaaaaccctagctctctctacaaacctctttcaataacctttcactctacttttcttcaacactttcagctatggcaggtgcagctccagaaggttcgcaatttgatgctcgtcagtttgatgctaaaatgaatgagttactctcaactgatgggcaagagttcttcacctcatatgatgaggtttatgaaagttttgattcaatgagattgcatgaaaaccttctgagaggaatctatgcttacggttttgagaagccttctgcaattcagcaaagggggattgttcctttctgcaaaggccttgatgtaattcaacaggctcagtctggaactgggaaaacagcaactttctgctctgggattttgcaacaacttgattatgagcttgtccagtgccaggctttggttttggcacccactagggaacttgcacaacagattgagaaggttatgcgggcacttggtgattatcttaatgtcaaggttcatgcttgtgttggtggcacaagtgttcgtgaggatcaacgcatccttcaggcaggtgttcatgttgttgtaggcacccctggtcgtgtatttgacatgttgcgaaggcagtcacttcgtcctgattacattaagatgtttgtactggatgaggctgatgaaatgctttctcgtggtttcaaggaccagatctatgatattttccagctacttcccgccaaggttcaggttggggtgttctctgctacaatgcctcctgaagcccttgagatcactaggaagtttatgaacaagcctgtgagaatcttggtgaagcgtgatgaactcacccttgagggtatcaagcagttttatgtgaatgttgagaaggaagagtggaagcttgagacactatgtgatctctacgaaaccctggccatcacccaaagtgtcatctttgtgaacacacggcgcaaggttgattggctcactgacaagatgcgtggccgtgaccatacagtctcagccacccatggtgacatggaccagaatactcgtgatataattatgcgtgaattccgctctggatcttcccgtgttctcatcaccactgacctcttggctcgtggtattgatgtgcagcaagtctccttggtcataaactttgatctgccgactcaaccagaaaattaccttcaccgtattggacgaagtggacggtttgggagaaagggtgttgccattaattttgttacaaaggacgatgagagaatgctgtttgacattcagaagttctacaatgtgcaagttgaggagctgccatcaaatattgccgatctcctgtgatgaagtcttttttggttttgtttgaggcatggggttctcttcctttcatagtactatttattttttataacttcttaattttgttttgtttttttttcccatctagtgtcccaagttaatgttggcaaacatatctgaccttttaatgaattgggtttagggcttgcatattattgcaacataaagacagttcagttcctatttcagcttggagggattatttaaaatt

SEQ ID NO: 4807 - DNA, 1612 bp, Solanum tuberosum
ggaagaagaaaaaaaagctgcagtctttgaaaaccctaattctcaaatctttcagatctttctttaacaaacttcaaatcgttatcaatcatggcagcagaaggttctcagtttgatgctcgtcaattcgatgcgaaaatgacagagctgcttggtactgaacaacaggaattcttcacatcatatgatgaggttcacgacagttttgatgccatgggtttgcaagaaaatctgctgaggggcatctatgcgtatggttttgagaagccatctgctattcagcaaaggggcattgttcctttttgcaagggccttgatgttatccagcaggcacaatctggtactggaaagacggcaactttctgctctggaattctccagcagcttgattacagtttagttgagtgtcaggctctggttcttgcaccaacccgcgagcttgcacaacagattgagaaggttatgagagcacttggtgactacctgggtgtgaaggttcatgcttgtgttgggggtaccagtgtccgtgaggatcagcgcatccttcagagcggtgttcatgttgtggttggtactccaggccgtgtctttgacatgttgcgcaggcagtctcttcgccccgaccacatcaagatgtttgttttggatgaagctgacgaaatgctctctagaggtttcaaggatcagatttatgatatattccagcttttgccaccaaaaatccaagtgggtgttttctctgccactatgccaccagaggctcttgagattactagaaaattcatgaacaaacctgtgagaattctcgtgaagcgtgatgagctcactcttgaaggtattaagcaattttatgtcaatgtcgataaggaagagtggaagcttgaaacactttgtgatctttacgagaccttggccatcacccagagcgtcatctttgttaacactaggcgaaaggttgactggctcactgataaaatgcgtggccgtgatcacacagtatctgcaactcacggagacatggatcagaacacaagagatatcattatgagggagttccgatctggctcatctcgtgtgcttatcacaaccgatctccttgctcgtggtattgatgtccaacaagtctctcttgttattaactatgacctgccaactcaaccagaaaactacctgcatcgtattggtcgtagtggacgatttggaaggaagggtgttgctatcaactttgtcaccaaggatgacgaaaggatgctttttgacatacagaagttttacaacgtcgtagttgaggagctcccagccaatgttgctgatctcctttaatatattttttcttagatttagtttcagtttgtactagacttggaattaggaaatgctggtaccatggtttgccacagcaccagttactttcctgattcaaatgaaacttctagagtcaacttttgcaaattttgtttggtttgtcattttatatcttaaagcatccaaataactttggatttggtattgtttgaattgtttaatttatctatttccctatggaaggtaaagcttttagttggatatctgtttttccccattttgatgctatatttcatatttgaactcc

SEQ ID NO: 4808 - DNA, 1771 bp, Nicotiana tabacum
  misc_feature (202)..(202): n is a, c, g, or t
  misc_feature (218)..(218): n is a, c, g, or t
  misc_feature (232)..(233): n is a, c, g, or t
  misc_feature (245)..(245): n is a, c, g, or t
  misc_feature (248)..(248): n is a, c, g, or t
  misc_feature (269)..(269): n is a, c, g, or t
  misc_feature (338)..(338): n is a, c, g, or t
ggccattacggccggggagtaaatacaattccataaaagaacacaactacggaaaaaccataaaataacacataacacaacgcaagtctaatctttctattctctttttcctctgtaactcctgcggcgtagatccgaggagtttcagacaaaaacagcagtctttgcaaaccctaactttccaatcgcttttacccacttntcctttcaactctctntttgctattcctcnnatcttttcctcntcnctatcagtcatggctggcttngcaccggaaggttctcaatttgatgctcgtcagtatgatgccaaaatgactgagctgcttgggactgancaggaggagttcttcacatcatatgatgaggtttatgacagttttgatgccatgggtttgcaagaaaaccttcttaggggcatctatgcttatggttttgagaagccatctgctatccagcaaaggggtattgttccattttgcaagggtcttgatgtgatccaacaggcacaatctggaaccggaaagacagcaactttctgctctggagttctccagcagctcgattacagcttagtcgaatgtcaggctctggttctggctccaacccgtgagcttgcccaacagattgagaaggttatgcgagcacttggtgattatctcggtgtgaaggttcatgcttgtgtaggaggtaccagtgtccgtgaggatcagcgtatccttcaaagtggtgttcatgtggtggttggtactcctggccgtgtctttgacatgttgcgcaggcagtctcttcgccctgaccacatcaagatgtttgttctggatgaagctgatgaaatgctctcaagaggtttcaaggatcagatttatgatatttttcaactgctgccaccaaagattcaagtgggtgttttctctgccactatgccgccagaagcccttgaaattactaggaagttcatgaacaagcctgttaggattcttgtgaagcgtgatgacgttacgcttgaaggtatcaagcaattttatgtcaatgttgataaggaagagtggaagcttgaaactctttgcgatctttacgagaccttagccatcacccagagtgtcatctttgttaacaccaggcgtaaggttgattggctcactgacaaaatgcgcagccgtgatcacacagtatctgcaactcacggagacatggaccagaacactagagatatcattatgcgagagttccgatctgggtcatctcgtgtgctcatcaccactgatcttctggcacgtggtattgacgtgcagcaagtttcccttgtgattaactatgaccttccaactcagccagagaactacctgcatcgtattggtcgtagtggacgatttggaaggaagggtgttgctatcaactttgtcataaaggatgacgaaaggatgctttctgatattcagaggttttacaatgttgtaatcgaggagttgccagccaatgtggccgatctcctttgatgtggttttggttctgtgaggtgaatttcttctttacatgaagtaatttaatatcttattattaggtttgttagatatctattggtcttagaattgggaaatgcaggtgccatgattcgccatggaacctgtaattttcctgtttggttggagtacctactatcaattttgtcggtttatctttgttttgtattgtaagtccaaaataactccaagttttggatgctttttgaatttttattgagatttaactcttggccttgttattgtgt

SEQ ID NO: 4809 - DNA, 1617 bp, Brassica napus
gttcactctcaatctcaaagcctctctcaatcttcgctctttgtctctaaccgccttagccggttagatccgagtttgggagattcagcctccctaagttaaaccaaaaaacatcactccactactaccaaatctctttcactctccagtcatggcaggatccgcaccagaaggcactcagtttgatgcacgtcagttcgaccagaagttgaacgaagttcttgagggacaggacgagttcttcacctcttacgatgaatcccacgacagctttgacgccatgggtctccaagagaatctcctcaggggtatctacgcttacggtttcgagaagccttctgctatccagcaaagaggaatcgttcccttttgcaaaggcctcgacgtgatccaacaggcccagtccggtaccggcaaaaccgccactttctgctccggcgtcctccagcagctagactactccctcgtccagtgccaggccctcgtcctcgccccgaccagagagctcgcccagcagatcgagaaggtcatgagggccctcggcgactacctcggcgtcaaggtccacgcctgcgtcggcgggaccagcgtccgcgaggaccagcgcatcctccaggccggcgtccacgtcgtcgtcggcaccccggggcgcgtgttcgacatgctgaagcgccagtccctccgcgccgactacatcaagatgttcgtcctcgacgaggccgacgagatgctctcccgcgggttcaaggaccagatctacgacatcttccagctcctcccgcccaagatccaggtgggtgtcttctcggcgaccatgccgccggaggctctcgagatcacgaggaagttcatgagcaagccggtgaggatcctggtgaagcgcgacgagctcaccttggaaggtatcaagcagttttacgtcaacgttgagaaggaggagtggaagctcgagacgctctgcgacctctacgagacgctggccatcactcagagcgtcatcttcgtgaacaccaggcggaaggttgactggctcactgataaaatgagggggcgtgaccacacggtgtctgcgactcacggagacatggaccagaacactagagacattattatgagagagttcaggtctggctcctcgcgtgtgcttatcaccactgatctcttggctcgtggtatcgatgttcagcaggtgtctctggtgatcaactacgatctgccgactcagcctgagaactaccttcaccgtatcggaagaagtgggaggtttgggaggaaaggtgtggcgatcaacttcgtgacgaaggatgatgagaggatgctgtttgatattcagaagttttacaacgtggttgttgaggagctgccttcgaacgttgctgatctgctgtgaaggggagaaactttggcattgtctaccggagaagaaaggtttttacttgtttgttaaggcacgcactctttgatctgattttgatctcatcttcatctctctttccataagcggtttgtttacattttctcgtgttttgtcacctcttctgttcctaagaacatatctctctctctcttgtgaccatttttatttttaaaatcatatggagtatttgtttctggctt

SEQ ID NO: 4810 - DNA, 1690 bp, Arabidopsis lyrata
aaaaaaaaaaaaagggagactataaaaagtggctaacacgtatcgggttaggtctctctctacctcaatttttattatttgcttccatcgtctctttatctctctaccagatccgagttcgggagatttcaagctatctaacaaagtccttcacttttgctctcaaagctttcatctttcattcaactacttgacctcacagtatggcaggatctgcagcagaaggtacacaatttgatacgcgtcagtttgaccagaagctgaatgaagtactcgagggacaggatgagttcttcacctcatatgatgaggtccatgagagctttgatgccatgggtttgcaagagaaccttctcaggggtatctatgcttatggtttcgaaaagccttcagctattcagcaaagagggattgtacccttttgcaagggtcttgatgtgatccagcaggcacagtctggtactggaaaaaccgccactttctgctctggtgtcttgcagcagcttgactatacccttgtccagtgccaggctctcgttttggctcccaccagagagcttgctcagcagattgagaaggtcatgcgtgcccttggtgattaccaaggcgtcaaagttcatgcctgtgttggtggaaccagcgtccgtgaggatcagcgcattctccaggctggtgttcatgttgtcgttggaactcccggtcgtgtgtttgacatgcttcgaagacaatctcttcgccctgactgcatcaagatgtttgtccttgatgaagctgatgaaatgctctcccgtggtttcaaggatcagatctatgacatattccagcttctcccaccaaagattcaggttggagtgttctcagcaacgatgccaccggaagctctggagatcacaaggaaattcatgagcaaaccagtgagaatcttggtgaaacgtgatgagctcacacttgaaggtatcaagcaattctacgtgaacgtggagaaagaagagtggaagcttgagactctctgcgatctctatgagactctagccatcactcagagtgtcatcttcgtcaacactcgtcgcaaggtcgactggctcacagacaaaatgagaagccgtgaccacacagtctcagcaactcacggagacatggaccaaaacacaagagacatcatcatgagagaattcaggtctggttcttctcgtgttctaatcacgactgatctcttggctcgtggtatcgatgtgcagcaagtctctctggtcataaactttgacctcccaactcagccagagaattaccttcaccgtatcggaagaagtggaaggttcgggagaaagggtgtggccattaacttcattactcgtgatgatgagagaatgctgtttgatattcagaaattctacaatgttgttgttgaggagcttccctcaaacgtggccgatttgctgtgaagaagaagaagaaaagaagaaaggttgcttgtttcgcaagtttcttatttgatttttgacccgtttctctgtctctctcgctctctgaatcatcgatacatctttttcattctctagtattcttcatcaactctatcgaacatatatatgtcgcttctgaccatttttctttttagtcacatgcaatatttatttcttctcttgtatgatccacaaatctttcgtaatcacaagtctagtcatagcaa

SEQ ID NO: 4811 - DNA, 1972 bp, Arabidopsis lyrata
taaagacggagtatataaacaagtaacgcgtttcctctcagcctctttcggattttcctatcagtctctcacaatcttcgctcttctcttttatctctctctctctcaacgcggttcagatccgagtttgggagattcaagctccctgaaaaaagccctttactttcgcttaccaatctctctcaatcatggcgggatctgcaccagaaggcacacagtttgatgcacgtcagtttgatcagaaactgaatgaagtacttgagggacaagatgagttcttcacatcttatgatgaggttcatgagagctttgatgccatgggtctgcaagagaaccttctcaggggtatttatgcttatggttttgagaagccttctgctattcagcaaagaggaattgtccccttttgcaaaggtcttgatgtgattcagcaggcccagtctggtactgggaaaacagcgactttctgctctggtgtcttgcagcagctggacttctcccttgtccagtgtcaggctttggttctagctccaactagagagcttgctcagcaaattgagaaggtcatgagggccctcggtgattaccttggtgtcaaggttcacgcctgtgttggtggaaccagtgtccgtgaggatcagcgtatcctccaagctggtgtccatgttgttgttggaactccaggacgtgtctttgacatgttgaagaggcagtctctccgtgctgacaacatcaagatgtttgttcttgatgaagctgatgaaatgctctcccgtggtttcaaggaccagatctatgacatattccagcttctcccaccaaagatccaagttggtgtgttctccgcaacaatgccaccagaagctcttgagatcacaaggaagttcatgagcaagccagtgagaatcttggtgaagcgtgatgagcttacccttgaaggtatcaagcagttctatgtcaatgtcgagaaagaagagtggaagctcgagacactctgtgatctctacgagactctggccatcactcagagtgtcatcttcgttaacaccaggcgtaaggttgattggctcacagacaaaatgagaagccgtgaccacacagtctcagcaactcacggagacatggaccagaacaccagagacatcatcatgagagagttcaggtctggttcctcccgtgttctcatcaccactgacctcttggctcgtggtattgatgtccaacaagtctctctggttatcaacttcgatctcccaactcagccagagaactacctccaccgtatcggaagaagtggaaggttcgggagaaagggtgtggcgatcaattttgtgacccacgatgatgagaggatgctgtttgatattcagaagttctataacgtggttgtcgaagagctgccttcgaacgtggccgatctgctgtgaagggagaaaactttggtattgtctaccggagaagaaaggttttttacttgtttgttaaggcacgcacacctctttgatctgattttgatctcatcatcatctctctctttccataagcggtttgtttacattttctcgtgttttgtcacctcttctttctaagaacatatctctctctcttgtgaccatttttatttttaaaatcatatggagtatttgtttctggtttgttgtcttttcttatcttcttttgtaacaaatcttgtcgtgaaagtttaggttttaaactttttcatatctcggtgcagaagtagtaaggattacacgaactttaatgagaagtgaatgatggagagaagatatttagaataaatatcttatttatttagtgttttatttagagtttatttattattaagatatttatctctaatgttttagggtttctatgtttttttatatataaccgtttaggcttaagtttgtattgggatgactgatattaatatattttataaaagagaggtttgaaaccaaaaaaaaaa

SEQ ID NO: 4812 - DNA, 1760 bp, Mimulus guttatus
gttgccttctctctctctctacagttttatctctctctctctcatctgaactccgcggcgtagatccgaggagtttcagataaacaccgccgctaaatcaaagctaaaccgctctcttacgtactttttcttcctcagatcttcgttcgagttgagttttttcagtcatggctgacaaagtacccgagggttccaatttcgatgctcgccagttcgatgcaaaaatggatgagatacttggtgctgaaggcgaggaatttttcactagctatgacgaggtgtacgacagttttgatgccatgggcttgcaggaaaatcttcttaggggcatctatgcatatggttttgagaagccctctgccatccagcaaagagggattgttcccttctgcaagggactggacgtgatccaacaagctcaatctggtactggaaaaactgcaaccttttgctctggagttttgcagcagctcgactatactttagttgaatgccaggcccttgttctggcaccaactcgcgagcttgcacagcagattgagaaagttatgcgagccctaggtgattatcttggtgttaaggtccacgcatgtgttggaggcaccagcgttcgtgaagatcagaggattctttcaagtggggtccacgtcgtggttggtacacctggacgtgtttttgacatgttgagaaggcagtcactccgctctgattacatcaaaatgtttgtgctcgatgaagctgatgaaatgctctccagagggttcaaggatcagatatacgatatcttccagctgctgccacccaagatccaagtgggagtgttctccgccactatgccaccagaggctcttgaaatcaccaggaagttcatggctaagcccgttcgtattctcgtgaagcgtgatgagttaacccttgagggtatcaagcagttctacgttaacgtagacaaagaggactggaaactcgaaaccctctgcgatctctacgaaacacttgccatcactcagagcgtcatctttgtcaacactaggcgcaaggttgactggttgaccgataaaatgaggggccgtgatcacactgtatctgccacccatggtgacatggaccaaaacacgagagatataatcatgcgtgaattcaggtccggttcttcgagggttttgatcacgactgatcttttggcacgtggaatagatgtgcagcaagtctctcttgtgatcaattacgatctgccaactcagcctgagaactacttgcatcgtattggtcggagtggaaggtttgggagaaagggtgttgctataaactttgtcactaaagatgacgagcgcatgcttttcgacatacagaagttttacaatgttgtggttgaggagcttccagctaatgttgccgatctactctgatgtgggcttttgctgatttcaccgaggttaatgtttctttgttttcgagtaagttatttgcgttatttatctaggttagtttaacgtgtaattgacttggtaatttgggagatgtgagtgccgttatttgcagagagggctttcatcttccaatatatgattgcactgaagaaactacaagtttttggtttgttcgtttttttgttgtatctgtcgaaaaaaaactgaagatttcgatttttatttggactacatagagggtatttttactagctttaatattattattgttttgatattgatggtgtgttggattttattgttgtttagttttacatttctattcttgat

SEQ ID NO: 4813 - DNA, 1735 bp, Avena sativa
aaaccctctgtttctctctcctgcccaatccccaaccctcatcgcctccgctcctacgccgccgaatccgagactcgatctcggattcctcgcagcgcaacccaggcgatccgctcaagctcctccccaacgcttcagccatggcaggaatggcacctgaaggttcccagtttgatgctaagaactatgactctaaaatgcaggagctgctgagccaaggtgagactgaggacttcttcacctcctatgatgaagttcatgagagctttgatgacatgggtctccaagagaaccttctgaggggaatttacgcttatggttttgagaagccttcagccatccagcaaaggggtattgttcctttctgcaaggggcttgatgttattcagcaagcacaatctggaacaggaaagacagctaccttctgctctggaatcttgcaacagcttgactatggtttggttgagtgccaggccttggtccttgctcccacccgtgagcttgcacagcaaatcgagaaggtcatgcgtgcactcggtgactacttgggtgtgaaagttcatgcatgtgttggaggaacctctgttcgtgaggaccagagaattcttgcaagtggagtgcacgtcgttgttggcacacctggtcgtgtgttcgacatgcttcgtaggcagtctcttcgccctgacaacatcaagatgtttgttcttgatgaagctgatgagatgctttcccgtggtttcaaggatcagatttatgacatcttccagctgctcccaggaaagattcaagttggtgtcttctctgctaccatgccccctgaggcccttgagattacccgcaagttcatgaacaagcctgtgaggatccttgtcaagagggatgagctcacccttgagggtatcaagcagttttatgtgaatgtggagaaggaagagtggaagctggacacactctgtgacctgtatgagactcttgccatcacccagagtgtcatctttgtcaacacccgccgcaaggtggactggctcactgacaagatgaggggcagggaccacacagtttctgctacccacggagacatggaccagaacactagggacatcatcatgagggagttcagatctggttcttcacgtgtgctcatcaccactgacctgcttgctcgtggtattgatgtccagcaagtgtccctggtcatcaactatgatcttccgacccagccagagaactacctgcatcgcatcggtcgtagtggtcggtttgggaggaagggtgttgccatcaactttgtgacccgcgaagatgagaggatgctgtttgacatccagaagttctacaacgtggtgattgaagagctcccagccaacgttgccgacctcctgtgatcaagctcttgagaacatatggtaaggagcctgactggggcttgtttttgttgaaaacatcaccaactttctttcttggggggaagtgataaatggtcgggggttctactttaaggtcgtggtcatggacgatttggggtttattatgctggcatgttttgggaatttttgtagttgctaggctgtgctatgtgctgctgtgtttaagcttgaggatggagctactgctggagtcctcactttatttgttaagactatgtaatgaccgaatgatgttatttatttgtgtcatccttgactcttcaccgcatgtaaacctgcaatcggtactagtacttcctactactatt

SEQ ID NO: 4814 - DNA, 1804 bp, Arabidopsis thaliana
taaagacggagtatataaacaaggtaacgcgttttctctcagcctctttcggatattccaccagtctctcgcaatcttcgctcttctctttgctctctctctctcaacgcggttcagatccgagtttgggagattcaagctccctgaaaaaagccctttactctcgcttaccaactttgctccagcatggcaggatctgcaccagaaggcacacagtttgatgcacgtcagtttgaccagaaactcaatgaagtacttgagggacaagatgagttcttcacatcctatgatgatgttcatgagagctttgatgccatgggtcttcaagagaaccttctcaggggtatttatgcttatggttttgagaagccttctgctattcagcaaagaggaatcgtccccttctgtaagggtcttgatgtgattcaacaggctcagtctggtactgggaaaacagcaactttctgctctggtgtcttgcagcagctggacttctcccttatccagtgtcaggctttggttctagctccaactagagagcttgctcagcaaattgagaaggtcatgagggcccttggtgattaccttggtgtcaaggttcacgcctgtgttggtggaaccagtgtccgtgaggatcagcgcatcctccaagctggtgtccatgttgttgttggaactccagggcgtgtctttgacatgttgaagaggcagtctcttcgtgctgacaacatcaagatgtttgttctcgatgaagctgatgaaatgctctcccgtggtttcaaggaccagatctatgacatattccagcttcttccaccaaagatccaagttggtgtgttctccgcaacaatgccaccagaagctcttgagatcacaaggaagttcatgagcaagccagtgagaatcttggtgaagcgtgatgagcttacccttgaaggtatcaagcagttctacgtcaacgttgagaaagaagagtggaagctcgagacactctgtgatctctacgagactcttgccatcactcagagtgtcatcttcgtgaacaccaggcgtaaggttgattggctcacagacaaaatgagaagccgtgaccacacagtctctgcaactcacggagacatggaccagaacaccagggacatcatcatgagagagttcaggtctggttcctcccgtgttctcatcaccactgacctcttagctcgtggtattgatgtccaacaagtctccctggttatcaacttcgatctcccaactcagccagagaactaccttcaccgtatcggaagaagtggaaggttcgggagaaagggtgttgcgatcaatttcgtgacccgtgatgatgagaggatgctgtttgatattcagaaattctacaatgtggttgtcgaagagctgccttcgaacgtggccgatctgctgtgaagggagaaaagaagtcggttctgttgctgtgtttgctctgccgtactagtatcaccggagaagaaaggttttcttgttttgcaaggcactctttgatctgattttgacccgtcgtctatcagcgatttacatttcttaaattttcttagttgttgttctctcctctctctcccagctacgaacatatctctctcttcttgaccatttttaagtttaagtcatatggagtatttatttcttcactattttaatattcggctttgttgtttgtctttgatttttgtatcaatcaaatcttttcatcaaagtttggttttaagctttttcaaatctatatctcagcattaaacttattttatatgtttatgtcaaactggtt

SEQ ID NO: 4815 - DNA, 1664 bp, Brassica napus
ggcctctttacgattcgttcactctcaatctcaaagcctctctcaatcttcgctctttgtctctaaccgccttagccggttagatccgagtttgggagattcagcctccctaagttaaaccaaaaacactactctctttcgctcttcagtcatggcaggatccgcaccagaaggcactcagtttgatgctcgtcagttcgaccagaagttgaacgaagttcttgaaggacaggatgagttcttcacctcttacgatgaatcccacgacagctttgacgccatgggtctccaagagaatctcctcaggggtatctacgcttacggtttcgagaagccttctgctatccagcaaagaggaatcgttcccttttgcaaaggcctcgacgtgatccagcaggcccagtccggtaccggcaaaaccgccactttctgctccggcgtcctccagcagctagactactccctcgtccagtgccaagccctcgtcctcgccccgaccagagagctcgcccagcagatcgagaaggtcatgagagccctcggcgactacctcggcgtcaaggtccacgcctgcgtcggcgggaccagcgtccgcgaggaccagcgcatcctccaggccggcgtccacgtcgtcgtcggcaccccggggcgcgtgttcgacatgctgaagcgccagtccctccgcgccgaccacatcaagatgtttgtccttgatgaggccgacgagatgctctcacgcgggttcaaggaccagatctacgacatcttccagctcctccccccgaagatccaggtgggagtgttctctgccaccatgccgccggaggctctcgagatcacgaggaagttcatgagcaagccggtgaggattcttgtgaagcgcgacgagcttactttagaaggtatcaagcagttttacgtcaacgttgagaaggaagactggaagctcgagacgctctgcgacctctacgagacgctggccatcactcagagcgtcatctttgtcaacactaggcggaaggttgactggctcactgataaaatgagggggcgtgaccatacagtctctgcgactcacggagacatggaccagaacactagagacattatcatgagagagttcaggtctggctcatctcgtgtgttgatcacgactgatctcttggctcgtggtatcgatgttcagcaggtgtctctggtgatcaactacgatctgccgactcagcctgagaactaccttcaccgtattggaagaagtgggaggtttgggaggaaaggagtggcgatcaactttgtgaccaaggatgatgagaggatgctgtttgatattcagaagttttacaacgtggttgttgaggagctgccttcgaacgttgctgatctgctgtgaaggggagaaaaagtttggtattgtctaccggagaagaaaggttttttacttgtttgttaaggcacgcacacctctttgatctgattttgatctcatcttcatcatctctctttccataagcggtttgtttacgttttctcttgtgtgtttctctaagaacatatctctcgtatttttaaaatcatatggagtatttgtttctggtttgctgtcttttctcatcttcttttgtatcaaatcttgtcgtgaaagttttggttttaaacattttcat

SEQ ID NO: 4816 - DNA, 1826 bp, Cenchrus ciliaris
  misc_feature (654)..(654): n is a, c, g, or t
gagagagagaactagtctcgagtttttctctctcctgcgccgcgccgtccccttcgtctccgccgccgaatccgggactccgatctcgggttcaccgcagagcaccaaagcaaccaccggcgaccggccccgatcagctctcctctccgcgcttcagtcatggcgggaatggcacctgagggttcccagttcgatgctaagcactatgattctaaaatgcaggagctgctgagcactggtgagactgaggaattcttcacctcatatgatgaggtttttgagagctttgatgacatgggcctccaagagaaccttctgaggggcatttatgcttatggttttgagaagccttcagcaatccagcagagaggaattgtacctttctgcaagggtcttgatgtcattcagcaagcacaatctggtacaggaaagacagcaactttctgttctgggatcttgcagcagctcgactatggcctggttgaatgccaggccctggtccttgctcccacccgtgagcttgcgcagcagatcgagaaggtcatgcgtgcacttggtgactacctgggggtgaaagttcatgcatgcgtgggtggaacttcagtccgtgaggaccaaaggattcttgctagcggtgtgcatgttgttgttggnacaccaggtcgtgtgtttgacatgttgcgtaggcagtctctccgtcctgatcacatcaagatgtttgtcctggatgaagctgatgagatgctctctcgtggtttcaaggatcagatttatgacatcttccagcttctcccagcaaagattcaggttggagtcttctctgctaccatgcccccagaggctcttgagattacccgcaagttcatgaacaaacctgtgagaatcctggtgaagagagatgagctcacccttgagggtatcaagcaattctatgtgaatgtggagaaagaagactggaagctggacacgctatgtgacttgtatgagacccttgccatcacccagagtgtcatctttgtcaacacccgccgcaaggtggactggctcactgacaagatgaggagcagggaccatactgtttctgccactcacggtgacatggaccagaacactagggacatcatcatgagggagttcaggtctggttcatcccgtgtgctcatcaccaccgacctgcttgcccgtggtatcgatgttcagcaggtgtccctggtcatcaactatgatctccccacccagcctgagaactaccttcatcgcattggtcgtagtggtcgtttcggtaggaagggtgttgccatcaactttgtgacccgtgatgatgagaggatgctgtttgacatccagaagttctacaatgtggtgattgaggagctgccagccaacgtcgctgacctcctgtgatcaagttgaggaaaaccaaaacagaacaaaaaaaaagtggtaaggggacctgataaggcttgtttttgttgaaatatggccatatgcggggtggagtgacaaggtcggtggggtttctatgtttaagttgtggtcatggacaatttgtgatttttccttatgccatgttttgggaatttttgtagctgcctaggctgtggtatgtgctgctgtgggggttcattagtatggaggtggagacctgctggtgctggagtattttcgtctttagtatttttgtttaaaactatgtatgacctaatgatggtattatttgtgtcatccttgactcttgtattctgccgctaccgtatgtatcctgcagtcagcactggtctttgttattctgtgcgagtaaaacctgtttactcgtactgtgctta

SEQ ID NO: 4817 - DNA, 1606 bp, Castanea mollissima
tcgctgttttcacctttcgcctcctctttaactttccattcaaactccacggcgcagatccgaggagtttggaaaaaccctagctctctcttcaaacctctttcaataatctttcactctacttttcttcaacactttcagctatggcaggtgcagctccagaaggttcacaatttgatgctcgccagtttgatgctaaaatgaatgagttactctcaactgatgggcaagaagagttcttcacctcatatgatgaggtttatgaaagttttgattcaatgaaattgcatgaaaaccttctgagaggaatctatgcttacggttttgagaagccttctgcaattcagcaaagggggattgttcctttctgcaaaggtcttgatgttattcaacaggctcagtctggaactgggaaaacagcaactttctgctctgggattttgcaacaacttgattatgagcttgtccagtgccaggctttggttttggcacccactagggaacttgcacaacagattgagaaggttatgcgggcacttggtgattatcttaatgtcaaggttcatgcttgcgttggtggcacaagtgttcgtgaggatcaacgcatccttcaggcaggtgttcatgttgttgtaggcacccctggtcgtgtatttgacatgttgcgaaggcagtcacttcgacctgattacattaagatgtttgtactggatgaggctgatgaaatgctttctcgtggtttcaaggaccagatctatgatattttccagctgcttcccgccaaggttcaggttggggtgttctctgctacaatgcctcctgaagcccttgagatcactaggaagtttatgaacaagcctgtgagaatcttggtgaagcgagatgaactcacccttgagggtatcaagcagttttatgtgaatgttgagaaggaagagtggaagcttgagacactatgtgatctctacgaaaccctggccatcacccaaagtgtcatctttgtgaacacacggcgcaaggttgactggctcactgacaagatgcgtggccgtgaccatacagtctcagccacccatggtgacatggaccagaatactcgtgatataattatgcgtgaattccgctctggatcttcccgtgttctcatcaccactgacctcttggctcgtggtattgatgtgcagcaagtctccttggtcataaactttgatctgccgactcaaccagaaaattaccttcaccgtattggacgaagtggacggtttgggagaaagggtgttgccattaattttgttacaaaggacgatgagcgaatgctgtttgacattcagaagttctacaatgtgcaagttgaggagctgccatcaaatattgcagatctcctgtgatgaagtcttttttggttttgtttgaggcatggggttcccttcctttcatagtactatttattttttaacttcttatttttgttttgttttttttcccccatctagtgtcccaagttaatgttggcaaacatatctgaccttttaatgaattgggttttagggcattgcatattgttgcaacataaagacagtctaagttcttatttcagcttggaggg

SEQ ID NO: 4818 - DNA, 2987 bp, Actinidia deliciosa
caaattcacacataagtaccgaattacattataatttaggtgtcgaaaaaatggtggcaacagtggtcggaactagggtggagagcctagctagcagcgggatcgaggcgatccccaaggagtacgtgcggccgcaggaggagctcaccagcatcggtaacattttcgaggaagagaagaaggagaatggcccacaggtgcccaccatcgacctggaggacttggtttcggaggacgaggagaagagggtgaggtgccatgaggagctgaagagggcggcgacagagtggggggtgatgcaagtggtgaaccacggcataccgatcgagctaatggaccgggtgagggctgcgggggcggaattcttcaaccagtcggtggaggagaaggagaagtacgcgaacgaccacgcgtccgggaacatacaagggtatggaagtaaattggccaataatgctagcgggcagctcgagtgggaggactatttctttcaccttgtctacccggaggacaaaagggacatgtccatttggccaaagacaccaagtgattacattccggcaacaagcgcgtacgcggagcacctacgaggcctagcgaccaaaatcctgtcggctttatctcttggcttaggacttgaagagggtcggctcgagaaagaagttggcggaatggaagaactcctcctccaaatgaaaatcaactattacccaaaatgcccccagcccgagctggccttgggcgtggaggctcacactgacgttagtgccctcacattcatcctccataacatggtcccaggactccagctattctacgagggcaaatgggtaacagcaaaatgtgtccctgactccttagtcatgcacattggcgatacaattgagatactaagtaatgggaagtacaagagcattcttcacagggggctcgtgaacaaggaaaaagttcggatctcgtgggccgttttttgcgagccccccaaggagaagatcatcctgaagccgctcccggagacagtttctgaggcggagccacccctttacccaccccgcacctttgcccagcacattcaccacaagttgttcaggaagacccaggagctcggggctaaatgagtcttttttaaaattaatggtcatcgtcttattatcattgcattttatcccttaatgtcagtcatgtgttgtttgttttgagctcttggggagtgattgttgatggctgatgcaataaacacgtagaacattgcattaaaaagtaatatatggtccatattttgttgtggtgcactgtatttaaagtgaaaaaaaaaaaaaaaaaaaaaaaaactcgcctcttcctcgacttggcggcttagattcgaggagtttggaaaaccctaaccctagcaaaaacagatcgattgcagagacgcgcgctctcctcacgcttctttctctctcttcatccgcagatcttcaacgaccgttaactgctatcagacatggcgggcttggctccagagggttctcaatttgatactcgtcaatatgatacaaaaatgactgagttacttgggacaactgatggcgaagagtttttcacctcatatgatgaagtttatgagagcttcgatgctatgggcttacaagaaaatctcctgaggggcatctatgcctatggttttgagaagccctctgcaattcagcaaaggggcatagttcccttctgcaaaggactcgatgtaattcaacaagcacagtcgggaactgggaaaactgcaactttctgctcaggagttctgcagcagcttgattatagcttagttgagtgccaagctttggtcctagcacccactcgtgaacttgcccagcaaatcgagaaggttatgcgagcattgggcgactaccttggtgtgaaggttcatgcttgtgttggagggaccagtgtgcgcgaggatcagcgcattctctcaagtggggttcatgttgttgtcggtactcctggtcgagtatttgacatgctgcggagacagtcacttcgccctgattacatcaaaatgtttgtgttggacgaggcagatgaaatgctttcacgggggttcaaagatcagatctatgatattttccagctgctgccaccaaaaatccaggttggggtgttctctgccacaatgccaccagaggcccttgaaatcactcggaaattcatgaataaacctgtgaggattcttgtgaaacgtgatgaacttactcttgagggtatcaaacaattctatgtcaacgttgacaaggaggaatggaagcttgagacattatgcgatctctatgaaaccttggccataacccaaagcgtcatcttcattaacacccgacgcaaggttgactggcttactgacaaaatgcgcagtcgtgatcacaccgtctctgccacccatggagacatggatcagaacaccagagatatcatcatgcgggaattccggtctggttcgtcgcgtgtgctcatcaccactgatcttttggcccgtggtattgatgtccagcaggtctctctggtgatcaattttgatctgccgacccagccggagaactacctgcatcgaattggacgtagtggacggtttgggaggaagggtgttgccatcaactttgtgacaaaagacgatgagaggatgctgtttgacatccagaagttctataacgtcgtggttgaggagctcccagcaaacgttgctgatctcctttgagtggtgtttcgatttggcgaggtaaatttcacttggtagttatttattgtcttatttcttagtttttttatagtcgtggttaaacatgtatgagactgcaattttgatatttgggccttatgatttgcatgtatcaggaatcatttggtgcaaattttcttggttcgtttttgtattttatgggtctaaaataacgtgcaaaactggatattgtttgaagttatatcatatttgtgcatcgtttgtttgtaaaaaa

SEQ ID NO: 4819 - DNA, 1845 bp, Zea mays
ggattcgtccacacccaggcacataaaagccgcctctcgccgccgactgcaaaccctcgtttttctctctcctgcgctgcgccgtccttcacctccgccgccgaatccgagactctgatctcgggttcaccgcagcgcacagagcacccccgactcccgtcccgatccgcgctctcctctacgacgcttcagtcatggcaggaatggcacccgagggttctcagtttgatgctaagcactatgattctaaaatgcaggagctgctgagcactggtgagactgaggagttcttcacttcatatgatgaagtttttgaaagttttgatgacatgggccttcaagagaatcttctgagaggcatttatgcatatggttttgagaaaccatctgcaattcagcagagaggaattgttcccttctgcaaggggcttgatgtcattcagcaagcacaatctggtacaggaaagacagcaaccttctgttctgggatcttgcagcagcttgactatggtctggttgaatgccaggccctggttcttgctcccacccgtgagcttgcacagcaaattgagaaagttatgcgcgcacttggtgactaccttggtgttaaagtccatgcatgcgttggaggaacatctgttcgtgaggaccaaaggattctcgccagtggtgtgcatgttgttgttggtacacctggtcgtgtgtttgacatgctgcgtagacagtccctccgccctgataacatcaagatgtttgttcttgacgaagctgatgaaatgctttctcgtggtttcaaggatcagatttatgacatcttccagcttctgccatccaagattcaggttggagtcttctctgctaccatgccacctgaggcccttgagattacccgcaagttcatgaacaaaccagtgagaattcttgtgaagagagatgagctgacccttgagggtatcaagcagttctatgtgaatgtggacaaggaagactggaagctggacacactgtgtgacctgtatgagaccctggccattacccagagtgtcatctttgtcaacacccgccgcaaggtggactggctcactgacaagatgaggagcagggaccacaccgtttctgccactcatggtgacatggaccagaacactagagacatcatcatgagggagttccggtctggctcctcccgtgtgctcatcaccactgacctgcttgctcgtggtattgatgttcagcaggtgtccctggtcatcaactatgatcttcccacccagccagagaactacctgcatcgtattggtcgtagtggtcgttttggtaggaagggtgttgccatcaactttgtgacccgcgacgacgaacgtatgctgtttgacattcagaagttctacaacgtgttgattgaggagctgcctgccaatgttgctgaccttctgtgatcaatttgaagaaaaaacaaaacaaaaaagggtggtgaggaacctggtaaggcttggttttgtcgaaataccgtgggagagggggtgataaggacggtggggtttctatgttgaagtcgtggtcatggacaatttgtgattttttctcctttatgccatgttttggaatttttgtagctgcctaggccttgtggtaatgtgctgctgtgggggttcattagtatgaagaggaagacgctgctggcgcggagtctttctctttattagtattttgtttaaaactatgtatgaccgaatggtggtatttatttgtgtcatccttgactcttattctgctgcaaccagatgtatcgtgccatgtctgcaccactggtctttgctatcctgagtaaaacctgtttactct

SEQ ID NO: 4820 - DNA, 1648 bp, Medicago truncatula
acgcatatataacctaaatctctctctcactcttcccttcaactccacggcgcagatccgaggagtttgggaaaccctaattttcaatctttcttcgatcttcttctcgcttcaattctctcttcttcactcactccacaagcagtcatggcaggtttagctccagaaggttcgcaatttgataccaagcagtttgacactaagatgaatgaattgctttccactgaaggacaagaattcttcacctcatacgatgaagttcatgaaacttttgatgcaatgggattgctagaaaatcttctgagaggcatatatgcttatggttttgagaagccatctgcaatacagcaaaggggaattgttcctttcatcaagggtctcgatgtgattcagcaggctcagtcaggaaccggaaagacagcgacgttctgttctggaattttgcagcagcttgattatggtttggttcagtgccaggctttggttttggccccaacaagggagctggcacagcagattgagaaggttatgagagcacttggtgactaccttggtgttaaggttcatgcttgtgttggtggcactagtgttcgtgaggatcagcgtattctccaaactggtgtccatgttgttgttggtactcctggacgtgtgtttgacatgctgcgaagacagtctcttcggtcagattgcattaaaatgtttgttttggatgaagctgatgaaatgctttcacgtggtttcaaggaccagatctacgacatcttccagttgctgccacccaaaattcaggttggagtgttctctgctacaatgcctccagaggctctggagatcacaaggaagttcatgaataagccagtgagaattctggtaaagcgtgatgaattgacccttgagggtatcaagcagttctacgtgaatgttgacaaggaagagtggaaactagagacattgtgtgacctttacgagactctggctatcactcagagtgtcatttttgtgaacacaaggcgcaaggtggactggctcactgacaagatgcgaggcagagaccatactgtctcagccacccatggagacatggaccaaaacactcgtgatatcatcatgcgtgaattccgctctggctcttctcgagttctcattaccactgaccttttggcccgtggtattgatgttcagcaagtgtctctggtcataaattatgatttgcctacccaacctgaaaactatctccatcgtattgggcgaagtgggcgttttggaagaaaaggtgttgctatcaactttgtcacattggaagatgcaagaatgctggctgatattcagaagttctataatgtgatcgtagaggaattgccttcaaatgttgccgatctactctgatgaattaatttttgttctttgttaagtcatcgggggggctttttagtttttgacaagtgctattttccgcttattttcttttacaatttttacccattagagttcaaagacatctgactctatttataatggattctatgaattttgtttaattacttattattagggtgctctagaccttttttatttctatcttgtgtatttcttttctttaaattaaatttaaaccttatgctagcaacccttatttatatcatac

SEQ ID NO: 4821 - DNA, 1634 bp, Medicago truncatula
cctaaatctctctctcactcttcccttcaactccacggcgcagatccgaggagtttgggaaaccctaattttcaatctttcttcgatcttcttctcgcttcaattctctcttcttcactcactccacaagcagtcatggcaggtttagctccagaaggttcgcaatttgataccaagcagtttgacactaagatgaatgaattgctttccactgaaggacaagaattcttcacctcatacgatgaagttcatgaaacttttgatgcaatgggattgctagaaaatcttctgagaggcatatatgcttatggttttgagaagccatctgcaatacagcaaaggggaattgttcctttcatcaagggtctcgatgtgattcagcaggctcagtcaggaaccggaaagacagcgacgttctgttctggaattttgcagcagcttgattatggtttggttcagtgccaggctttggttttggccccaacaagggagctggcacagcagattgagaaggttatgagagcacttggtgactaccttggtgttaaggttcatgcttgtgttggtggcactagtgttcgtgaggatcagcgtattctccaaactggtgtccatgttgttgttggtactcctggacgtgtgtttgacatgctgcgaagacagtctcttcggtcagattgcattaaaatgtttgttttggatgaagctgatgaaatgctttcacgtggtttcaaggaccagatctacgacatcttccagttgctgccacccaaaattcaggttggagtgttctctgctacaatgcctccagaggctctggagatcacaaggaagttcatgaataagccagtgagaattctggtaaagcgtgatgaattgacccttgagggtatcaagcagttctacgtgaatgttgacaaggaagagtggaaactagagacattgtgtgacctttacgagactctggctatcactcagagtgtcatttttgtgaacacaaggcgcaaggtggactggctcactgacaagatgcgaggcagagaccatactgtctcagccacccatggagacatggaccaaaacactcgtgatatcatcatgcgtgaattccgctctggctcttctcgagttctcattaccactgaccttttggcccgtggtattgatgttcagcaagtgtctctggtcataaattatgatttgcctacccaacctgaaaactatctccatcgtattgggcgaagtgggcgttttggaagaaaaggtgttgctatcaactttgtcacattggaagatgcaagaatgctggctgatattcagaagttctataatgtgatcgtagaggaattgccttcaaatgttgccgatctactctgatgaattaatttttgttctttgttaagtcatcgggggggctttttagtttttgacaagtgctattttccgcttattttcttttacaatttttacccattagagttcaaagacatctgactctatttataatggattctatgaattttgtttaattacttattattagggtgctctagaccttttttatttctatcttgtgtatttcttttctttaaattaaatttaaaccttatgctagcaaaaaataaaaataactg

SEQ ID NO: 4822 - DNA, 1630 bp, Capsicum annuum
gcaggagggatccgaggagttttttcgaagaacacacaaaaaaaccctaattttcaaatcttcagatctttctttaacaaacttcaaatcttgattaatagtcatggcagcagaaggttctcagtttgatgctcgtcaattcgatgcgaaaatgacagagctgcttggtactgaacaacaggaattcttcacatcatatgatgaggtccacgagagttttgacgccatgggtttgcaagaaaaccttttgaggggcatctatgcctatgggtttgagaagccatctgctattcagcaaaggggcattgttcccttttgcaagggccttgacgttatccagcaggcacaatctggaactggaaagactgcaactttctgctctgggatcctccagcagcttgattacagtttagttgaatgtcaggctctcgttcttgcaccaactcgtgagctagcgcaacagattgagaaggttatgcgagcacttggcgactatctgggtgtcaaggttcatgcttgtgttgggggtaccagtgtccgggaggaccagcgtatccttcagagtggtgttcatgttgtggttggtactccaggccgtgtttttgacatgttgcgcaggcagtctcttcgccccgaccacatcaagatgtttgtattggatgaagctgatgaaatgctctctagaggtttcaaggatcagatttatgatatcttccagcttttgccaccaaaaatccaagtgggtgttttctctgccactatgccaccagaggctcttgagattactagaaagttcatgaacaagcccgtgagaattctcgtgaagcgtgatgagctcactcttgaaggtattaagcaattctatgtcaatgtggataaggaagagtggaagctcgaaacgctttgtgatctttacgagaccttggccatcacccaaagtgtcatcttcgtcaacactaggcggaaggttgattggctcactgataaaatgcgcggacgtgatcacacagtatctgcaactcacggagacatggatcagaacacaagagatatcattatgagggagttccgatctggctcatctcgtgtgcttatcacaactgatctccttgctcgtggtattgatgtccagcaagtctcccttgttattaactacgaccttccaacccaaccagaaaactacctgcatcgtattggtcgtagtggacgatttggaaggaagggtgttgctatcaactttgttaccaaggatgatgaaaggatgctttttgacatacagaggttttataacgtcgtgattgaggagctgccggccaatgtcgctgatctcctttaaggcgattttggttttgtgatgggaacttttccttccctacatgaagtagtctaatatatttatccagagtcaactattgcaaattttgtctggtttgtcatcttgtttttttctagtgtccaaatgactttggatttggccgtttgaattgtttaattgaagctgtttttctatggacataagtcaatttacttggtaatctattttgtttcttcttatgtagtttgctctttgataagactcagtttcttttaggtaaaacagtagcataagactaaagttttgttttcccaa

SEQ ID NO: 4823 - DNA, 2058 bp, Sorghum bicolor
gactcgtccactccacaccgcaggcacagcgcgcctcccccttaaaagccgcctctcgccgccgcccgcaaaccctcgtttttctctctcctgcgctgcgccgtccctcagcctcacctccgccgccgaatccgagactccgatctcgggttcaccgcagcgcacagagcacccccaccgactgtcccccggcccgatccgcgctctcatctccgtcgcttcagtcatggcaggaatggcacctgagggttctcagttcgatgctaagcactatgattctaaaatgcaggagctgctgagcactggtgagactgaggagttcttcacttcatatgatgaagtttttgagagttttgatgacatgggtctccaagagaatcttctgagaggcatttatgcttatggttttgagaagccttctgcaattcagcagagaggaattgttcccttctgcaaggggcttgatgtcattcagcaagcacaatctggtacaggaaaaacagcaactttctgttctgggatcttgcagcagcttgattatggcctggtggaatgccaggccttggtccttgctcccacccgtgagcttgcacagcaaattgagaaagtcatgcgcgcacttggtgactacctgggtgttaaggtccatgcatgtgtgggaggaacatctgtccgtgaggatcaaaggattcttgccagtggtgtgcatgttgttgttggtacacctggtcgtgtttttgacatgctgcgtaggcagtccctccgccctgataacatcaagatgtttgtgcttgatgaagctgatgaaatgctttctcgtggtttcaaggatcagatttacgacatcttccaacttcttccagccaagattcaggttggagtcttctctgctaccatgccccctgaggcccttgagatcacccgcaagttcatgaacaagcctgtcagaatccttgtgaagagagatgagctgactcttgagggtatcaagcagttctatgtgaatgtggagaaggaagactggaagctggacacactgtgtgacctgtacgagaccctggccatcacccagagtgtcatcttcgtcaacacccgccgcaaggtggactggctcactgacaagatgaggagcagggaccacactgtctctgccactcacggtgacatggaccagaacactagagacatcatcatgagggagttccggtctggttcctcgcgtgtgctcatcaccaccgacctgcttgctcgtggtattgatgttcagcaagtgtccctggtcatcaactatgatcttcccacccagccagagaactacctgcatcgcattggtcgtagtggtcgtttcggtaggaagggtgttgccatcaactttgtgacccgcgacgacgagcggatgctgtttgacatccagaagttctacaatgtggtgattgaggagctgcctgccaatgttgctgaccttctgtgatcattttgaagaaaaactgaacaaaaaaaagggaggcgaggggaactgataaggcttggttttgtcgaaatatcgcgggggaggaagtgatatggtcggtggggtttctatgttaaagtcgtggtcatggacaatttgtggtttttctttatgccatgttttgggaatttttgtagctgcctaggccttgtggtatgtgctgctgtgggggttcattagtatcaagaggaagacgctgctggcgctggagtgtttttctctttattagtactttgtttaaaactatgtatgaccgaatgatggtatttatttgtgtcatccttgactcttattctgctgcaaccagatgtatcgttccatgtgtttgcagcacttgtttttgctgctctgagtaaaacctttttactcggttgagcttgtcaactgttggtgcacggcctacggtaatgtatttcgaagtggtactactacgcaagatgtggcactggcgttttgtaatagtccttttgtttgctccctgtcttgttcgcttgaatttatcaaattcgttagccaacgaggggagttggatttagtttcctttctga

SEQ ID NO: 4824 - DNA, 1973 bp, Sorghum bicolor
gactcgtccactccacaccgcaggcacagcgcgcctcccccttaaaagccgcctctcgccgccgcccgcaaaccctcgtttttctctctcctgcgctgcgccgtccctcagcctcacctccgccgccgaatccgagactccgatctcgggttcaccgcagcgcacagagcacccccaccgactgtcccccggcccgatccgcgctctcatctccgtcgcttcagtcatggcaggaatggcacctgagggttctcagttcgatgctaagcactatgattctaaaatgcaggagctgctgagcactggtgagactgaggagttcttcacttcatatgatgaagtttttgagagttttgatgacatgggtctccaagagaatcttctgagaggcatttatgcttatggttttgagaagccttctgcaattcagcagagaggaattgttcccttctgcaaggggcttgatgtcattcagcaagcacaatctggtacaggaaaaacagcaactttctgttctgggatcttgcagcagcttgattatggcctggtggaatgccaggccttggtccttgctcccacccgtgagcttgcacagcaaattgagaaagtcatgcgcgcacttggtgactacctgggtgttaaggtccatgcatgtgtgggaggaacatctgtccgtgaggatcaaaggattcttgccagtggtgtgcatgttgttgttggtacacctggtcgtgtttttgacatgctgcgtaggcagtccctccgccctgataacatcaagatgtttgtgcttgatgaagctgatgaaatgctttctcgtggtttcaaggatcagatttacgacatcttccaacttcttccagccaagattcaggttggagtcttctctgctaccatgccccctgaggcccttgagatcacccgcaagttcatgaacaagcctgtcagaatccttgtgaagagagatgagctgactcttgagggtatcaagcagttctatgtgaatgtggagaaggaagactggaagctggacacactgtgtgacctgtacgagaccctggccatcacccagagtgtcatcttcgtcaacacccgccgcaaggtggactggctcactgacaagatgaggagcagggaccacactgtctctgccactcacggtgacatggaccagaacactagagacatcatcatgagggagttccggtctggttcctcgcgtgtgctcatcaccaccgacctgcttgctcgtggtattgatgttcagcaagtgtccctggtcatcaactatgatcttcccacccagccagagaactacctgcatcgcattggtcgtagtggtcgtttcggtaggaagggtgttgccatcaactttgtgacccgcgacgacgagcggatgctgtttgacatccagaagttctacaatgtggtgattgaggagctgcctgccaatgttgctgaccttctgtgatcattttgaagaaaaactgaacaaaaaaaagggaggcgaggggaactgataaggcttggttttgtcgaaatatcgcgggggaggaagtgatatggtcggtggggtttctatgttaaagtcgtggtcatggacaatttgtggtttttctttatgccatgttttgggaatttttgtagctgcctaggccttgtggtatgtgctgctgtgggggttcattagtatcaagaggaagacgctgctggcgctggagtgtttttctctttattagtactttgtttaaaactatgtatgaccgaatgatggtatttatttgtgtcatccttgactcttattctgctgcaaccagatgtatcgttccatgtgtttgcagcacttgtttttgctgctctgagtaaaacctttttactcggttgagcttgtcaactgttggtgcacggcctacggtaatgtatttcgaagtggtactactacgcaagatgtggcactggcgttttgtaatagt

SEQ ID NO: 4825 - DNA, 1914 bp, Saccharum officinarum
cggacgcgtggggcgctcccccccttaaaagccgcctctcgccgctgaccgcaaaccctcgtttttctctctcctgcgctgcgccgtccctcacctccgccgccgaatccgagaccccgatctcgggttcaccgcagcgcaccgagcaccccccgactcccggaccgatccgcgctcttctctccgtcgcttcagtcatggcaggaatggcacctgagggttctcagtttgatgctaagcactttgattctaaaatgcaggagctgctgagcactggtgagactgaggagttcttcacttcatatgatgaagtttttgagagttttgatgacatgggtctccaagagaatcttctgagaggcatttatgcttatggttttgagaaaccttctgcaattcagcagagaggaattgttcccttctgcaagggtcttgatgtcattcagcaagcacaatctggtacaggaaagacagcaactttctgttctgggatcttgcagcagctcgactatggcctggttgaatgccaggccttggtcctcgctcccacccgtgagcttgcacagcaaattgagaaagtcatgcgcgcacttggtgactacctgggtgttaaggtccatgcatgtgtgggaggaacatctgtccgtgaggaccaaaggattcttgccagtggtgtgcatgtagttgttggtacacctggtcgtgtttttgacatgctgcgtaggcagtccctccgccctgataacatcaagatgtttgttcttgatgaagctgatgaaatgctttctcgtggtttcaaggatcagatttatgacatcttccagcttctcccagccaagattcaggttggagtcttctctgctaccatgcctccggaggcccttgagattacccggaagttcatgaacaagccagtgagaatccttgtgaagagagatgagctgacccttgagggtatcaagcagttttatgtgaatgtggagaaggaagactggaagctggacacactgtgtgacctctacgagaccctggccatcacccagagtgtcatcttcgtcaacacccgccgcaaggtggactggctcactgacaagatgaggagcagggaccacactgtttctgccactcatggtgacatggaccagaacaccagagacatcatcatgagggagttccgatctggttcttcccgtgtgctcatcaccaccgacctgcttgctcgtggtattgatgttcagcaggtttccctggtcatcaactatgatcttcccacccagccagagaactacctgcatcgcattggtcgtagtggtcgtttcggtaggaagggtgttgccatcaactttgtgacccgcgatgacgagcggatgctgtttgacatccagaggttctacaacgtggtgattgaggagctgcctgccaatgttgctgaccttctgtgatcattttgaagaaaaacaaaactaaaaaaaaggtggtgaggggacatggtaaggcttggttttgtcgaaatatcgtggggaaggagtgatgatgtcggtggggtttctatgttaaagtcgtggtcatggacaagttgcgatttttctttatgccatgttttgggaatttttgtagctgcctaggcgttgtggtatgtgctgctgtgggggtcattagtatgaagaggaagacctgctggcgctggagtctttttctctttattagtattttgtttaaaactatgtatgaccgaatgatggtatttatttgtgtcatccttgactcttattctgctgcaaccagatgtatcatgccatgtgtctgcagcacaggtccttgttcagagtaaaacctgtttactccgttgagcttgtcagctgttgatgcggtgcgaatggtaatgtatttgaagtggtacgtatgaggctaaat

SEQ ID NO: 4826 - DNA, 1826 bp, Panicum virgatum
gacgcgcgcggcgagggagagagagccagagaggcggaacgagtcgagcagcgccccgcctccgtcggaaccccttataagccgcctccccccaaaccctcccttcccctagcccctgttcctcccccccgcacaagcgccaccgccgaatcgaatccgagacgccgatctcggattcgccgccgccgcacccagagtttcctcctcgccgtcgccgcgctctcctcctccccgccgctcgtcagccatggcaggactagcaccagagggttcccagtttgatgccaagcagtatgacaacaagatgcaggagctactgactgaagacttctttacctcgtatgatgaggtctgtgaaagttttgataacatggggctccaagagaaccttctgagaggcatctatgcctatggttttgagaagccatcagccattcagcaaaggggaattgttcctttctgcaaggggcttgatgtgattcagcaagctcagtctggaacagggaaaacagcaaccttctgttctggaattttgcagcagcttgattatggattggttgagtgccaggcattggttcttgctccaacccgtgagcttgcgcagcagattgagaaggtcatgcgtgctcttggggactatttgggtgtcaaagtgcatgcctgtgttggtggaacatctgtccgtgaggaccagaggattcttgctagtggagtgcatgttgttgtgggcacaccagggcgtgtgtttgatatgttgcgtaggcagtctctacgcccggacaacattaagatgtttgtgttggatgaagctgatgagatgctctctcgtggtttcaaggatcagatctatgatatcttccagcttcttccatcaaagatccaggttggcgtgttctctgctaccatgccccctgaggcccttgagattacccgcaagttcatgaacaagcctgtcaggatccttgtcaagagagatgagctcacccttgagggtatcaagcagttctatgtcaatgtggagaaggaagattggaagctggacactctctgtgacctgtacgagaccctggccatcactcaaagtgtcatctttgtgaacacccgccgcaaggtggactggctcacagataaaatgaggagcagggaccacaccgtctctgccacgcacggtgacatggatcagaacaccagggacatcatcatgagggagttcaggtccgggtcttcccgtgtgctcatcaccaccgacctgcttgcccgtggtattgatgtccagcaggtttccctggtcatcaactacgacctgccgacccagcccgagaactacctccatcgcattggccgtagtggtcggttcgggaggaagggtgttgccatcaactttgtcacccgtgacgacgagcggatgctgtttgacatccagaggttctacaacgtgaccattgaggagctgcctgccaacgttgctgatctcctctagattgtgtcctaggatattgctgctaaggtgctggataaagaagcctgttttagttaaatatcgcaaacttttctctttcctggaggagtggtaatgtcgtgttatctactatttgcattgtggctaaggatggtttctaagcttttcttctatgcaacgtttgggaaaaattttgtagcgtgtaggtctgtgtgccgcatcctgggctagctgggtgctgagacactactggagtatttaccttgctgttaagctatgcttgtcctgagtacttgcttttctgtgcatcatgacggtaaattagttgcctatttactgtgtctgacgctcttacagcgttctgatg

SEQ ID NO: 4827 - DNA, 1765 bp, Avena sativa
agcccaggaccgaagcgagaaaaccctactcgtcccgtcgacgagatagatacagagcgaggagagaagcagtcgagccgcccgccgcttccgtcgggaaccaatataagccgcctttctctctccacccagcctccaccaaaccctcgttcgtctcctccccgcacccaatcgatcgaatccgggacgccgatctcggattcgctcgaccgatcgacatcacagcaaccaaccaagccttcagatcgtctcttcagcaaaagctcttcagtcatggcaggaatggcaccagagggttctcagtttgatgccaagcattatgacagcaagatgtcagagttgctgaaccaaggcgacactgaggactttttcacttcttatgatgaagtgcacgagagttttgatgacatgggcctccaagagaaccttctcagaggcatctacgcatatggttttgagaagccatctgccattcagcagagaggaattgtgcctttctgcaagggacttgatgtgatccagcaagctcagtctggaacaggaaaaaccgccaccttctgctctggaatcctgcagcagctggactatggcttggtcgagtgccaggccctggtccttgctcccacacgtgagcttgcacagcagattgagaaggtcatgcgtgctcttggcgactacctaggcgtcaaggtgcatgcatgtgttggtggaacatctgttcgtgaagaccaaaggattcttgccagcggtgtgcacgttgttgtcggcacacctggtcgtgtgtttgatatgttgcgcaggcaatctcttcgcccagatcagatcaagatgtttgtgctggatgaagctgatgagatgctttcacgtggtttcaaggatcagatctatgatattttccagcttcttcccggaaagattcaggttggcgtgttctctgctaccatgccccctgaagcccttgagattacccgcaagttcatgaacaagcccgtgaggattcttgtgaagagagatgagcttacccttgagggtatcaagcagttctatgtcaatgttgagaaggaagagtggaagctggatactctctgtgacctgtacgagaccctggccattacccagagtgtcatctttgtgaacacccgccgcaaggtggactggctcaccgacaagatgaggggaagggaccacactgtctctgccacccacggagacatggaccagaacactagggacatcatcatgagggagttcaggtctgggtcttcccgtgtgctcatcaccaccgacctgctggctcgtggtatcgatgtccagcaagtttccctcgtcatcaactacgacctgccgactcagcctgagaactacctccatcgcatcggtcgtagtggtcggttcgggaggaagggagttgccatcaacttcgtcacccgcgaggacgagaggatgctcttcgacatccagaagttctacaacgtggtcatcgaggagctccccgccaatgttgctgaccttctctagattatgatcttaggaattgcagtaaggtgctggataagagtttgtttttattaagtatccccaactctcactgtggtagagtggtacggtatgggtctatttgagtcgtggtttgaggacggtctctgtttttatttttcgtatgcaatgttcggaaatttttgtagtctgtaggctgtgatgtttcctgggctagctgggttagtgacactacttgagtaatgagtatttacttttcaatgtgaag

SEQ ID NO: 4828 - DNA, 1586 bp, Brassica oleracea
ctcaatcttcgctctctctttctctcgctcgttgtctttctcactttcgcggtttagatctgagtttggggagatacaagctcccctaagttaacaacaaagcactctactttcgcttccttcagctaccaaatcaatttctctccagtcatggcaggatccgcaccagaaggcacacagtttgatgctcgtcagttcgaccagaagcttaacgaagttctcgagggacaagatgagttcttcacctcttacgacgaggttcacgacagcttcgacgtcatgggactccaagagaatctcctcagaggcatttacgcttacggttttgagaagccatctgcaatccagcaaagaggaatcgtcccgttctgcaaaggcctcgacgtgatccaacaagcccaatctggaacgggcaaaaccgccaccttctgctccggcgtcctccagcagctggacttcgccatcgtccagtgccaagccctcgtcctcgctccaaccagagagctcgcccagcagatcgagaaggtcatgagggcactcggcgactacctcggcgtcaaggtccacgcctgcgtcggcgggaccagcgtccgcgaggaccagcgcatcctccaggccggcgttcacgtcgttgtcggcaccccggggcgtgtcttcgacatgctgaagcgccagtccctccgcgccgacaacatcaagatgtttgttcttgacgaggccgacgagatgctctcccgcgggttcaaggaccagatctacgacatcttccagcttctcccaccaaagatccaagtcggcgtcttctcggcgaccatgcccccggaggctctcgagatcacgaggaagttcatgagcaagccggtgaggatcctggtcaagcgcgacgagctgaccttggaaggtatcaagcagttctacgtcaacgttgagaaggaggagtggaagctcgagacgctctgcgacctctacgagacgctcgccatcactcagagcgtcatcttcgtgaacacgaggaggaaggtggactggctcaccgacaagatgagggggcgtgaccacacggtctcggcgactcacggagacatggaccagaacacgagagacatcatcatgagggagtttaggtccgggtcctcgcgtgtgctcatcaccactgatctcttggctcgtggtatcgatgttcagcaggtgtctttggttatcaactacgatctgccgactcagcctgagaactaccttcaccgtatcggaagaagtgggaggtttgggaggaaaggtgtggcgatcaactttgtgaccaaggatgatgagaggatgctgtttgatatccagaagttttacaacgtggttgttgaggagcttccttccaacgttgctgatctgctttgaggaagaagaaaaggtctctttcttgttacacaaggcactctttgatctgattttgatacctattctctttccatcagcgtttattgttatatctctttaaatttctaagaacgtatctctctttgtgacaatttttatttcttaaatcatatggagtattttattttcttgtctattgcaattcccctggtatgttt

SEQ ID NO: 4829 - DNA, 1602 bp, Brassica oleracea
gatccacagtctctctctctctatacctacctttcgctcttttcttttttagtttatctctttacgattcgcttcagatccgagcttggaagatttcaagctctctctaagaaagtctcacactttttgttcccgaatcaatctcccaagtcatggcaggatcagcaccagaaggcacccagtttgatactcgtcagtttgaccagaggctcaatgaagtccttgagggacaggatgagttcttcacctcctatgatgaggtccatgagagctttgatgccatgggtttgcaagagaaccttcttaggggtatctatgcctatggttttgaaaagccttctgctattcagcaaagaggaatcgttcccttttgcaagggtcttgatgtgatccagcaggctcagtctggtactggcaaaaccgccactttctgctctggtgtcttgcagcagctcgacttctcccttgtccagtgccaggctctcgtcttggctcccaccagagagcttgctcagcagatcgagaaggtcatgcgtgctctcggagactaccttggcgtcaaggtccatgcttgtgttggtggaaccagtgtccgtgaggatcagcgtatcctccaggccggtgtccatgttgtcgttggaactcccggtcgtgtctttgacatgctccgaagacagtctcttcgctccgacagcatcaagatgtttgtccttgatgaagctgatgagatgctctcccgtggtttcaaggaccagatctacgacatattccagcttctcccaccgaagattcaggtcggagtgttctcagccacgatgccgccagaggctctcgagatcacaaggaagttcatgagcaaaccggtgaggatcctggtgaagcgagacgagctcaccctcgaaggtatcaagcagttctacgtgaacgtggagaaggaagagtggaagctcgaaactctctgtgacctctacgagaccttagccatcactcagagcgtcatcttcgtcaacactcgccgcaaggtggactggctcactgacaaaatgaggagccgtgaccacacggtctcagcgactcacggagacatggaccaaaacacgagagacatcatcatgagagagttcaggtctggctcttcccgtgtcctcatcacgacagatctcttggctcgtggtatcgatgtgcagcaagtgtctctggtcatcaactttgacctcccgactcagccggagaattaccttcaccgtatcggaagaagtggaaggtttgggaggaaaggtgtggccattaactttgtgacgaaggatgatgagagaatgctttttgatattcagaaattctacaatgttgttgttgaggagcttccctcaaacgttgccgatctgctttgaagaagaaaggaaaaccaccgttgaagaagaagaagaataggttacttgtttcgcaagcttcttattttgatttttgacccaactttctctgtttctctctctctttactcatcgatacctctcgtctcattttcgaacatatatatgtctcatctgaacatgtttcttcttaatctcatgcaatatttatttattttctcgtttgatgcac

SEQ ID NO: 4830 - DNA, 1557 bp, Brassica rapa
cgctttttatctctttactaatcgcttcagatccgagcttggaagatttcattcaagctctctaagaaagtctttcacttttgttctcaatctctctccatcctactcagtctcccaagtcatggcaggatcagcacctgaaggcacccagttcgatactcgtcagtttgaccagaggctcaatgaagtccttgagggacaggatgagttcttcacctcctatgatgaggtccatgagagctttgatgccatgggtttgcaagagaaccttcttaggggtatctatgcctatggttttgaaaagccttctgctattcagcaaagaggaatcgttcccttctgcaagggtcttgatgtgatccagcaggctcagtctggtactggcaaaaccgccactttctgctctggtgtcttgcagcagcttgacttctccctcgtccagtgccaggctctcgtcttggctcccaccagagagcttgctcagcagatcgagaaggtcatgcgtgctctcggagactaccttggcgtcaaggtccatgcttgtgttggtggaaccagtgtccgtgaggatcagcgcattctccaggccggtgttcacgttgtggttggaactcccggtcgtgtctttgacatgctccgaagacagtctcttcgctctgactccatcaagatgtttgtccttgacgaagctgatgagatgctctcccgtggtttcaaggatcagatctacgacatcttccagcttctcccaccaaagattcaggtcggagtgttctcagctacgatgccaccagaggctctcgagatcacgaggaagttcatgagcaaaccggtgagaatcctggtgaagcgcgacgagctcacgcttgagggtatcaagcagttctacgtgaacgtggagaaggaagagtggaagctcgaaactctctgcgacctctacgagaccttagccatcactcagagcgtcatcttcgtcaacactcgccgcaaggtggactggctcactgacaaaatgaggagccgtgaccacacggtgtcagccactcacggagacatggaccagaacacgagagacatcatcatgagagagttcaggtctggttcctcccgtgtcctcatcacgacggatctcttggctcgtggtatcgatgtgcagcaagtgtctctggtcatcaactttgacctcccgactcagccggagaattaccttcaccgtatcggaagaagtggaaggttcgggaggaaaggtgtggccattaactttgtgacgaaggatgatgagagaatgctttttgatattcagaaattctacaatgttgttgttgaggagcttccctcaaacgtcgccgacctgctttgaagaagaagaaaagaaaaccactgttgttcgccgttgaagaagaaaaggttacttgttttgcaagcttcttattttgatttttgacccatctttgtctgtttctctctctctctctctactcatcgatacctctcgtctcattttcgaacatatatgtctcatctgaacatgtttcttcttagtctcatgcaatattt

SEQ ID NO: 4831 - DNA, 1841 bp, Hordeum vulgare
ccccgccgccgcccaaaccctctgtttttctctctcctgccaatcccctcatcgcctccgctcccacgccgccgaatccgagacctgatctcggattcaccgcagcgcgacccctccggcgatccgcggcacctcctccccgacgcttcagccatggcaggaatggcaccggaaggttcccagtttgatgcaaagaactatgattctaagatgcaggagctgctgagccaaggtgagaccgaggagttcttcacctcatatgatgaagttcatgagagctttgatgacatgggtctccaagagaacctcctcaggggaatttatgcttatggttttgagaagccttctgccatccagcaaagggggattgttcctttctgcaaggggcttgatgttatccagcaggcacaatctggaacaggaaagactgctactttctgttctggaatcctccagcagcttgactatggtttggttgagtgccaggccttggtccttgctcccacccgtgagcttgcgcagcaaattgagaaggtcatgcgtgcccttggtgactacttgggtgtgaaggttcatgcatgtgttggagggacgtcagttcgtgaggaccagaggattcttgcaagtggagtgcatgtcgttgttggtactcctggtcgtgtgtttgacatgctccgtaggcagtctctgcgccctgacaacatcaagatgtttgtccttgatgaagctgatgagatgctttcccgtggattcaaggatcagatttatgacatcttccagctgctcccagggaagattcaagttggtgtcttctctgctaccatgcccccggaagcccttgagattacccgcaagttcatgaacaagcctgtgaggatccttgtcaagagggatgagctcacccttgagggtatcaagcagttctatgtcaatgtggagaaggaagagtggaagcttgacacactgtgtgacctgtacgagactcttgccatcacccagagtgtcatcttcgtgaacacccgccgcaaggtggactggctcaccgacaagatgaggggcagggaccacaccgtctccgctactcatggagacatggaccagaacactagggacatcatcatgagggagttcagatcaggttcttcacgtgtgctcatcaccactgacctgcttgctcgtggtattgatgtccagcaagtgtccctggtcatcaactatgacctcccgacccagccagagaactacctgcatcgcattggtcgtagtggtcggtttggaaggaagggtgtggccatcaactttgttacgcgtgaagatgagaggatgctgtttgacatccagaagttctacaacgtggtgattgaagagctcccagccaacgttgccgaccttctgtgatcgtgcgggctgtggagaacatatggtaaggggggtgggggtcctgacagggctttgtttttgttgaaatatcaccaagtttcttgtctgtgggggaaggcgggtttaagggataaatggtctgctggggttctactttaaagtcgttgtcgtggacaatttgggatttattaagccatgttttgggaatttttgtagttgctaggctgtggttctatgtgctggggagggaggcgtcgctgctcatgttgctgttgctggagtcctcactttatttgttaagactatgtaatgaccgaatgatgttatttgtttgtgtcatccttgactctttacctatcgcatgtaatcctgcaatcgctgctagtaatgctatcgttattctgatatttatcagattacaaactgtttactctttagcaatagcatttgcctgtctagtc

SEQ ID NO: 4832 - DNA, 1851 bp, Hordeum vulgare
cggcacgaggccccgccgccgcccaaaccctctgtttttctctctcctgccaatcccctcatcgcctccgctcccacgccgccgaatccgagacctgatctcggattcaccgcagcgcgacccctccggcgatccgcggcacctcctccccgacgcttcagccatggcaggaatggcaccggaaggttcccagtttgatgcaaagaactatgattctaagatgcaggagctgctgagccaaggtgagaccgaggagttcttcacctcatatgatgaagttcatgagagctttgatgacatgggtctccaagagaacctcctcaggggaatttatgcttatggttttgagaagccttctgccatccagcaaagggggattgttcctttctgcaaggggcttgatgttatccagcaggcacaatctggaacaggaaagactgctactttctgttctggaatcctccagcagcttgactatggtttggttgagtgccaggccttggtccttgctcccacccgtgagcttgcgcagcaaattgagaaggtcatgcgtgcccttggtgactacttgggtgtgaaggttcatgcatgtgttggagggacgtcagttcgtgaggaccagaggattcttgcaagtggagtgcatgtcgttgttggtactcctggtcgtgtgtttgacatgctccgtaggcagtctctgcgccctgacaacatcaagatgtttgtccttgatgaagctgatgagatgctttcccgtggattcaaggatcagatttatgacatcttccagctgctcccagggaagattcaagttggtgtcttctctgctaccatgcccccggaagcccttgagattacccgcaagttcatgaacaagcctgtgaggatccttgtcaagagggatgagctcacccttgagggtatcaagcagttctatgtcaatgtggagaaggaagagtggaagcttgacacactgtgtgacctgtacgagactcttgccatcacccagagtgtcatcttcgtgaacacccgccgcaaggtggactggctcaccgacaagatgaggggcagggaccacaccgtctccgctactcatggagacatggaccagaacactagggacatcatcatgagggagttcagatcaggttcttcacgtgtgctcatcaccactgacctgcttgctcgtggtattgatgtccagcaagtgtccctggtcatcaactatgacctcccgacccagccagagaactacctgcatcgcattggtcgtagtggtcggtttggaaggaagggtgtggccatcaactttgttacgcgtgaagatgagaggatgctgtttgacatccagaagttctacaacgtggtgattgaagagctcccagccaacgttgccgaccttctgtgatcgtgcgggctgtggagaacatatggtaaggggggtgggggtcctgacagggctttgtttttgttgaaatatcaccaagtttcttgtctgtgggggaaggcgggtttaagggataaatggtctgctggggttctactttaaagtcgttgtcgtggacaatttgggatttattaagccatgttttgggaatttttgtagttgctaggctgtggttctatgtgctggggagggaggcgtcgctgctcatgttgctgttgctggagtcctcactttatttgttaagactatgtaatgaccgaatgatgttatttgtttgtgtcatccttgactctttacctatcgcatgtaatcctgcaatcgctgctagtaatgctatcgttattctgatatttatcagattacaaactgtttactctttagcaatagcatttgcctgtctagtc

SEQ ID NO: 4833 - DNA, 1747 bp, Phaseolus coccineus
tggccgggggctgttctcacagttcccactcactttctctcaaaacgcattgtcctctctttctgcggcgtagatctgagcagtttgggaaaccctaactgctctcaccaacgacctcactactctcttcgcctttttctcctccgatcaacgacctctttcttcgccctaagtcatggcaggacttgcacctgagggatcacagtttgatggtcgtcattatgatagcaaaatgaatgagttgcttacaactgatgcacaggatttcttcacatcctatgatgaggtttttgaaagttttgatgctatgggtttgcaagagaatcttctgagaggcatttatgcatatggttttgagaagccatcagctattcagcaaaggggaatagttccattctgcaagggacttgatgttatacaacaggctcagtctggaactgggaagacagcaactttctgttctggaattcttcagcaacttgattataatgtgacagaatgccaagccttggttttagcaccaactcgggagcttgctcagcagattgagaaagttatgcgggcacttggagattatcttggagttaaggtgcatgcatgtgttggaggtaccagtgttcgtgaagaccaacgcattctatcaagtggtgttcatgttgttgttggtactccaggtcgtgtatttgatatgctacgcagacagtcacttcgaccggattacatcaagatgtttgtattggatgaggctgatgaaatgctttcccgtggttttaaagatcagatctatgatatattccagctacttccaagtaagattcaagtgggagttttctctgctacaatgcctcctgaggcactcgagatcaccaggaaatttatgaacaaacctgtgaggatccttgtgaagcgtgatgagctcaccttggagggtatcaagcagttttatgtcaatgttgagaaagaggaatggaagcttgacactctctgtgatctttatgagacattggcaattactcaaagtgtcattttcgtgaacaccagaagaaaggttgattggctgactgacaagatgcgcagccgagatcacacagtctcagcaacccatggagacatggaccagaataccagagacattattatgcgtgaattccgctccgggtcttcccgtgttttgataactactgatcttttagcccgtggtattgatgtccagcaagtgtctttagttataaattacgatctcccaacacagcccgagaactatctccatcgtattggtcgtagtgggaggtttggcaggaaaggtgttgccatcaattttgtcacaaaggatgatgacaaaatgctgtttgacattcagaagttttacaatgtggtagttgaggagctgccttcaaatgttgccgaactcctttgatgagtatttttgttccatcatattagagggaagttggtttccgaggtaagtgttatgtaatgtttcttttcctttttgcccctttgttgtatttctgctaaaccttgtttgactttttcaataggtgtagtaatttaatttacattgtcagttgtctgaatgtcccaagtgataagtacttacaatgtggaatcactttattgtccgaatggtgtattggtagttgcacaccttctaacaagcaaggttttcaattatacgttttggtagttttaacatttgttcattttttcaatgtattcacagtttatcgtggcatggcacgtgaaa

SEQ ID NO: 4834 - DNA, 1749 bp, Brachypodium distachyon
ccgcctctccccgccgtcgcccaaaccctctgtttctctctcctgccaatcccctcatcgcctccgccgccgaatccgagaccccgatctcggattcaccgcagcgcacccaggcgatccgcaccggctcctctccgtcgcttcagccatggcaggaatggcaccagaaggttcccagtttgatgctaagaactatgattctaaaatgcaggagctgctgagccagggtgagactgaggagttcttcacatcctatgatgaagttcatgagagctttgatgacatgggcctccaagagaaccttctcagaggaatttatgcttatggttttgagaagccttctgccatccagcagaggggaattgttcctttctgcaaggggcttgatgttattcagcaagcacaatctggaacaggaaagactgctaccttctgctctggaatcctgcaacagcttgactatggtttggttgagtgccaggccttggtacttgctcccacccgtgagcttgcgcagcagattgagaaggttatgcgtgcacttggtgactacttgggtgtgaaagttcatgcatgtgttggaggaacttctgttcgtgaggatcaaagaattcttgcaagtggggtgcatgttgttgttggaacacctggtcgtgtcttcgacatgttgcgtaggcagtctctgcgccctgatcacatcaagatgtttgtcctggatgaagctgatgagatgctttcccgaggtttcaaggatcagatttatgacatcttccagctgctccccggaaagattcaggttggagtcttctctgctacaatgccccctgaggcccttgagatcactcgtaagttcatgaacaagcctgtgaggatccttgtgaagagggatgagcttacccttgagggtatcaagcagttctatgtcaatgtggagaaggaagagtggaagctcgacacactctgtgacctgtacgagacccttgccatcacccagagtgtcatctttgtgaacacccgccgcaaggtggactggctcactgataagatgaggggcagggaccacacagtttctgccactcatggtgacatggaccaaaacactagggacatcatcatgagggagttcagatctggttcttcccgtgtgctcattaccaccgacctgcttgctcgtggtattgatgtgcagcaagtgtccctggtcatcaactatgatcttccgacccagccagagaactacctccatcgcatcggtcgtagtggtcgttttggtaggaagggtgttgccatcaactttgtgacccgtgaagatgagaggatgctgtttgacatccagaagttctacaacgtggtgattgaagagctcccagccaacgttgctgacctcctgtgatcaagctcctcttgaggacatctggtaaggagcctggtagggcttgtttttgttgaaatatcaccaagtttcttgttctggggggaagtgataaatggttgggggttctactttaaagtcgtggtcatggacaatttcgaatttattatgccatgttttgggaatttttgtagttgctaggctgtgctatgtgctgggtttaagcttgaggatggaggcgcttctgctgctggagtcctcactttatttgttaagactatgtaatgaccgaatgatgttatttatttgtgtcatccttgactctccaccgcatgtaaacctgcaatcgtattgtggagtaaaaactgtttgctctt

SEQ ID NO: 4835 - DNA, 1727 bp, Brachypodium distachyon
taaaagccgcctctccccgccgtcgcccaaaccctctgtttctctctcctgccaatcccctcatcgcctccgccgccgaatccgagaccccgatctcggattcaccgcagcgcacccaggcgatccgcaccggctcctctccgtcgcttcagccatggcaggaatggcaccagaaggttcccagtttgatgctaagaactatgattctaaaatgcaggagctgctgagccagggtgagactgaggagttcttcacatcctatgatgaagttcatgagagctttgatgacatgggcctccaagagaaccttctcagaggaatttatgcttatggttttgagaagccttctgccatccagcagaggggaattgttcctttctgcaaggggcttgatgttattcagcaagcacaatctggaacaggaaagactgctaccttctgctctggaatcctgcaacagcttgactatggtttggttgagtgccaggccttggtacttgctcccacccgtgagcttgcgcagcagattgagaaggttatgcgtgcacttggtgactacttgggtgtgaaagttcatgcatgtgttggaggaacttctgttcgtgaggatcaaagaattcttgcaagtggggtgcatgttgttgttggaacacctggtcgtgtcttcgacatgttgcgtaggcagtctctgcgccctgatcacatcaagatgtttgtcctggatgaagctgatgagatgctttcccgaggtttcaaggatcagatttatgacatcttccagctgctccccggaaagattcaggttggagtcttctctgctacaatgccccctgaggcccttgagatcactcgtaagttcatgaacaagcctgtgaggatccttgtgaagagggatgagcttacccttgagggtatcaagcagttctatgtcaatgtggagaaggaagagtggaagctcgacacactctgtgacctgtacgagacccttgccatcacccagagtgtcatctttgtgaacacccgccgcaaggtggactggctcactgataagatgaggggcagggaccacacagtttctgccactcatggtgacatggaccaaaacactagggacatcatcatgagggagttcagatctggttcttcccgtgtgctcattaccaccgacctgcttgctcgtggtattgatgtgcagcaagtgtccctggtcatcaactatgatcttccgacccagccagagaactacctccatcgcatcggtcgtagtggtcgttttggtaggaagggtgttgccatcaactttgtgacccgtgaagatgagaggatgctgtttgacatccagaagttctacaacgtggtgattgaagagctcccagccaacgttgctgacctcctgtgatcaagctcctcttgaggacatctggtaaggagcctggtagggcttgtttttgttgaaatatcaccaagtttcttgttctggggggaagtgataaatggttgggggttctactttaaagtcgtggtcatggacaatttcgaatttattatgccatgttttgggaatttttgtagttgctaggctgtgctatgtgctgggtttaagcttgaggatggaggcgcttctgctgctggagtcctcactttatttgttaagactatgtaatgaccgaatgatgttatttatttgtgtcatccttgactctccaccgcatgtaaacctgcaatcg

SEQ ID NO: 4836 - DNA, 1609 bp, Brassica napus
gatcaaagtctctctctctctctacctacctatcgctcttttcttttttagtttctctctttacgattcgcttcagatccgagcttggaagatttcaagctctctctaagaaagtcttttactttttgttcccgaatctctctccttctactcaatctccaagtcatggcaggatcagcaccagaaggcacccagtttgatactcgtcagtttgaccagaggctcaatgaagtccttgagggacaggatgagttcttcacctcctatgatgaggtccatgagagctttgatgccatgggtttgcaagagaaccttcttaggggtatctatgcctatggttttgaaaagccttctgctattcagcaaagaggaatcgttcccttttgcaagggtcttgatgtgatccagcaggctcagtctggtactggcaaaaccgccactttctgctctggtgtcttgcagcagctcgacttctcccttgtccagtgccaggctctcgtcttggctcccaccagagagcttgctcagcagatcgagaaggtcatgcgtgctctcggagactaccttggcgtcaaggtccatgcttgtgttggtggaaccagtgtccgtgaggatcagcgtatcctccaggccggtgtccatgttgtcgttggaactcccggtcgtgtctttgacatgctccgaagacagtctcttcgctccgacagcatcaagatgtttgtccttgatgaagctgatgagatgctctcccgtggtttcaaggaccagatctacgacatattccagcttctcccaccgaagattcaggtcggagtgttctcagccacgatgccgccagaggctctcgagatcacaaggaagttcatgagcaaaccggtgaggatcctggtgaagcgagacgagctcaccctcgaaggtatcaagcagttctacgtgaacgtggagaaggaagagtggaagctcgaaactctctgtgacctctacgagaccttagccatcactcagagcgtcatcttcgtcaacactcgccgcaaggtggactggctcactgacaaaatgaggagccgtgaccacacggtctcagcgactcacggagacatggaccagaacacgagagacatcatcatgagagagttcaggtctggctcttcccgtgtcctcatcactacagatctcttggctcgtggtatcgatgtgcagcaagtgtctctggtcatcaactttgacctcccgactcagccggagaattaccttcaccgtatcggaagaagtggaaggtttgggaggaaaggtgtggccattaactttgtgacgaaggatgatgagagaatgctttttgatattcagaaattctacaatgttgttgtcgaggagcttccctcaaacgttgccgacctgctttgaagaagaaaggaaaaccaccgttgttcgccgttgaagaagaagaagaaaaggttacttgtttcgcaagcttcttattttgatttttgacccaactttctctgtttctctctctctctttactcatcgatacctctcgtctcattttcgaacatatatatgtctcatctgaacatgtttcttcttaatctcatgcaatatttatttt

SEQ ID NO: 4837 - DNA, 1636 bp, Brassica napus
gtcgacgggcccattacgggccgggggtattcttttttacaaagcctctcaatcttcgcctgttcagatccgagttttgggagaaacagcctcccaaagttaaccaacaaagcactctactttcgcttcttcagttaccaatctctttcgctcaagtcatggcaggatccgcaccagaaggcacacagtttgatgctcgtcagttcgaccagaagctaaacgaagttctcgagggacaggacgagttcttcacctcttacgatgaggttcacgacagctttgacgccatgggccttcaagagaatctcctcaggggtatctacgcttacggtttcgagaagccttctgcaatccagcaaagaggaatcgtccctttctgccaaggcctcgacgtgatccaacaggcccagtccggaaccggcaaaaccgcgactttctgctccggcgtcctccagcagctagacttcacccttgtccagtgccaggccctcgtcctcgccccgaccagagagctcgcccagcagatcgaaaaggtcatgagagccctcggtgactacctcggcgtcaaggtccacgcctgcgtcggcggaacgagcgtccgggaggatcagcgcatcctccaagccggcgtccatgtcgtcgtcggcaccccgggccgcgtcttcgacatgctgaagcgtcagtccctccgcgccgacagcatcaagatgttcgtcctggacgaggccgacgagatgctctcccgcgggttcaaggaccagatctacgacatcttccagctcctcccgccgaaaatccaggtcggagtgttctcggcgacaatgccaccagaggctctcgagatcacgaggaagttcatgagcaagccggtgaggatcctggtgaagcgcgacgagctaaccttggaaggtatcaagcagttctacgtcaacgtagagaaggaggactggaagctcgagacgctctgcgacctctacgagactctggccatcactcagagcgtcatcttcgtgaacactaggcgtaaggttgactggttaaccgataaaatgagggggcgtgaccacacggtctcggccactcacggagacatggaccagaacacgagagacattatcatgagggagttcaggtccggctcctcgcgcgtgctgatcaccaccgatctgttagcgcgtggtatcgatgttcagcaggtgtcgttggtgattaactacgatttgccgactcagccggagaattacctccaccgtatcggaaggagtgggaggtttgggaggaaaggtgtggcgattaactttgtgacgaaggatgatgagaggatgttgtttgatattcagaagttttataatgttgttgttgaggagctgccttctaacgttgctgatctgctgtgagagggagaagaagttcgccgacgtcaccggagaagaaaggttttttctttgttttgaaagggcacaacaactactcttttgatttgattgtctttcttccgaccatttttattctatatttaagatcattatggagtatttatttctggtttgttgtttgtctttgtatcagtcaaatcttttcatgcaagttttgttttcaaaacgtgttttactttattaatatcctttttaacata

SEQ ID NO: 4838 - DNA, 1759 bp, Brassica napus
gatccgagcttggaagatttcaagctctctaagaaagtctttcacttttgttctcaatctctctccatcctactcactctcccaagtcatggcaggatcagcacctgaaggcacccagttcgatactcgtcagtttgaccagaggctcaatgaagtccttgagggacaggatgagttcttcacctcctatgatgaggtccatgagagctttgatgccatgggtttgcaagagaaccttcttaggggtatctatgcctatggttttgaaaagccttctgctattcagcaaagaggaatcgttcccttctgcaagggtcttgatgtgatccagcaggctcagtctggtactggcaaaaccgccactttctgctctggtgtcttgcagcagcttgacttctccctcgtccagtgccaggctctcgtcttggctcccaccagagagcttgctcagcagatcgagaaggtcatgcgtgctctcggagactaccttggcgtcaaggtccatgcttgtgttggtggaaccagtgtccgtgaggatcagcgcattctccaggccggtgttcacgttgtggttggaactcccggtcgtgtctttgacatgctccgaagacagtctcttcgctctgactccatcaagatgtttgtccttgacgaagctgatgagatgctctcccgtggtttcaaggatcagatctacgacatcttccagcttctcccaccaaagattcaggtcggagtgttctcagctacgatgccaccagaggctctcgagatcacgaggaagttcatgagcaaaccggtgagaatcctggtgaagcgcgacgagctcacgcttgagggtatcaagcagttctacgtgaacgtggagaaggaagagtggaagctcgaaactctctgcgacctctacgagaccttagccatcactcagagcgtcatcttcgtcaacactcgccgcaaggtggactggctcactgacaaaatgaggagccgtgaccacacggtgtcagccactcacggagacatggaccagaacacgagagacatcatcatgagagagttcaggtctggttcctcccgtgtcctcatcacgacggatctcttggctcgtggtatcgatgtgcagcaagtgtctctggtcatcaactttgacctcccgactcagccggagaattaccttcaccgtatcggaagaagtggaaggtttgggaggaaaggtgtggcaattaactttgtgacgaaggatgatgagagaatgctttttgatattcagaaattctacaatgttgttgttgaggagcttccctcaaacgtcgccgacctgctttgaagaagaagaaaagaaaaccactgttgttcgccgttgaagaagaaaaggttacttgttttgcaagcttcttattttgatttttgacccatctttgtctgttcctctctctctatctactcatcgatacctctcgtctcattttcgaacatatatgtctcatctgaacatgtttcttcttaatcgcatgatgcaatatttattaaaaaaaaaaaaaaaaaaaaaaaaaaaaaaaaaaaaaaaaaaaaaaaaaaaaaaaaaaccaaaaaaaaaaaaaaaaaaaaaaaaaaaaaaaccttgcggcccgccccgcccctcgaaaagttttcaaaacctttcgttgggggcggggccccggaaggaaaggaaactgggccatagttttttccaaggaaacccgggccttgacaggggttggaattcccacaaaaaaaa

SEQ ID NO: 4839 - DNA, 1688 bp, Vigna unguiculata
tcagcggcgtagatctgagcagtttgggaaaccctaactgctctcaccaacgacttcaccactctcttcgcctttttctcctccgatcaacgacctctttcttcgccttaagtcatggcaggagttgcacctgaggtatcacagtttgatggtcgtcattatgataacaagatgaatgagttgcttacatctgatggacaagatttcttcacatcctacgacgaggtttttgaaagttttgatgctatgggcttgcaagaaaatcttctgagaggcatttatgcatatggttttgagaagccatcagctattcagcaaaggggaatagttccattctgcaagggacttgatgttatacaacaggctcagtctggaactggaaagacagcaactttctgttctggaattctgcagcaacttgattataatgtgacagaatgccaagccttggttttagcaccaactcgagagcttgctcagcagattgagaaagttatgcgggcacttggagattatcttggtgttaaggtgcatgcatgtgtgggaggtaccagtgtccgtgaagaccaacgcatcctatcaagtggagttcatgttgttgttggtactcctggtcgtgtatttgatatgctgcgcagacagtcacttcgaccagattacatcaagatgtttgtattggatgaggctgatgaaatgctttcccgtggttttaaagatcagatctatgatatattccagcttctcccaactaagattcaagtgggagttttctctgctacaatgcctcctgaggcacttgagatcactaggaaatttatgaacaaacccgtgaggatcctggtgaagcgtgatgagctcaccttggagggtattaagcagttctatgtcaatgttgacaaagaggaatggaagcttgacactctctgtgatctttatgagacattggcaattactcaaagtgtcattttcgtcaacactagaagaaaggttgattggctgactgacaagatgcgcagccgagaccacacagtctcagcaacccacggagatatggaccagaataccagagacattattatgcgtgaattccgctctgggtcttcccgtgttttaataactactgatcttttagctcgtggtattgatgtccagcaagtgtctttagttataaattatgatctcccaacacagcccgaaaactatcttcatcgtattggtcgtagtgggaggtttggcaggaaaggtgttgccatcaattttgtcacaaaggacgatgaaaaaatgctgtacgacattcagaagttttacaatgtggtagtcgaggagctgccttcaaatgttgccgaactcctttgatgatttttgttccatcatattagaagggagttggtttctgaggtaagtgttatgtaatgtttcttttctcttttgccccttttgttgtatttctccctaaaccttgtttgactttttcaataggtgtagtaatttaatttacattgtcagtcgtctggatgtccaaatataagtacttacaatgtggaatcacatattgtccgaatggtgtattgatagttgcacctttctaacaagcagggttttcaattttatgttttggtagttttaacatttgttcattttttcaatgtattcatagagttcatcgtggcatggcacatgaaacatta

SEQ ID NO: 4840 - DNA, 1692 bp, Actinidia deliciosa
ctcaactccgcggcgtagatccgaggagtttgggaaaaccctaaccctaaaaaagaactcatcgcttcgcagacacactctctcacttctttctctctcctcgttcagagatcttcacctacctttacttctaccagacatggcgggattggctccagagggttcacaatttgatgctcgtcaatatgataacaaaatgattgagttacttggggctgatggaggagaagaattcttcacctcatatgatgaagttcatgagagctttgatgcaatgggcttacaagaaaatctcctgaggggcatttatgcttacggttttgaaaaaccctctgctattcagcaaaggggtatagttcccttctgcaaaggacttgatgtaattcaacaagcacagtctggaactgggaaaactgcaactttctgctctggaattctgcagcagcttgattatggtaaagttgagtgccaagccttggttctggcacccactcgtgaacttgcacaacaaatcgaaaaggtcatgcgagcactgggtgactatcttggtgtgaaggttcatgcttgtgtaggagggaccagtgtccgagaagatcagcggattctctcaagtggggttcatgtagtagttggtactcctggtcgagtatttgatatgttgcggagacagtcgctacgtcctgattacatcaaaatgtttgtcttggatgaagcagatgaaatgctttcacgaggtttcaaagatcagatctatgatattttccagttactgccacccaatatccaggttggggtgttctctgccacaatgccacccgaggcccttgaaatcaccaggaaattcatgaataagcctgtgaggattcttgtgaaacgagatgaactcactcttgagggtatcaagcaattttatgtgaatgttgacaaagaggaatggaagcttgagacactttgtgatctttatgaaaccttggccataacccaaagtgtcattttcgtcaacacccgtcgcaaggtcgactggctcactgacaaaatgcgtagccgtgaccacacagtctctgccactcatggagacatggatcagaatacgagagatataatcatgcgtgaattccggtctggttcctctcgtgtactcatcaccactgatcttttggcccgtggtattgatgtccagcaagtgtctcttgtgataaattatgatctcccaacccagccagagaactacctccatcgaattgggcgtagtgggaggttcgggaggaaaggtgttgccatcaacttcgtgaccaaagaggatgagaggatgctgtctgacatacagaggttctacaacgtgatagttgaggagctcccagcaaatgttgctgatctcctttgagggcatttggattggcaaggtaaattgttttcgactcggatgttatttatcatattattacttaagagtcgggcacctgataatgtgcatgtgacttgcaattgggagaattgaaccctttgattggcagctggggacttgcatgttcctaatttggatgtagtagaaatccaatttcggaaattttgttggtttgcttgtgttgtaagtttctaaaataacttgtaaaagtgatgttgtgtgaactacatggttgaattctatgagaatggatattgaagtatgagtgtcatattaaaaaaaaaaaa

SEQ ID NO: 4841 - DNA, 1593 bp, Lotus japonicus
aacctagtttgaaacacacttgttgttgttgtacgcgaaacactcttcctcttccttcaaactccacggcgcagatccgaggagtttggaaaaccctaattcgttctctcttttgcgattctcagtttctctcacttctctcgctccagcatggcaggtttagctccagaaggctcacagtttgatgcgaagcaatatgattccaagatgactgaattgcttgctactgatggacaagaattcttcacctcatatgatgaagtctatgatacttttgattcaatgggattgcatgaaaatctcctgagaggcatatatgcttatggttttgagagaccttctgcaatacagcagaggggaattgttcctttctgcaaaggtcttgatgtgattcagcaggctcagtctggaactggaaagacagcaacattctgttctggaattctacaacagcttaattatgaattggttcagtgccaggctttggttttggcaccaacaagggagctagcacagcagattgagaaggtcatgcgagctctcggtgattatctcggtgtgaaggttcatgcttgtgttggtgggacaagtgttcgtgaggatcagcgcatcctccaagctggagtccacactgttgttggtactcctgggcgtgtgtttgacatgctgaggagacagtctcttcgcccagatagcataaagatgtttgttttggatgaggctgatgaaatgctttcccgtggtttcaaggatcagatttacgacatcttccagctactgccaggtaaaattcaggttggagtgttctctgctacaatgccaccagaagccctggagattacaaggaagttcatgaataagccagtgagaatcctggtcaagcgtgatgaattgactcttgaaggtatcaagcagttttatgtgaatgttgagaaggaagagtggaaactcgagacattatgcgacctgtatgagactcttgctatcactcagagcgtcatttttgtgaacacaaggcgaaaggtcgactggctcactgacaagatgcgaagcaatgaccatacagtgtctgccacccacggagacatggaccagaacactcgtgatatcatcatgcgtgagtttcgctctggctcttctcgagtcctgattaccactgacctcttggctcgtggtattgatgtgcagcaagtttctctggtcattaactatgatctgccgactcaacctgaaaattatcttcatcgtattgggcgaagtgggcgttttggaagaaaaggtgttgctataaattttgtgacattggatgattcaagaatgctgtctgatattcagaagttctacaatgtgaccgtagaggagttgccatcaaatgttgctgatctgctctgatgagttaattttgtttaagtaagtcatcagggtggtgttctctttttgacaagtactattttgtgctctttttctgttacaatttttaatcattagagctagaagatatctgactctatttataatggattctataaaattttgttaattgcttggtagggcgctgaagcccattttgtgtttattctttgttttggtgtc

SEQ ID NO: 4842 - DNA, 1827 bp, Zea mays
ccccccctcccttaaaagccgcctctcgccgccgactgcaaaccctcatttttctctctcctgcgccgcgacgtccctcgccttcgccgccgaatccgagactccgatctcgggttcaccgcagcgcacagagcagccccgactcccggcccgatccgcgctctcctctccgtcgcttcagtcatggcaggaatggcacctgagggttctcagttcgatgctaagcactatgattctaagatgcaggagctgctgagcaccggtgagactgaggagttcttcacttcatatgatgaagtttttgagagttttgatgatatgggcctccaagagaatcttctgagaggcatttatgcttatggttttgagaagccatctgcaattcagcagagaggaattgttcccttctgcaagggtcttgatgtcattcagcaagcacaatctggtacaggaaagacagcaaccttctgttctgggatcttgcagcagctggactatggcctggttgaatgccaggccctggtccttgctcccacccgtgagcttgcacagcaaatcgagaaagtcatgcgcgcgcttggtgattaccttggtgttaaggtccatgcatgtgtgggaggaacatccgtccgtgaggaccaaaggattcttggcagtggtgtgcatgttgttgttggtacacctggtcgtgtgtttgatatgctgcgcagacagtccctccgccctgataacatcaagatgtttgttctagatgaagctgatgaaatgctttctcgtggtttcaaggatcagatttacgacatcttccagcttctcccagccaagattcaggttggagtcttctctgctaccatgccccctgaggcccttgagattacccgcaagttcatgaacaagccagtgagaatcctcgtgaagagagatgagctgactcttgagggtatcaagcagttctatgtgaatgtggataaggaagactggaagctggacacactgtgtgacctgtacgagacccttgccatcacccagagtgtcatctttgtcaacacccgccgcaaggtggactggctcactgacaagatgaggagcagggaccacactgtttctgccactcatggtgacatggaccagaacactagagacatcatcatgagggagttccggtctggctcctcccgtgtgctcatcaccaccgacctgcttgctcgtggtattgatgttcagcaggtgtccctggtcatcaactatgatctccccacccagccagagaattacctgcatcgcattggtcgtagtggtcgtttcggtaggaagggtgttgccatcaactttgtgacccgcgacgacgagcggatgctgttcgacatccagaagttctacaacgtgttgattgaggagctgcctgccaacgtcgctgaccttctgtgatcattttgaagaaaaacagaactaaaagaacggtggtgggggtgatctggtaaggcttggttttgccgaaatattgtgggggaggagtgataaggtcggtggggtttctatgttaaagtcgtggtctcgggcaatatgcgatttttctttatgccatgttttgggaaattttgtagctgcctaggcctcgtgctgttgtggtggttcattagtatgaagacgaaggctctgctggctatgggagtcctttttctttttgttagtattttgtttaaaactatgtatgaccgaattatttgtcatccttgactcaattctgctgcaaccagttgtatcgtgccatgtgtctgcagcaccggtcgttgctgttctgagtaaaatctgtttactctgctttca

SEQ ID NO: 4843 - DNA, 1479 bp, Glycine max
ttctctgttacgtcctcctctcacagccacagccacagccacaaccacaaccacaaccacaacccttcgagtttcagaaaccctaaccccacaataacctctcacaaactcactatttttcatcattcgataattcgaacttccaccatcttccccaaagtttgaaatcatggctgggtcggcacccgaaggatcacaattcgatgctcgtcaatatgatgctaagatgaatgagttacttggaactgatgggcaagatttttttacttcttatgacgaagtttgtgaaagctttgatgctatgggattgcaggagaaccttctgaggggtatttatgcatacggttttgagaagccctctgcaattcaacaaagggggattgttcctttctgcaaggggcttgatgttattcagcaagcacaatctggaactggaaaaactgccaccttttgttctggagttttgcagcagcttgattatagcttagttgaatgccaggcactggttcttgctcccactcgtgaacttgcacaacaaattgaaaaggtcatgcgagcactgggggactatcttggtgtcaaggtccatgtttgtgttggtgggaccattgttcgtgaagatcaacgcatcctctcaagtggggttcatgttgttgttggtactcctggtcgtgtatttgacatgctgtgcagacaatctttgcgccctgataacatcaggatgtttgtattggatgaggcagatgagatgctctctcgaggtttcaaggatcagatctatgatatttttcagctgctgccacctaagatccaggttggggttttctctgccacaatgcctcctgaagccctggaaatcacaaggaagtttatgaacaaacctgtgaggattcttgtaaaacgtgatgagcttaccttggaggggatcaagcaattttttgtcaatgtagacaaggaggattggaagctggagacactatgtgatctttatgaaacattggcaatcacccagagcgttatctttgtgaacaccagacgcaaagtagattggctgacagacaaaatgcggagtcgtgatcacacagtttcagccactcatggagatatggaccaaaacacaagggatatcatcatgcgggaattccgttctgggtcgtcccgtgttcttattaccacagatcttttggcccgtggtattgatgtccagcaagtctcacttgttataaattatgacctgccaactcagccagagaactatctccatcgaattggtcgtagtggacggtttgggagaaagggtgttgctatcaattttgtgacaggagatgatgaaaggatgctatttgacatccaaaagttttataatgtgcagattgaggagttgccagccaatgtagctgatctcatttgatttggtcttcccatcattggtatgctttttatcatggaggccgccgtcattattttgtttatcatggc

SEQ ID NO: 4844 - DNA, 1679 bp, Saccharum officinarum
cggacgcgtgggtacctagccaagcccccctccctgcccttctgccgtggcccaaggaaacgccaccgccgaatcgaatccgagacgccgatctcggattcgcttccatcgccgtagccgcgccctccgtcgtcctcgtcgttcccgccgctcgtctcgtcagccatggcaggattggcaccagaagggtcccagtttgacgacaagcagtatgacaagaaaatgcaggagctactgattgaagacttcttcacttcgtatgatgaagtttgtgaaagttttgacaacatggggctacaagagaaccttctgagaggcatctatgcctatggttttgagaagccatcagctattcagcaaaggggaatagttcccttctgcaaggggctcgatgtgattcagcaggcccaatctggaactggaaaaacagctaccttctgctctggaatcttacagcagcttgattatggattggttgagtgccaggccttggttcttgctccaacccgtgagcttgctcagcaaattgagaaggttatgcgtgctcttggggactatttgggtgtcaaagtgcatgcctgtgttggtggaacatccgtccgtgaggatcaaaggattcttgccagtggtgtgcatgttgttgtgggcacaccagggcgtgtgtttgatatgttgcgtaggcagtcactccgccctgacaacatcaagatgtttgtgctggatgaagctgatgagatgctctcccgtggattcaaggatcagatctatgatatcttccagcttcttccatcgaagattcaggtcggtgttttctcagctaccatgccccctgaggccctcgagatcactcgcaagttcatgaacaagcctgtgaggattcttgtcaagagagatgagctcacccttgagggtatcaagcaattctatgtcaatgtggagaaggaagattggaagctcgacactctatgtgacctgtatgagaccctggctatcacccagagtgtcatctttgtgaacacccgccgcaaggtggactggctcacagacaagatgaggagcagggaccacactgtctcagccacgcacggtgatatggaccagaacactagggacatcatcatgagggagttcaggtccgggtcctcccgtgtgctcatcaccactgacctgctcgcccgtggtatcgatgtccagcaggtctcacttgtcatcaactacgacctgccgacccagcccgagaactatcttcaccgcattggtcgtagtggtcggttcggaaggaagggtgttgccatcaacttcgtcacccgtgacgacgagcggatgctgtttgacatccagaggttctacaacgtgaccattgaggagctgccagccaatgtcgctgaccttctctagatgatgttctctagataatatggctgctaaggtttctggataaagaagtctgtttttgttaaaatacgccaacttttctctgctttggaggagtggtaaggtcggggtctattcgaattgtggcgaaggatggttctaagttcattttctcgtatgcaacatttcggaatttttgtagcgagtaggctatgtgccgctcctgggctagctgggtgctgagacactactggagtattttcactttcactgttgggataattcgtgtctctggatgttctgtc

SEQ ID NO: 4845 - DNA, 1658 bp, Panicum virgatum
ccccgcaccagcgccaccgccgaatcgaatccgagactccgatctcggattcgccgccgtcgtccccgccgcacccagcgttcctcgccgtcgccgtcgccgcgctctcctcctccccgccgctcgtcagccatggcaggactagcaccagagggttcccagtttgatgccaagcagtatgacaacaagatgcaggagctactgactgaagacttctttaccacctatgatgaagtcgttgaaagtttcgataacatggggctccaagagaaccttctgagaggcatctatgcctacggttttgagaagccatcagccattcagcaaaggggaattgttcccttctgcaaggggcttgatgtgattcagcaagctcagtctggaacagggaaaacagctacattctgttctggaattttgcagcagcttgattatggattggttgagtgccaggcattggttcttgctccaacccgtgagcttgcgcagcagattgagaaggtcatgcgtgctcttggggactatttgggtgtcaaagtccatgcctgtgttggtggaacatctgtccgtgaggaccagaggattcttgctagtggtgtacatgttgttgtgggcacaccagggcgtgtgtttgatatgttgcgtaggcagtctctacgcccggacaacattaagatgtttgtgttggatgaagctgatgagatgctctctcgtggtttcaaggatcagatctatgatatcttccagcttcttccatcaaagatccaggttggcgtgttctctgctaccatgccccccgaggcccttgagattacccgcaagttcatgaacaagcctgtcaggatccttgtcaagagagatgagctcacccttgagggtatcaagcagttctatgtcaatgtggagaaggaagattggaagctggacactctctgtgacctgtacgagaccctggccatcactcaaagtgtcatctttgttaacacccgccgcaaggtggactggctcacagacaagatgaggagcagggaccacactgtctccgccacgcacggtgacatggatcagaacaccagggacatcatcatgagggagttcaggtctgggtcttcccgtgtgctcatcaccacggacctgcttgcccgtggtattgatgtccagcaggtttccctggtcatcaactacgacctgccaacccagcctgagaactacctccatcgcattggccgtagtggtcggttcgggaggaagggtgttgccatcaactttgtcacccgcgacgacgagcggatgctgtttgacatccagaggttctacaacgtgaccattgaggagctgccggccaatgttgcagatcttctctagattgtgtcctaggatattgctgctaaggtgctggataaagaagtctgttttagttaaatatcgccaacttttctcttcctggaggagtggtaatgtcgggttatctactatttgcattgtggctaaggatggtttctaagcttttcttctatgcaacgtttgggaaaaattttgtagcttgtaggtctgtgccgcatcctgggctagctgggtgctgagacactactggagtattaccttgctgttaagctatgcttgccctgagttcttacttttctgtgcatcacgatggt

SEQ ID NO: 4846 - DNA, 1597 bp, Triphysaria pusilla
gttttttgcaaacagaagcgaaaaactcagtctttattctcaaactccacggcgcagatccgaggagttattcagcaaactaatcaatctctcaacaagcttgtttccctattcaagtatggcaggttcggcaccagaaggttcacagtttgatgctcgtcagtatgatgctaagatgactgagatagtcgatggtggagatgaattctttacttcatatgatgaggtttatgacagttttgatggtatgggtctgcaggaaaatcttctaagaggaatttatgcttatggttttgagaagccctcggccattcagcagaggggaatcgttccattctgcaaaggactcgatgttatccagcaggctcagtccggaactggaaaaactgctacattctgctctggtattttgcagcagcttgattatggtttgactcagtgtcaggctttggttttggcacccactagagagttggctcagcagatcgagaaggttatgcgtgcccttggtgactaccttggcgtcaaggttcatgcttgtgttggtggaaccagtgttcgggaggaccaacgtatcctttctgctggtgtccacgttgttgttggaacccctggtcgtgtgtttgacatgttgcgcaggcaatctcttcgctctgacagcattaagatgtttgttctggatgaggctgatgagatgctttctcgtggttttaaggatcagatttacgacatcttccagctcctccctgccaaggtccaagttggtgtgttctctgcaacaatgccacctgaggcccttgaaatcactcgcaagttcatgaacaagccagtccgcatcctggtcaagcgtgatgagctcaccctcgagggtatcaagcagttttacgtcaatgtcgagaaggaggaatggaagctcgagacactctgtgacctttacgagactctggccatcacccagagtgtcatcttcgtcaacaccagaagaaaggtcgactggctgaccgacaacatgcgtacccgtgaccacactgtctcagccacccacggtgacatggaccagaacacccgtgacatcatcatgcgtgagtttcgctcgggctcgtcccgtgtcctcattactaccgacttgctggcccgtggtatcgatgtgcagcaagtttcgctcgtgatcaactttgacctgccgactcagccggagaactatctgcatcgtattggtaggagtgggaggtttgggagaaagggtgtggcaattaacttcatgacgactcaggatgagaagatgctgcaggatatacagaagttctataatgtcgtggttgaggagctgccgtcgaatgttgccgatctgctttgaggagttgtttctgttagggttttgttatggtaaatggggccacaatggagtttttaattttttttattttaatttttgttgctagataatttatgttattctgttttattgttgttgatttttattttgcggagattactatctttgttccaccacttgtgaaagtggagaatttgcttatttcattagtggtggccaatattacatactaatgcaattttgtatgtaacgtattctgga

SEQ ID NO: 4847 - DNA, 1756 bp, Triticum aestivum
gtcgagccgcgcgccgcttccgtcggggaccaatataagccggctttctctctccttctccccacagcccaccaaaccctcgctcttcccaccgcaggaaagagctcctctcccctccccacccccaccgcctccgccgacgaaccgatcgaatccgggaccccgatctcggattcgctcggcagatcagcgagcaccagcccccaagcccccggatcgcacttcgtcctccccaccgcgcgcttcagccatggcaggaatggcaccagagggttcgcagtttgatgctaagcagtatgacagcaagatgaccgagttactgaaccaaggtgacactggggagtttttcacctcgtatgatgaggtgcatgaaagttttgatgacatgggtctccaagagaaccttcttagaggcatctacgcatatggttttgagaagccatcagccattcagcaaagaggaattgttcccttctgtaagggtcttgatgtgattcagcaagctcagtctggaacaggaaaaactgccaccttctgttctggaatcttgcagcagcttgactatggattggttgagtgccaggcattggtccttgctccaacccgtgagcttgcacagcagattgagaaggtcatgcgtgctcttggtgactacttaggcgtcaaggtgcatgcttgtgttggtggaacttctgttcgtgaggaccaaaggattcttgccagtggggtgcatgttgttgttggcacacctggtcgtgtgtttgatatgttgcgcaggcaatccctccgcccagataacatcaagatgtttgtgttggatgaagctgatgagatgctttcacgtggtttcaaggatcagatctatgatatcttccagcttcttccatcaaagattcaggttggggtgttctctgctaccatgcctcctgaggcccttgagattacccgcaagttcatgaacaagcccgtgaggattctcgtcaagagagatgagcttacccttgagggtatcaagcagttctatgtcaatgtggagaaggaagagtggaagctggatacactctgtgacctgtacgagaccttggcaattacccagagtgtcatctttgtgaacacccgccgcaaggtggactggctcaccgacaagatgaggggaagggaccacactgtctctgccacgcacggagacatggaccagaacactagggacatcatcatgagggagttcagatctggatcttctcgtgtgctcatcaccactgacctgctggcccgtggtattgatgtgcagcaagtctcccttgtcatcaactacgacctgccaactcagcccgagaactacctccatcgcattggtcgtagtggtcggttcgggaggaagggagttgccatcaactttgtcacccgtgaagatgagaggatgctgttcgacatccagaagttctacaacgtggtcattgaggagctcccggccaatgtcgctgacctgctctagattatatcttaggaatgcagtaaggtgcttgataaagttcgtttttgttgaatatctcccaactctcagttttggagtggtaaggtctgggtctgtttgaatcgtcgttaaggatggtctgagtttttcttgttatgcaatgtccggaaatttttgtagtgcgtaggctgtgccatctcctgggctagctgggatagagtaactctcataagtattttacttttcgttgtgaagttattttattgcgcatctgtttttgca

SEQ ID NO: 4848 - DNA, 1778 bp, Triticum aestivum
gtttttctctctcctgccaatcccctcatcgcctccgctcccacgccgccgaatccgagacctgatctcggattcaccgcgaccagaccctcaggcgatccccggcacctcctccccgacgcttcagccatggcaggaatggcaccggaaggttcccagtttgacgctaagaactatgattctaagatgcaggagctgctgaaccaaggtgagactgaggagttcttcacctcttatgatgaagttcacgagagctttgatgacatgggtctccaagagaacctcctgaggggaatttatgcttatggttttgagaagccttctgccatccagcaaaggggaatcgttcctttctgcaagggccttgatgttatccagcaagcacaatctggaacaggaaagactgctactttctgttctggaatcctccaacagcttgactatggtttggttgagtgccaggccttggtccttgctcccacccgtgagcttgcacagcaaattgagaaggtcatgcgtgcacttggtgactacttgggtgtgaaggttcatgcctgtgttggaggaacttcagttcgtgaggaccaaaggattcttgcaagtggagtgcatgtcgttgttggtacgcctgggcgtgtgtttgacatgctccgtaggcagtctctgcgccctgacaacatcaagatgtttgtcctcgatgaagctgatgagatgctttcccgtggtttcaaggatcagatttatgacatcttccagctgctcccagggaagattcaagttggtgtcttctctgctaccatgccccctgaagcccttgagattacccgcaagttcatgaacaagccagtgaggatccttgtcaagagggatgagctcacccttgagggtatcaagcagttctatgtcaatgtggagaaggaagagtggaagcttgacacactgtgtgacctgtacgagactcttgccatcacccagagtgtcatctttgtgaacacccgccgcaaggtggactggctcaccgacaagatgaggggcagggaccacaccgtctccgccactcacggagacatggaccagaacactagggacatcatcatgagggagttcagatcaggttcttcacgtgttctcatcaccactgacctgcttgcgcgtggtattgatgtccagcaagtgtccctggtcatcaactatgacctcccgacccagccagagaactacctgcatcgcatcggtcgtagtggtcggttcgggaggaagggtgtggccatcaactttgtgacccgtgaagatgagaggatgctgtttgacatccagaagttctacaacgtggtgattgaagagctcccagccaacgttgccgaccttctgtgagcggggcgggctgtggagaacatatggtaagggggtcctgacagggctttgtttttgttgaagtatcaccaaaactttcttgtctgtgggtgggggggttcaagtgataaatggtctgctggggttctactttaaagtcgtggtcgtggacaatttgggatttattaaaggggaatttttgtagttgctaggctgtggttctatgtgctgaggagggaggcgctgctgctcatgctgctgttgctggagtcctcactttatttgttaagactatgtaatgaccgaatgatgttatttgtttgtgtcatccttgactctttacctaccgcatgtaatcctgcaatcggtacttttaatgctatcgttattaaaaactgtttactcatgttttagcaaaaaaaaaa

SEQ ID NO: 4849 - DNA, 1674 bp, Triticum aestivum
ctcgctcttcccaccgcaggaagagagctcctctcccctccccgcccccaccgcctccgccgacgaaccgatcggatccgggacacgatctcggattcgctcggcagatcagcgcgcaccagcccccaagcctccggatcctccttcgtcgtcctccccaccgcaagcttcagccatggcaggaatggcaccagagggttcccagtttgatgctaagcagtatgacagcaagatgaccgagttactgaaccaaggtgacaccggggagtttttcacctcgtatgatgaggtgcacgaaagttttgatgacatgggcctccaagagaaccttcttagaggcatctacgcttatggttttgagaagccatcagccattcagcaaagaggaattgttcccttctgcaagggtcttgatgtgattcagcaagctcagtctggaacaggaaaaactgccaccttctgttctggaatcttgcagcagcttgactatggattggttgagtgccaggcattggtccttgctccgacccgtgagcttgcacagcagattgagaaggtcatgcgtgctcttggtgactacttaggtgtcaaggtgcatgcatgtgttggtggaacttctgttcgtgaggaccaaaggattcttgccagtggtgtgcatgttgttgtcggcacacctggtcgtgtgttcgatatgttgcgcaggcaatccctccgtccagataacatcaagatgtttgtgttggatgaagctgatgaaatgctttcacgtggtttcaaggatcagatctatgatatcttccagcttcttccatcaaagattcaggttggggtgttctcagcaaccatgcctcctgaggcccttgagataacccgcaagttcatgaacaagcctgtgaggattcttgtcaagagagatgagcttacccttgagggtatcaaacaattctatgtcaatgtggagaaggaagagtggaagctggatacactctgtgacctgtacgagaccctggcaattacccagagtgtcatctttgtgaacacccgccgcaaggtggactggctcaccgacaagatgaggggacgggaccacactgtctctgccacgcacggagatatggaccagaacactagggacatcatcatgagggagttcagatctggatcttctcgtgtgctcatcaccaccgacctgctggcccgtggtattgatgtgcagcaagtctcccttgtcatcaactatgacctgccgactcagcctgagaattacctccatcgcattggtcgtagtggtcggttcgggaggaagggagttgccatcaactttgtcacccgtgaagatgagaggatgctgttcgacatccagaagttctacaacgtggtcattgaggagctcccggccaatgtcgctgaccttctctagattatatcttaggaatgcagtaaggtgcttgataaagttcgtttttgttgaatatctcccaactctcagttttggagtggtaaggtctgggtctgtttgaatcgtggttaaggatggtctcttgagttttttcctgttatgcaatgtccggaaatttttgtagtgcgtaggctgtgccatctcctgggctagctgggatagagtgactctcatggagtattttacttttcgttgtgaagttattttattgccca

SEQ ID NO: 4850 - DNA, 1820 bp, Triticum aestivum
tcatcgctgtctggaacagcgttgactcgagaaccgctctgtttttctctctcctgccaatcccctcatcgcctccgctcccacgccgccgaatccgagacctgatctcggattcaccgcagcgacgcgaccaaaccctcaggcgatccccggcacctcctccccgacgcttcagccatggcaggaatggcaccggaaggttcccagtttgacgctaagaactatgattctaagatgcaggagctgctgagccaaggtgagactgaggagttcttcacctcctatgatgaagttcatgagagctttgatgacatgggtctccaagagaacctcctcagaggaatttatgcttatggttttgagaagccttctgccatccagcaaaggggaatcgttcctttctgcaaggggcttgatgttatccagcaagcacaatctggaacaggaaagactgctactttctgttctggaatccttcaacagcttgactatggtttggttgagtgccaggccttggtccttgctcccacacgtgagcttgcacagcaaattgagaaggtcatgcgtgcacttggtgactacttgggtgtgaaggttcatgcatgtgttggaggaacctcagttcgtgaggaccaaaggattcttgcaagtggagtgcatgtcgttgttggtactcctggtcgtgtgtttgacatgctccgcaggcagtctctgcgccctgacaacatcaagatgtttgtcctcgatgaagctgatgagatgctttcccgtggtttcaaggatcagatttatgacatcttccagcttctcccagggaagattcaagttggtgtcttctctgccaccatgccccctgaagcccttgagattacccgcaagttcatgaacaagccagtgaggatccttgtcaagagggatgagctcacccttgagggtatcaagcagttctatgtcaatgtggagaaggaagagtggaagctcgacacactgtgtgacctgtacgagactcttgccatcacccagagtgtcatctttgtgaacacccgccgcaaggtggactggctcaccgacaagatgaggggcagggaccacaccgtctccgccactcacggagacatggaccagaacactagggacatcatcatgagggagttcagatcaggttcttcacgtgtgctcatcaccactgacctgcttgctcgtggtattgatgtccagcaagtgtcccttgtcatcaactatgacctcccaacccagccagagaactacctgcatcgcatcgggcgtagtggtcggttcgggaggaagggtgtggccatcaactttgtgacccgtgaagatgagaggatgctgtttgacatccagaagttctacaacgtggtgattgaagagctcccagccaacgttgccgaccttctgtgatcgggcgggctgtcgagaacatatggtaagggggtcctgacagggctttgtttttgttgaagtatcaccaaactttcttgtctgtgggtgggggggttcaagtgataaatggtctggggttctactttaaagtcgtggtcgtggacaatttgggatttattaagccatgttttgggaatttttgtagttgctaggctgtggttctatgtgctgaggagggaggcgctgctgctcatgttgctgttgctggagtcctcactttatttgttaagactatgtaatgaccgaatgatgttatttgtttgtgtcatccttgactctttacctaccgcatgtaatcctgcaatcggtactagtaatgttatcgttattaaaaactgtttactctttttttagca

SEQ ID NO: 4851 - DNA, 1704 bp, Saccharum officinarum
ctgcagggaccggaccggaccggaatgcccgggtcgagccacgcgtccgagccaagcccccctccctgcccttctgccccgcaaacgccaccgccgaatcgaatccgagacgccgatctcggattcgcttccatcgccgtagccgcgccctccgtcgtcctcgtcgttcccgccgctcgtctcgtcagccatggcaggattggcaccagaagggtcccagtttgacgacaagcagtatgacaagaaaatgcaggagctactgattgaagacttcttcacttcgtatgatgaagtttgtgaaagttttgacaacatggggctacaagagaaccttctgagaggcatctatgcctatggttttgagaagccatcagctattcagcaaaggggaatagttcccttctgcaaggggctcgatgtgattcagcaggcccaatctggaactggaaaaacagctaccttctgctctggaatcttacagcagcttgattatggattggttgagtgccaggccttggttcttgctccaacccgtgagcttgctcagcaaattgagaaggttatgcgtgctcttggggactatttgggtgtcaaagtgcatgcctgtgttggtggaacatccgtccgtgaggatcaaaggattcttgccagtggtgtgcatgttgttgtgggcacaccagggcgtgtgtttgatatgttgcgtaggcagtcactccgccctgacaacatcaagatgtttgtgctggatgaagctgatgagatgctctcccgtggattcaaggatcagatctatgatatcttccagcttcttccatcgaagattcaggttggtgttttctcagctaccatgccccctgaggccctcgagatcactcgcaagttcatgaacaagcctgtgaggattcttgtcaagagagatgagctcacccttgagggtatcaagcaattctatgtcaatgtggagaaggaagattggaagctcgacactctatgtgacctgtatgagaccctggctatcacccagagtgtcatctttgtgaacacccgccgcaaggtggactggctcacagacaagatgaggagcagggaccacactgtctcagccacgcacggtgatatggaccagaacactagggacatcatcatgagggagttcaggtccgggtcctcccgtgtgctcatcaccactgacctgctcgcccgtggtatcgatgtccagcaggtctcacttgtcatcaactacgacctgccgacccagcccgagaactatcttcaccgcattggtcgtagtggtcggttcggaaggaagggtgttgccatcaacttcgtcacccgtgacgacgagcggatgctgtttgacatccagaggttctacaacgtgaccattgaggagctgccagccaatgtcgctgaccttctctagatgatgttctctagataatatggctgctaaggtttctggataaagaagtctgtttttgttaaaatacgccaacttttctctgctttggaggagtggtaaggtcggggtctattcgaattgtggcgaaggatggttctaagttcattttctcgtatgcaacatttcggaatttttgtagcgagtaggctatgtgccgctcctgggctagctgggtgctgagacactactggagtattttcactttcactgttgggataattcgtgtctctggatgttctgtc

SEQ ID NO: 4852 - DNA, 1580 bp, Orobanche aegyptiaca
tccgcggcgcagatccgaggaggtttgggattaatctacactcaaaacaaaccctaaatccacgttttcttttaatctcagattattttctcttcaagcgagcttattctgctgtcagtcatggctggaactgcacccgaaggttctcaatttgatgcaagtaaatttgatgctcgaatgaatgacttggtcggagctgatgctgaggaattcttcacaaattatgatgatgtgtacgacagttttgatgctatgggcttgcaggaaaatctgctcaggggcatctatgcctacggttttgagaagccctctgcaattcaacaaagagggattgttcctttctgcaagggtcttgacgtgattcaacaagctcaatctggcaccgggaaaactgcgaccttctgttccggtatccttcagcagctagactataatgtagttgagtgccaggctttagttctggcacccacccgtgaactcgcgcagcagattgagaaggtcatgcgggcactgggtgattttcttggcgttaaggttcacgcttgcgttggaggtacgagcgtccgtgaggatcagcgtatcctctcgagtggggtccacgttgttgtcggtaccccgggacgtgtgtttgacatgttgaagaggcagtccctacgccctaattacatcaggatgtttgtgttggatgaagccgacgaaatgctttccagaggcttcaaggatcagatatacgatatcttccagatgctgccacctaagatccaagtcggcgtgttctccgccaccatgccgcccgaagccctcgagatcacccgaaaattcatgaacaagcccgtccgcatccttgtgaaacgtgacgaacttaccctcgagggcatcaaacaattctacgtcaacgtggacaaggaggagtggaagctcgagaccctttgcgatctctacgaaaccctagctatcactcagagcgtcatcttcgtcaacacgaggcgtaaggtcgactggctgaccgacaaaatgcggagccgtgaccataccgtctcagccacccacggcgacatggaccagaacaccagagatatcatcatgcgggaattcaggtccgggtcctcgcgggttctcatcaccactgatctgttggcccgtggtatcgatgtccagcaggtgtcgctcgtgatcaactacgatctcccgacccagcccgagaactacttgcatcggatcgggaggagcgggaggttcgggaggaagggtgtcgcgattaatttcgtgacgaaagatgacgaacgcatgctttccgatatacagaggttttataatgtcgtggttgaggagttgccggcgaatgtcgcggatctgctttgaagttttaagttttcgcaagttaaattttattgttggtagtgtagtttaatgtgtaatggagggtattattggcataataggatgttattagtggtgtgattttgggaggagactgtttgatctctcagctttggtgcagttttaagtttttttttttcttaatttgtcgaaaataactgctggttttgatgaatgaagactttgattagcttttaaaa

SEQ ID NO: 4853 - DNA, 1759 bp, Arabidopsis thaliana
ggaaagtgggggtaaagttggaaatataaaaattttggaaaagtagaacaattagaaagaggaaaaccctaaaaaaaaaaagagggggactatataactggctaacacgtattgggttgagtctctctctacctcaatttatattatttgcttcaatcttctctttatcgctccaccagatccaagttcgcgagatttcaagctctctaacaaagttcttcacttttgctctcaaagctttcatctttcattcaactacttaagctccaagtatggcaggatccgcaccggaaggaacacaatttgatacgcgtcagtttgaccagaggctgaatgaagttctcgatggacaggatgagttcttcacctcatatgatgaggtccatgagagctttgatgccatgggtttgcaagagaatcttcttaggggtatctatgcttacggtttcgaaaagccttctgctattcagcaaagaggaattgtacccttttgcaagggtcttgatgtgatccagcaggcacagtctggtactggaaaaaccgccactttctgctctggtgtcttgcagcagcttgactatgcccttctccagtgccaggctctcgttttggctcccaccagagagcttgctcagcagattgagaaggtcatgcgtgcccttggtgactaccaaggtgtcaaggttcatgcctgtgttggtggaaccagtgtccgtgaggatcagcgcattctccaggctggtgttcatgttgtcgttggaactcccggtcgtgtttttgacatgcttagaagacaatctctccgccctgactgcatcaagatgtttgtccttgatgaagctgatgaaatgctctcccgtggtttcaaggatcagatctatgacatattccagcttctcccaccaaagattcaggttggagtgttctctgcgacaatgcctccggaagctttggagatcacaagaaaattcatgagcaaaccagtgagaatcttggtgaaacgtgatgagctcacacttgaaggtatcaagcaattctacgtgaacgtggagaaagaagactggaagcttgagactctctgcgatctctacgagactctagccatcactcagagtgtcatctttgtcaacactcgtcgcaaggtcgactggctcacagacaaaatgagaagccgtgaccacacagtctcagcaactcatggagacatggaccaaaacaccagagacatcatcatgagagagttcaggtctggctcgtctcgtgttctaatcacaaccgatctcttggctcgtggtatcgatgtgcagcaagtctctctagtcataaactttgacctcccaactcagccagagaattaccttcaccgtatcggaagaagtggaaggttcgggagaaagggtgtggcgattaactttgtgactcttgatgatcagagaatgctgtttgatattcagaaattctacaatgtggttgttgaggagcttccctcaaacgtggctgatttgctgtgaagaagaagaagaagaagaagaagaaaggttgcttgtttcgcaaatttcttatttgatttttgacccgtctctctctctctgaatcatcgatacatctttttcattctctagtattcttcatcaactctatcgaacatatatatgtctcttctgaccatatttcttttttatcaaatgcaatatttatttcttctcttgtatgatccaaaaatctttcgtaattacaagtctattcacagcaattctat

SEQ ID NO: 4854 - DNA, 1696 bp, Hordeum vulgare
gcctcgtgccgaatcggcacgagggctcttcccaccgcaggaaagagctcctcccatcccctccccccaccgcctccaccgacgcatcgatcgaatccgggacacgatctcggattcgctcggccaatcgacgcgcaccagccccccggatcgtcgttcgtactcccccaccgcgagcgcttcagccatggcaggaatggcaccagagggttcccagtttgatgctaagcactatgacagtaagatgactgagttactgaaccaaggtgacactgaggagtttttcacctcatatgatgaggtgcatgaaagttttgatgacatgggcctccaagagaaccttcttagaggcatctatgcttatggttttgagaagccatcagccattcagcaaagaggaattgttcccttctgcaagggtcttgatgtgattcaacaagctcagtctggtacaggaaaaactgccaccttctgttctggaatcttgcagcagcttgactatggattggttgagtgccaggcattggtccttgctccgacccgtgagcttgcacagcagattgagaaggtcatgcgtgctcttggtgactacttaggcgtcaaggtgcatgcatgtgttggtggaacttctgtccgtgaggatcagaggattcttgccagtggtgtgcatgttgttgtcggcacacctggtcgtgtgttcgatatgttgcgcaggcaatccctccgcccagataacatcaagatgtttgtgttggatgaagctgatgagatgctatcacgtggtttcaaggatcagatctatgatatcttccagcttcttccatcaaagattcaggttggggtgttctctgctaccatgcctcctgaggctcttgagataacccgcaagttcatgaacaagcccgtgaggattcttgtcaagagagatgagcttacccttgagggtatcaagcaattctatgtcaatgttgagaaggaagagtggaagctggacacactctgtgacctgtacgagaccttggcaattacccagagtgtcatctttgtgaacacccgccgcaaggtggactggctcaccgacaagatgaggggaagggaccacactgtctctgcaacacacggagacatggaccagaacactagggacatcatcatgagggagttcagatctggctcttctcgtgtgctcatcaccaccgacctgctggcccgtggtattgatgtgcagcaagtctcccttgtcatcaactatgacctgccgacccagcctgagaactacctccatcgcattggtcgtagtggtcggttcgggaggaagggagttgccatcaacttcgtcacccgtgaagatgagaggatgctgttcgacatccagaagttctacaacgtggtcattgaggagctcccggccaatgtcgccgaccttctctagattattatcataggaatgcagtaaggtgctcgataaagttcgtttttgttgaatatctcccaactctcagttttggagtggtaaggtctggttctgtttgaatcgcggttaaggatcgagtttttttctttttcttgttatgcaatgtccggaaatttttgtagtgcgtaggctgtgccaactcccgggctagctgggatagagtgacactgatggagtttttacttctcgttgtgaagctattttattgcccctctgttttta

SEQ ID NO: 4855 - DNA, 1592 bp, Brassica napus
ggtcaatcgattttgcactttctctctctctaaaactctttgtttcatctcttgggttcagatccgagttcggaaggtttccaagcactccaaagcctttcacttttgctcttaaagctttcatctctctctctctctctctctcccacacaactcaaactcaagtcatggcaggatcagcaccagaaggcacacagtttgacacgcgtcagtttgatcagaagctcaacgaagtcctggagggacaggacgagttcttcacctcgtatgatgaggtccatgagagctttgatgccatgggtctccaagagaaccttcttaggggcatctatgcttatggttttgaaaagccatctgctattcagcaaagaggaatcgtacccttttgcaacggtctcgacgtgatccagcaggcacagtccggtaccggcaaaaccgccactttctgctctggtgtcttgcagcagctcgacttcacccttgtccagtgccaggctctcgtcttggctccaaccagggagcttgctcagcagattgagaaggtcatgcgtgctctaggagactatcttggcgtcaaggtccacgcctgtgtcggtggaaccagtgtccgtgaggatcagcgtatcctccaagccggtgtccacgtcgtggtgggaacaccaggtcgtgtgttcgacatgctcagaagacagtctcttcgcgctgactccatcaagatgtttgttcttgacgaagccgatgagatgctctcacgcgggttcaaggaccagatctacgacatcttccagctcctcccgccgaagatccaagtcggtgtgttctcggccacaatgccaccggaggctctcgagatcacgaggaagtttatgagcaaaccggtgaggatcttggtgaagcgcgacgagctgactctcgaaggtatcaagcagttttacgtgaacgtggagaaggaagattggaagctggagactctttgcgacctctacgagacgttagccatcactcagagcgtcatcttcgtcaacactcgtcgcaaggtggactggctcacggataaaatgaggagccgtgaccatacggtgtcggctactcacggagacatggaccagaacactagagacattatcatgagagagttcaggtctggttcttcgcgtgtgctgatcacgactgatctcttggctcgtgggattgatgtgcagcaagtgtctctggttattaactttgatctgccgactcagcctgagaactaccttcaccgtattggtaggagtgggaggtttgggaggaaaggtgtggcgattaactttgtgacgaaggatgatgagaggatgctttttgatattcagaagttttacaatgtggttgttgaggagcttccatcgaacgtagctgatcttctttgaagaagaggaagaaaaaggttacttggtttgcaagtttcttatttgacttttgacccatctctctctctctttctgaatcatctcgagaccagttttttatttatttctagtattcaaccaactctttcgaacatatgttgtttcttctgaccatttttcttttttaatctcatgcaatgtttacct

SEQ ID NO: 4856 - DNA, 1595 bp, Brassica napus
gatcaattgatattgcactttctctctctataaactctttgttctatctcttcacattcgggttcagatccaaagtctttcacttttgctcttaaaagctttcatctctctcctacacaactcaaactcaagtcatggcaggatcagcaccagaaggtacacagtttgatactcgtcagtttgaccagaagctcaatgaagtcctcgagggacaagatgagttcttcacctcgtatgatgaggtccatgagagctttgatgccatgggtcttcaagagaaccttcttaggggcatctatgcctatggttttgaaaagccatctgctattcagcaaagaggaatcgtacccttttgcaacggtctcgacgtgatccagcaggcacagtctggtaccggcaaaaccgccactttctgctctggggtcttgcagcagctcgacttcacccttgtccagtgccaggctctcgtcttggctccaaccagggagcttgctcagcagattgagaaggtcatgcgcgctctaggagactatcttggcgtcaaggtccacgcctgtgtcggtggaaccagtgtccgtgaggatcagcgtatcctccaagccggtgtccacgtcgtggtgggaactccaggtcgtgtgttcgacatgctcagaagacagtctctccgcgctgactccatcaagatgtttgtcctcgacgaagccgacgagatgctctcacgcgggttcaaggaccagatctacgacatcttccagctcctcccaccgaagatccaagtcggtgtgttctcagccacaatgccgccggaggctctcgagatcacgaggaagtttatgagcaaaccggtgaggatcttggtgaagcgcgacgagctgactctcgaaggtatcaagcagttttacgtgaacgtggagaaggaagactggaagctggagactctctgtgacctctacgagacgttggccatcactcagagcgtcatcttcgtcaacactcgtcgcaaggtggactggctcacggataaaatgaggagccgtgaccatacggtgtcggcgactcacggagacatggaccagaacactagagacattatcatgagagagttcaggtctggctcttcgcgtgtgctgatcacgaccgatctcttggctcgtgggattgatgtgcagcaagtgtctttggttattaactttgatctgccgactcagcctgagaactaccttcaccgtattggtaggagtgggaggtttgggaggaaaggtgtggcgattaactttgtgaccaaggacgatgagaggatgctttttgatattcagaagttttacaatgtggttgttgaggagcttccatcaaacgtagccgatcttctttgaagaagaggaagaaaaggttacttggtttgcaagtttcgtatttgatttttgacccctctctctctctttctgaatcatctcgagaccagtttttcattttttttttctagtattcaaccaactctttcgaacatatgttgtttctttttaccatttttcttttttaatatcatgcaatgtttacctaattttcttgttacgatgcacaaatcattcgtgagt

SEQ ID NO: 4857 - DNA, 1477 bp, Gossypium hirsutum
  misc_feature (221)..(221): n is a, c, g, or t
  misc_feature (341)..(341): n is a, c, g, or t
  misc_feature (638)..(638): n is a, c, g, or t
atcaggaaattcgacgatcaaatcaaacagtcatggctggagttgcacctgatggatcacaatatgatgctcgtcaatacgacagtaaaatgaatgaattgcttgctgatgatggaaatgacttctttactacttacgatgaggtctacgagagctttgataaaatgggtttgcaagaaaacctcctaagaggcatctatgcttatgggtttgagaagccntctgcaattcaacaaaagggaatcgtgcccttttgtaaaggtttagatgtaattcaacaagcacaatcaggtaccggtaaaacggcgactttctgttctgggatcttacaacagctggantatggtttagtacaatgtcaagctttggttcttgctcccactagggagcttgcgcaacagattgagaaagttatgcgtgcacttggtgattatttgggtgtaaaggttcatgcatgtgttggtggaactagtgtccgggaggatcaacgaatccttgcagctggcgtccatgttgttgttggtaccccgggtcgtgtttttgacatgcttcgtaggcagtctcttcgtgcagattatattaagatgtttgtcctcgatgaagctgatgaaatgctctctcgtggttttaaagatcanatctacgacatattccagcaactccccccgaaaatacaggttggtgttttttctgcaaccatgccacccgaggctcttgaaattaccaggaagtttatgaacaaaccagtcaggattcttgtgaagcgtgatgagctcaccctcgaaggtattaagcagttttatgtcaacgttgacaaggaggagtggaagctcgacacgctttgtgatctctatgaaactttagctataactcagagcgtgatctttgttaacgccagacgcaaagttgattggcttaccgatcaaatgcggagccgtgatcacacagtatccgccacccatggagaaatggaccagaacactcgtgatatcatcatgcgcgagtttcgatcgggatcttctcgtgtgctgatcaccactgatctattggctcgagggattgatgtccagcaggtctcgttggttattaactatgatttgccaacacaaccggagaactatcttcatcgtattggtcgaggtggtcggtttgggaggaaaggtgtagcgatcaacttcacaacacgagatgatgaacggatgcttgccgatatccaaaggttctacaatgtagtgatagaggaactgcctgcaaatgttgcggatttgatctgattgagtcagcattttcatacacaagagcaaaggttgctttagtaaaaaaaagaaagaaagattgtctgtttgttttgtgagtgaaaaggttaaagtggatttggcattcttgacttcattgtattcattgttctctttatttacattacttagatattttaattttttttaaagaatggtatttaattcatattttgatatat

SEQ ID NO: 4858 - DNA, 1698 bp, Pennisetum glaucum
atctcgggttcaccgcagagcaccaaagcaacctccggcgaccggccccgatcaagctctcctctccgcgcgtcagtcatggcgggaatggcacctgagggttcccagttcgatgctaagcactatgattctaaaatgcaggagctgctgagcactggtgagactgaggaattcttcacctcatatgatgaggtttttgagagctttgatgacatgggccttcaagagaaccttctgagaggcatttatgcttatggttttgagaagccttcagcaattcagcagagaggaattgtgcctttctgcaagggccttgatgtcattcagcaagcccaatctggtacaggaaagacagcaactttctgttctggtatcttgcagcagctcgactatggcctggttgaatgccaggccttggtccttgctcccacccgtgagcttgcacagcagattgagaaagtcatgcgcgcacttggtgactacctgggtgtgaaagttcatgcatgtgtgggtggaacttcagtccgtgaggaccaaaggattcttgccagtggcgtgcatgttgttgttggtacacctgggcgtgtctttgacatgttgcgtaggcagtcactccgtcctgatcacatcaagatgtttgtcctggatgaagctgatgagatgctttctcgtggtttcaaggatcagatttatgacatcttccagcttctcccagcaaagattcaggttggagtcttctctgctacaatgcctccagaggctcttgagattacccgcaagttcatgaacaaacctgtgagaattcttgtgaagagagatgagctcacccttgagggtatcaagcagttctatgtgaatgtggagaaggaagactggaagctggacacgctatgtgacctgtacgagacccttgccatcacccagagtgtcatcttcgtcaatacccgtcgaaaggtggactggctcactgacaagatgaggagcagggaccacactgtttctgccactcacggtgacatggaccagaacactagggacatcatcatgagggagttcaggtctggttcatcccgtgttctcatcaccaccgacctgcttgcccgtggtattgatgttcagcaggtgtccctggtcatcaactatgatctccccacccagcctgagaactaccttcatcgcattggtcgtagtggtcgtttcggtaggaagggtgttgccataaactttgtgacccgtgatgatgacaggatgctgtttgacatccagaggttctacaacgtggtgattgaggagctgccggccaatgttgctgaccttctgtgatcaagtttgaggaaaaacaaaacagaacaaaaaaaagtgactgcctaggcctgtggtatgttctactgtgggggttcattagcatggagggggagaaggggaaggagatgcgccgccgcgtgatggagctcaaggagagcgccgtggcctcggcgaggcccggcggacggtccatccgcaacctcgacaggctcatcgacgaggtgctcgctcctggcttgttgaacagtggacactagctagctaaatgcctggcctgtcttgatggcttcttgttgcttgccggctggcgctggcaagatattagtatcaaatctttgtgatttggatctgatgatatgtagcgatttgatcattacaatatgtactgaagac

SEQ ID NO: 4859 - DNA, 1836 bp, Oryza sativa
gtcgggtcccctttataacctctctctctctttctctctctctcctcccaaaccctcaatcgtcgcatcgcctcctcctcctctcgccgctcgcagcgaaaaagccagcgcctcccagcgcccacgcgatcccgacgaatcgaatcgagtccgagacgccgatctcggattcgagaccgttgatttcaaccaacacaagccctcctccggatcgatccgctcctcttcagccatggcaggaatggcacccgaaggctcccagtttgatgctaagcactatgacagcaagatgcaggaactactgcaccaaggtgacaatgaggaattcttcacttcatatgatgaagtttttgagagttttgatgacatgggcctccaagagaaccttctcagaggcatctatgcttatggttttgagaagccatcagctattcagcaaagggggattgttcccttctgcaaagggcttgatgtgattcagcaggctcaatctggaacaggaaaaactgctaccttctgttctgggatcctgcagcaacttgactatggattggtggagtgccaatccctggtccttgcaccaacacgtgagcttgcccagcaaattgaaaaggtcatgcgtgctcttggtgactacttaggtgtcaaggtgcatgcctgtgttggtggaacctctgtccgtgaggaccaaaggattcttgctagtggtgtgcatgttgttgttggcacacctggacgtgtgtttgacatgctacgtcggcaatctctccgcccagaccacattaagatgtttgtgctggatgaagctgatgagatgctctcccgtggtttcaaggatcagatctatgatatcttccagctccttccaccaaagatccaggtcggagtgttctctgctaccatgcctcctgaggcccttgagatcacccgcaagttcatgaacaagcccgtgaggattcttgtgaagagagatgagcttacccttgagggtatcaagcaattctacgtcaatgtggagaaggaagattggaagctcgacactctttgtgacttgtatgagacactggccatcacccagagtgtcatctttgtgaacacccgccgcaaggtggactggctcaccgacaagatgaggagcagggaccacactgtctctgccacacatggagacatggaccagaacactagggacatcatcatgagggagttccgatctggttcttcccgtgtgcttatcaccactgatctgcttgctcgtggtatcgatgtccagcaagtctcccttgtcatcaactacgacctgcccacccagcctgagaactacctccatcgcattggtcgtagtggtcggtttggcaggaagggagttgccattaactttgtcacccgcgatgatgagaggatgctgttcgacatccagaggttctacaatgtgaccatcgaggagctgccggccaacgtcgctgaccttctctagattatgtcttaggaagtaaggttctggataaaagtttgtttttgtttttgttttaatatgaccaactttctcgtttgggaggagtggtaaggacggggtctatttgaattgtggttaaggacggcttccatgtttttctcttttccgtatgcaactatgtttggaaatttttgtagctgttaggctgtgctgcttcctgggctagctgggagagggagacactactggaatatttactttctttattaagctatgcttgccttgtgttattattccaatctgctcttacattcttcagctgtttgcaatccgtacaaattttgttcttattggtaatgtgaaatctaacttgtttcgag

SEQ ID NO: 4860 - DNA, 1894 bp, Sorghum bicolor
gaggaacgggtcgagccgcgccccgcctccgtcggaaccccttataagccgcctccccccaaaccctccctagcccagcctcccctgccctgccctgccctgcccttctcaccccgccacagccgaatcgaatccgagacgccgatctcggattcgcttccaccgccgtagccgcgccctccgtcgtcctcgtcgctctcaccgctcgtctcgtcagccatggcaggattggcaccagaagggtcccagtttgatgacaagcagtatgacaagaaaatgcaggagatactaactgaggacttcttcacttcgtatgatgaagtttgtgagagttttgacaacatggggctacaagagaaccttctgagaggcatctatgcctatggttttgagaagccatcagctattcagcaaagaggaattgttcccttctgcaaggggcttgatgtgattcagcaagcccaatctggaactggaaaaacagctaccttctgttctggaatcttacagcagcttgattatggattggttgagtgccaggccttggttcttgctccaacccgtgagcttgcgcagcaaattgagaaggttatgcgtgctcttggggactatttgggtgtcaaagtgcatgcctgtgttggtggaacatctgtccgtgaggaccaaaggattcttgccagtggtgtgcatgttgttgtgggcacaccagggcgtgtgtttgatatgttgcgtaggcagtctctccgccctgacaacatcaagatgtttgtgctggatgaagctgatgagatgctctcccgtggattcaaggatcagatctatgatatcttccagcttcttccatcgaagattcaagttggtgtgttctcagctaccatgcccccagaggccctagagatcacccgcaagtttatgaacaagcctgtgaggattcttgtcaagagagatgagcttacccttgagggtatcaagcaattctatgtcaatgtggagaaggaagactggaagctcgacacattatgtgacctgtatgagaccctggcaatcacccagagtgtcatctttgtgaacacccgccgcaaggtggactggctcacagacaagatgaggagcagggaccacaccgtctcagccacacacggtgatatggaccagaacaccagggacatcatcatgagggagttcaggtccgggtcctcccgtgtgctcatcaccactgacctgcttgcccgtggtattgatgtccagcaggtctcacttgtcatcaactacgacctgccgacccagcctgagaactaccttcaccgcattggtcgtagtggtcggtttggaagaaagggtgttgccatcaactttgtcacccgcgatgatgagcggatgctgtttgacatccagaggttctacaacgtgaccattgaggagctgccggccaacgtcgctgaccttctctagatgatgtcctctagataatatgggctgctaaggtttctggataaagaagtctgtttttgttaaaatacgccaacttttctctgcttttggaggagtggtaaggtcgggttctattcgaattgtggcgaaggatggtttctaagttaattttctcgtatgcaacatttcggaatttttgtagcgagtaggctatgtgccgctcctgggttagctgggtgctgagacactactggagtatttttacattcactgttatgaatcattcctgtcgctgtgtaccttctgtttgctgaagatgtgggggtatcaagcagaacctgcgtagacgatgctacatacctcccatcgtagaaattatgcaattctagtgattcagtctagatcacaatgtcttaatttcgtcagatttgtagaaaacagtttatgcgatttaaaaataggt

SEQ ID NO: 4861 - DNA, 1823 bp, Sorghum bicolor
agcccagcctcccctgccctgccctgccctgcccttctcaccccgccacagccgaatcgaatccgagacgccgatctcggattcgcttccaccgccgtagccgcgccctccgtcgtcctcgtcgctctcaccgctcgtctcgtcagccatggcaggattggcaccagaagggtcccagtttgatgacaagcagtatgacaagaaaatgcaggagatactaactgaggacttcttcacttcgtatgatgaagtttgtgagagttttgacaacatggggctacaagagaaccttctgagaggcatctatgcctatggttttgagaagccatcagctattcagcaaagaggaattgttcccttctgcaaggggcttgatgtgattcagcaagcccaatctggaactggaaaaacagctaccttctgttctggaatcttacagcagcttgattatggattggttgagtgccaggccttggttcttgctccaacccgtgagcttgcgcagcaaattgagaaggttatgcgtgctcttggggactatttgggtgtcaaagtgcatgcctgtgttggtggaacatctgtccgtgaggaccaaaggattcttgccagtggtgtgcatgttgttgtgggcacaccagggcgtgtgtttgatatgttgcgtaggcagtctctccgccctgacaacatcaagatgtttgtgctggatgaagctgatgagatgctctcccgtggattcaaggatcagatctatgatatcttccagcttcttccatcgaagattcaagttggtgtgttctcagctaccatgcccccagaggccctagagatcacccgcaagtttatgaacaagcctgtgaggattcttgtcaagagagatgagcttacccttgagggtatcaagcaattctatgtcaatgtggagaaggaagactggaagctcgacacattatgtgacctgtatgagaccctggcaatcacccagagtgtcatctttgtgaacacccgccgcaaggtggactggctcacagacaagatgaggagcagggaccacaccgtctcagccacacacggtgatatggaccagaacaccagggacatcatcatgagggagttcaggtccgggtcctcccgtgtgctcatcaccactgacctgcttgcccgtggtattgatgtccagcaggtctcacttgtcatcaactacgacctgccgacccagcctgagaactaccttcaccgcattggtcgtagtggtcggtttggaagaaagggtgttgccatcaactttgtcacccgcgatgatgagcggatgctgtttgacatccagaggttctacaacgtgaccattgaggagctgccggccaacgtcgctgaccttctctagatgatgtcctctagataatatgggctgctaaggtttctggataaagaagtctgtttttgttaaaatacgccaacttttctctgcttttggaggagtggtaaggtcgggttctattcgaattgtggcgaaggatggtttctaagttcattttctcgtatgcaacatttcggaatttttgtagcgagtaggctatgtgccgctcctgggttagctgggtgctgagacactactggagtatttttacattcactgttatgaatcattcctgtcgctgtgtaccttctgtttgctgaagatgtgggggtatcaagcagaacctgcgtagacgatgctacatacctcccatcgtagaaattatgcaattctagtgattcagtctagatcacaatgtcttaatttcgtcagatttgtagaaaacagtttatgcgatttaaaaataggt

SEQ ID NO: 4862 - DNA, 1897 bp, Hordeum vulgare
tctcgtgcttttattagtagagatgtgttctacctgaaacaagtatacaatagttctgaaattgcttttgaagcttgttaatttggcgatcggtggcgttgcttcccgacgagccacgactcatagagctttttcgtccgcgtgctcaatgtgtggtaggccgtgaaccaaatcgccacacgtggccatccttgatagccgtgtgtagatacgcctcatgacgaggaaagagctcctcccctccctccccccaccgcctccaccgacgcatcgatcgaatccgggacacgatctcggattcgctcggccaatcgacgcgcaccagccccccggatcgtcgttcgtcctcccccaccgcgagcgcttcagccatggcaggaatggcaccagagggttcccagtttgatgctaagcactatgacagtaagatgactgagttactgaaccaaggtgacactgaggagtttttcacctcatatgatgaggtgcatgaaagttttgatgacatgggcctccaagagaaccttcttagaggcatctatgcttatggttttgagaagccatcagccattcagcaaagaggaattgttcccttctgcaagggtcttgatgtgattcaacaagctcagtctggtacaggaaaaactgccaccttctgttctggaatcttgcagcagcttgactatggattggttgagtgccaggcattggtccttgctccgacccgtgagcttgcacagcagattgagaaggtcatgcgtgctcttggtgactacttaggcgtcaaggtgcatgcatgtgttggtggaacttctgtccgtgaggatcagaggattcttgccagtggtgtgcatgttgttgtcggcacacctggtcgtgtgttcgatatgttgcgcaggcaatccctccgcccagataacatcaagatgtttgtgttggatgaagctgatgagatgctatcacgtggtttcaaggatcagatctatgatatcttccagcttcttccatcaaagattcaggttggggtgttctctgctaccatgcctcctgaggctcttgagataacccgcaagttcatgaacaagcccgtgaggattcttgtcaagagagatgagcttacccttgagggtatcaagcaattctatgtcaatgttgagaaggaagagtggaagctggacacactctgtgacctgtacgagaccttggcaattacccagagtgtcatctttgtgaacacccgccgcaaggtggactggctcaccgacaagatgaggggaagggaccacactgtctctgcaacacacggagacatggaccagaacactagggacatcatcatgagggagttcagatctggctcttctcgtgtgctcatcaccaccgacctgctggcccgtggtattgatgtgcagcaagtctcccttgtcatcaactatgacctgccgacccagcctgagaactacctccatcgcattggtcgtagtggtcggttcgggaggaagggagttgccatcaacttcgtcacccgtgaagatgagaggatgctgttcgacatccagaagttctacaacgtggtcattgaggagctcccggccaatgtcgccgaccttctctagattattatcataggaatgcagtaaggtgctcgataaagttcgtttttgttgaatatctcccaactctcagttttggagtggtaaggtctggttctgtttgaatcgcggttaaggatcgagtttttttttttcttgttatgcaatgtccggaaatttttgtagtgcgtaggctgtgccaactcccgggctagctgggatagagtgacactgatggagtattttacttctcgttgtgaagctattttattgcccctctgtttttacatgctcgagctcattcc

SEQ ID NO: 4863 - DNA, 1619 bp, Brassica napus
agcttggacgcctgcaggtacacggtccggattcccgggtcgacccacgcgtccgcccacgcgtccgaaaggctctcaatcttcgctctctttttctctcgctcgttgtctctctcactttcgcggtttagatctgagtttggggagatacaagctcccctaagttaacaacaaagcactctactttcgcttccttcagctaccaaatcaatttctctccagtcatggcaggatccgcaccagaaggcacacagtttgatgctcgtcagttcgaccagaagcttaacgaagttctcgagggacaagatgagttcttcacctcttacgacgaggttcacgacagcttcgacgtcatgggactccaagagaatctcctcagaggcatttacgcttacggttttgagaagccatctgcaatccagcaaagaggaatcgtcccgttctgcaaaggcctcgacgtgatccaacaagcccaatctggaacgggcaaaaccgccaccttctgctccggcgtcctccagcagctggacttcgccatcgtccagtgccaagccctcgtcctcgctccaaccagagagctcgcccagcagatcgagaaggtcatgagggcactcggcgactacctcggcgtcaaggtccacgcctgcgtcggcgggaccagcgtccgcgaggaccagcgcatcctccaggccggcgttcacgtcgttgtcggcaccccggggcgtgtcttcgacatgctgaagcgccagtccctccgcgccgacaacatcaagatgtttgttcttgatgaggccgacgagatgctctcccgcgggttcaaggaccagatctacgacatcttccagcttctcccaccaaagatccaagtcggcgtcttctcggcgaccatgcccccggaggctctcgagatcacgaggaagttcatgagcaagccggtgaggatcctggtgaagcgcgacgagctgaccttggaaggtatcaagcagttttacgtcaacgttgagaaggaggattggaagctcgagacgctctgcgacctctacgagacgcttgccatcactcagagcgtcatcttcgtgaacacgaggaggaaggttgactggctcaccgacaagatgagggggcgtgaccacactgtctcggctactcacggagacatggaccagaacacgagagacatcatcatgagggagtttaggtctggctcctcgcgtgtgctcatcaccactgatctcttggctcgtgggattgatgttcagcaggtgtctttggttatcaactacgatctgccgactcagcctgagaactaccttcaccgtatcggaagaagtgggaggtttgggaggaaaggtgtggcgatcaactttgtgaccaaggatgatgagaggatgctgtttgatatccagaagttttacaacgttgttgttgaggagcttccttccaacgttgctgatctgctttgagggagagaagaaaaggtctctttcttgttacacaaggcactctttgatctgattttgatacctattatctctctttccatcagcgtttattgttatctctctttaaatttctaagaacatatctctctctttgtgacaatttttatttctaaaatc

SEQ ID NO: 4864 - DNA, 1446 bp, Artemisia annua
  misc_feature (572)..(572): n is a, c, g, or t
tggatcaaaaaccctagaagcagccatcttctttttcatcatcatcattacccaccttttcttcaatctttcttttcatcacaacaacaaaaaaagtcatggcaggtgttgcagcagaaggatctcagttcgatactcgtcaatttgactccaaaatggatgagttgctttcagccgacggacaagacttctttacatcatatgacgaggttaccgaaacttttgacgccatgggtttgctagagaatcttctgagaggcatatatgcatatggttttgagaaaccatccgcaatccagcaaaggggaattgtacccttcaccaagggtcttgacgtcattcaacaagctcaatctggaacagggaagactgcaactttttgctctggcattcttcaacaacttgattacaacgtggtggaatgccaagccttggttttggcacccactcgtgaacttgcccaacaaattgagaaagttatgcgtgcacttggtgactaccttggtgtaaaggttcatgcttgtgttggtggaaccagtgttcgtgaggaccagcgtatcctctcggctggngttcatgctgttgttggtacacctggacgtgtgtttgacatgttgaggaggcagtcgttgcggtccgactatatcaagatgtttgtgctggatgaggctgatgagatgctttcaagaggattcaaggatcagatttacgacatctttcaattgctgccaccaaaggtacaagttggagtcttttctgcaacaatgcccccagaggcactggaaatcacaaggaagttcatgaataaacccgtgaggattcttgtgaagcgtgatgagctcacattggaaggtattaaacagttttatgtcaatgttgaaaaggaggactggaagcttgagacactctgtgatctgtacgaaacattggccatcactcagagtgtcatctttgtcaacacacgtcgtaaggttgactggttgaccgataagatgagaagcagagatcacaccgtgtcagcaacacatggagacatggaccagaacacaagagacatcatcatgcgtgagttccgttctggatcttcacgtgtactcatcaccacagatcttttggctcgtggtattgacgtgcagcaagtttctctagtcatcaactatgatcttcctactcagcccgagaactaccttcaccgtattggacgaagtggtcggtttggaagaaagggtgttgccatcaatttcgtcactctggatgactcaagaatgctttcggatatccagaagttctacaatgtggttgtggaggagctcccttcgaatgttgctgacctgatctaattaaattttgtttcattgaatgtttatttaggaaactactttttgctcagaagagtatggattgacattagcttattttagattaatctcatctattttattagcg

SEQ ID NO: 4865 - DNA, 1503 bp, Brassica napus
agatccgagtttgggagaaacagcctcccaaagttaaccaacaaagcactctactttcgcttcttcagttaccaagtcatggcaggatccgcaccagaaggcacacagtttgatgctcgtcagttcgaccagaagctaaacgaagttctcgagggacaggacgagttcttcacctcttacgatgaggttcacgacagctttgacgccatgggccttcaagagaatctcctcaggggtatctacgcttacggtttcgagaagccttctgcaatccagcaaagaggaatcgtccctttctgccaaggcctcgacgtgatccaacaggcccagtccggaaccggcaaaaccgcgactttctgctccggcgtcctccagcagctagacttcacccttgtccagtgccaggccctcgtcctcgccccgaccagagagctcgcccagcagatcgaaaaggtcatgagagccctcggtgactacctcggcgtcaaggtccacgcctgcgtcggcggaacgagcgtccgggaggatcagcgcatcctccaagccggcgtccatgtcgtcgtcggcaccccgggccgcgtcttcgacatgctgaagcgtcagtccctccgcgccgacagcatcaagatgttcgtcctggacgaggccgacgagatgctctcccgcgggttcaaggaccagatctacgacatcttccagctcctcccgccgaaaatccaggtcggagtgttctcggcgacaatgccaccagaggctctcgagatcacgaggaagttcatgagcaagccggtgaggatcctggtgaagcgcgacgagctaaccttggaaggtatcaagcagttctacgtcaacgtagagaaggaggactggaagctcgagacgctctgcgacctctacgagactctggccatcactcagagcgtcatcttcgtgaacactaggcgtaaggttgactggttaaccgataaaatgagggggcgtgaccacacggtctcggccactcacggagacatggaccagaacacgagagacattatcatgagggagttcaggtccggctcctcgcgcgtgctgatcaccaccgatctgttagcgcgtggtatcgatgttcagcaggtgtcgttggtgattaactacgatttgccgactcagccggagaattacctccaccgtatcggaaggagtgggaggtttgggaggaaaggtgtggcgattgtgacgaaggatgatgagaggatgttgtttgatattcagaagttttataatgttgttgttgaggagctgccttctaacgttgctgatctgctgtgagagggagaagaagttcgccgacgtcaccggagaagaaaggttttttctttgttttgaaagggcacaacaactactcttttgatttgattgtctttcttccgaccatttttattctatatttaagatcattatggagtatttatttctggtttgttgtttgtctttgtatcagtcaaatcttttcatgcaagt

SEQ ID NO: 4866 - DNA, 1580 bp, Brassica napus
cggcacgccgctctctctcttttacaaaccctcaatcttcgttcgcggtctagatccgagtttgggagaaacagcctccctaagttaaccaacaaagcactctactttctcttcttcagctaccaagtcatggcaggatccgcaccagaaggcacacagtttgatgctcgtcagttcgaccagaagcttaacgaagttctcgagggacaggacgagttcttcacctcttacgatgaggttcatgacagctttgacgccatgggccttcaagagaatctcctcaggggtatctacgcttacggtttcgagaagccttccgcaatccagcaaagaggaatcgtccccttctgccaaggcctcgacgtgatccaacaggcccaatccggaaccggcaaaaccgcaacattctgctccggcgtcctccagcagctagacttcaccctcgtccagtgccaggccctcgtcctcgccccgaccagagagctcgcccagcagatcgaaaaggtcatgagagccctcggcgactacctcggcgtcaaggtccacgcctgcgtcggcgggactagcgtccgggaggaccagcgcatcctccaagccggcgtccacgtcgtcgtgggaaccccaggccgcgtcttcgacatgctgaagcgtcagtccctccgcgcggacagcatcaagatgttcgtcctggacgaggccgacgagatgctctcccgcgggttcaaggaccagatctacgacatcttccagctcctcccgcccaagatccaggtcggagtgttctcagcaacaatgccaccagaggctctcgagattacaagaaagttcatgagtaagccggtgaggatcttagtgaagcgcgacgagctcaccttggaaggtatcaagcagttctacgttaacgtggagaaggaggactggaagctcgagacgctctgcgatctctacgagactctggccatcactcagagcgtcatcttcgtgaacactaggcgtaaggttgactggttaaccgataaaatgagggggcgtgaccacacggtctcggcgactcatggagacatggaccagaacacgagggatattataatgagggagttcaggtccggctcttctcgcgtgctgatcaccaccgatctgttagctcgtggtatcgatgtgcagcaggtgtctttggtgatcaactacgatttgccgactcagccggagaattatctccaccgtattggaaggagtgggaggtttgggaggaaaggtgtggcgattgtgacgaaggatgacgagaggatgttgtttgatattcagaagttttataatgttgttgttgaggagctgccttctaacgttgctgatctgctgtgagagggagaagaagttcgccgacgtcaccggagaagaaaggttttttgtttgttttgaaagggcacaacaacaactactcttttgatttgattttgtctctcttccgaccatttttattctactatttaagatcattatggagtatttatttctggtttgttgtttgtctttgtatcagtcaaatcttttcatgcaagtgtttcatttattaatatcct

SEQ ID NO: 4867 - DNA, 1704 bp, Leymus cinereus x Leymus triticoides
  misc_feature (9)..(9): n is a, c, g, or t
  misc_feature (14)..(14): n is a, c, g, or t
  misc_feature (21)..(22): n is a, c, g, or t
  misc_feature (25)..(25): n is a, c, g, or t
  misc_feature (27)..(28): n is a, c, g, or t
  misc_feature (30)..(30): n is a, c, g, or t
  misc_feature (33)..(34): n is a, c, g, or t
  misc_feature (36)..(36): n is a, c, g, or t
  misc_feature (39)..(39): n is a, c, g, or t
  misc_feature (67)..(67): n is a, c, g, or t
  misc_feature (70)..(70): n is a, c, g, or t
  misc_feature (85)..(85): n is a, c, g, or t
  misc_feature (92)..(92): n is a, c, g, or t
  misc_feature (100)..(103): n is a, c, g, or t
  misc_feature (110)..(112): n is a, c, g, or t
  misc_feature (115)..(116): n is a, c, g, or t
  misc_feature (118)..(118): n is a, c, g, or t
  misc_feature (123)..(123): n is a, c, g, or t
  misc_feature (133)..(133): n is a, c, g, or t
  misc_feature (136)..(136): n is a, c, g, or t
  misc_feature (138)..(138): n is a, c, g, or t
  misc_feature (145)..(145): n is a, c, g, or t
  misc_feature (151)..(151): n is a, c, g, or t
  misc_feature (154)..(154): n is a, c, g, or t
  misc_feature (163)..(163): n is a, c, g, or t
  misc_feature (166)..(166): n is a, c, g, or t
  misc_feature (169)..(169): n is a, c, g, or t
  misc_feature (172)..(172): n is a, c, g, or t
  misc_feature (175)..(175): n is a, c, g, or t
  misc_feature (190)..(190): n is a, c, g, or t
  misc_feature (205)..(205): n is a, c, g, or t
  misc_feature (208)..(208): n is a, c, g, or t
  misc_feature (214)..(214): n is a, c, g, or t
  misc_feature (217)..(217): n is a, c, g, or t
  misc_feature (220)..(220): n is a, c, g, or t
  misc_feature (226)..(226): n is a, c, g, or t
  misc_feature (241)..(241): n is a, c, g, or t
  misc_feature (244)..(244): n is a, c, g, or t
  misc_feature (250)..(250): n is a, c, g, or t
  misc_feature (259)..(259): n is a, c, g, or t
  misc_feature (265)..(265): n is a, c, g, or t
  misc_feature (271)..(271): n is a, c, g, or t
  misc_feature (277)..(277): n is a, c, g, or t
  misc_feature (283)..(283): n is a, c, g, or t
  misc_feature (292)..(292): n is a, c, g, or t
  misc_feature (295)..(295): n is a, c, g, or t
  misc_feature (301)..(301): n is a, c, g, or t
  misc_feature (304)..(304): n is a, c, g, or t
  misc_feature (307)..(307): n is a, c, g, or t
  misc_feature (322)..(322): n is a, c, g, or t
  misc_feature (328)..(328): n is a, c, g, or t
  misc_feature (337)..(337): n is a, c, g, or t
  misc_feature (347)..(347): n is a, c, g, or t
  misc_feature (352)..(352): n is a, c, g, or t
  misc_feature (364)..(364): n is a, c, g, or t
  misc_feature (367)..(367): n is a, c, g, or t
  misc_feature (385)..(385): n is a, c, g, or t
  misc_feature (400)..(400): n is a, c, g, or t
  misc_feature (421)..(421): n is a, c, g, or t
  misc_feature (442)..(442): n is a, c, g, or t
  misc_feature (457)..(457): n is a, c, g, or t
  misc_feature (460)..(460): n is a, c, g, or t
  misc_feature (463)..(463): n is a, c, g, or t
  misc_feature (469)..(469): n is a, c, g, or t
  misc_feature (484)..(484): n is a, c, g, or t
  misc_feature (520)..(520): n is a, c, g, or t
  misc_feature (535)..(535): n is a, c, g, or t
  misc_feature (547)..(547): n is a, c, g, or t
  misc_feature (562)..(562): n is a, c, g, or t
  misc_feature (574)..(574): n is a, c, g, or t
  misc_feature (769)..(769): n is a, c, g, or t
  misc_feature (982)..(982): n is a, c, g, or t
  misc_feature (1003)..(1003): n is a, c, g, or t
  misc_feature (1527)..(1527): n is a, c, g, or t
caacccaancctcnggcgtcnncgncnncnccnncncgncgcttcagccatggcaggaatggcaccnganggttcccagtttgangctaagnactatgannnnaagatgnnnganntnctganccaaggtganacngnggagttnttcacntcntatgatgangtncanganagntttgatgacatgggnctccaagagaacctnctnagaggnatntangcttanggttttgagaagccntcngccatncagcaaagnggaatngttccnttctgnaagggncttgatgtnatncagcangcncantctggaacaggaaanactgcnaccttctgntctggaatcntgcancagcttgactanggnttggttgagtgccaggcnttggtccttgctccnacccgtgagcttgcacagcanattgagaaggtcatgcgtgcncttggtgactacttnggngtnaaggtncatgcatgtgttggnggaacttctgttcgtgaggaccaaaggattcttgcnagtggagtgcatgtngttgttggtacncctggtcgtgtgttngacatgctccgnaggcagtctctgcgccctgacaacatcaagatgtttgtcctcgatgaagctgatgagatgctttcccgtggtttcaaggatcagatttatgacatcttccagctgctcccagggaagattcaagttggtgtcttctctgctaccatgccccctgaagcccttgagattacccgcaagttcatgaacaaacctgtnaggatccttgttaagagggatgagctcacccttgagggtatcaagcagttctatgtcaatgtggagaaggaagagtggaagctcgacacactgtgtgacctgtacgagactcttgccatcacccagagtgtcatcttcgtgaacacccgccgcaaggtggattggctcaccgacaagatgaggggcagggaccacactgtttccgctactcanggtgacatggaccagaacacnagggacatcatcatgagggagttcagatcaggttcttcacgtgtgctcatcaccactgacctgcttgctcgtggtattgatgtccagcaagtgtccctggtcatcaactatgacctcccgacccagccagagaactacctgcatcgcattggtcgtagtggtcggtttggaaggaagggtgtggccatcaactttgtgacccgtgaagatgagaggatgctgtttgacatccagaagttctacaacgtggtgattgaagagctcccagccaacgttgccgaccttctgtgatcgggctgtcgagaacatatggtaagggggtcctgacagggctttgtttttgttgaaatatcaccaactttcttgtctgtgggggggttcaagtgataaatggtctggggttctactttaaagtcgtggtcgtggacaatttgggatttattatgccatgttttgggaatttttgtagttgctaggctgtggttctatgtgctgaggagggaggcgctgctgctcatgttgcngttgctggagtcctcactttatttgttaagactatgtaatgaccgaatgatgttatttgtttgtgtattacctaccgcatgtaatcctgcaatcggtactagtaatgctatcgttattctgatatatatcagagtaaaaactgtttactccttttttagcaataacccttgctcatt

SEQ ID NO: 4868 - DNA, 1896 bp, Oryza sativa
aaaccctcttgtttctctctcctgctccccccccaacgccgccgccaccgccgccgccgccgccgccgaatccgagacccccatctcggattcacctctcccgcctccggcctccgtcaccgtctccccacgcgcgtcagtcatggcgggaatggcaccagagggatcccagtttgatgctaagcactatgattctaaaatgcaggagcttctgaaccaaggtgaaaccgaggagttcttcacatcttatgatgaagttcatgagagttttgatgacatgggtctccaagagaaccttctcagaggcatctatgcctatggtttcgagaagccttcagccattcagcaaaggggtattgtccctttctgcaagggtcttgatgtgattcagcaagctcagtcaggaacaggaaagactgccaccttctgttctggaattttgcagcaacttgactatgctgtggttgagtgccaggccttggtccttgctcctactcgtgagcttgcacagcaaattgagaaagtcatgcgcgcacttggtgactatctgggtgtgaaggttcatgcttgtgttggaggtacttctgttcgtgaggaccaaaggattcttgcaagtggagtgcatgttgttgttggaacacctggtcgtgtgtttgacatgctgcgtaggcagtccctccgtcctgattacatcaagatgtttgtccttgatgaagctgatgaaatgctttctcgtggtttcaaggatcagatttatgatatcttccagctcctcccgtcaaagatccaagttggtgtgttctctgctacaatgccccctgaggcccttgagatcacccgtaaattcatgaacaagcctgtgcggatccttgtgaagagggatgagctcactcttgagggtatcaaacagttttatgtcaatgtggagaaggaagaatggaagcttgacacactctgtgacctgtatgagacactggccatcacgcagagtgtcatctttgtgaacacccgccgcaaggtggactggctcactgataagatgaggggcagggatcacacagtttctgctacccatggtgacatggaccagaacactagggacatcatcatgagggagttccgatctggttcttcccgtgtgctcattaccacggaccttcttgcccgtggtattgatgtccagcaggtgtcccttgtcatcaactatgatctgccgacccaacctgagaactacctgcatcgcattggtcgtagtggtcgttttggtaggaaaggtgttgccattaactttgtgacccgtgacgatgagaggatgctgtttgacatccagaggttctacaatgtggtgattgaggagctgccggccaacgtcgctgaccttctgtgatcaagttcagaagagttatgttaaggggcctgataaggattgtttttgtctgaagtatcactgtcttatctggggggggggggagtgataaaggtgggggttctgttttaaaagtcactgtggtcgtagacaatttccaaatttttatgccatgttatgggaatttttgtagttgctaggctgtgctatgtgctggtgaggagggaggagtcttttacttttattatatctattgttaaaactatgtatgaccgaatgatgttatttatttgtgtcatggttgactatttgccatatgtattctgccaccggtcctgctactgccactggtatctcgagtgaaaactgtttgctcctcggtgcaataagccagataacatgtcacctaccggaatgccgttgatgtctagtgatgttttatctgttgatatgcatgtttggttggatacttgcctggacgattataataattttttgagatgttggcttcattttggtgagtgaaaaca

SEQ ID NO: 4869 - DNA, 1245 bp, Pennisetum glaucum
atggcaggaatggcaccggagggttcccagttcgatgctaagcactatgattctaaaatgcaggagctgctgagcactggtgagactgaggaattcttcacctcatatgatgaggtttttgagagctttgatgacatgggccttcaagagaaccttctgagaggcatttatgcttatggttttgagaagccttcagcaattcagcagagaggaattgtgcctttctgcaagggccttgatgtcattcagcaagcccaatctggtacaggaaagacagcaactttctgttctggtatcttgcagcagctcgactatggcctggttgaatgccaggccttggtccttgctcccacccgtgagcttgcacagcagattgagaaagtcatgcgcgcacttggtgactacctgggtgtgaaagttcatgcatgtgtgggtggaacttcagtccgtgaggaccaaaggattcttgccagtggcgtgcatgttgttgttggtacacctgggcgtgtctttgacatgttgcgtaggcagtcactccgtcctgatcacatcaagatgtttgtcctggatgaagctgatgagatgctttctcgtggtttcaaggatcagatttatgacatcttccagcttctcccagcaaagattcaggttggagtcttctctgctacaatgcctccagaggctcttgagattacccgcaagttcatgaacaaacctgtgagaattcttgtgaagagagatgagctcacccttgagggtatcaagcagttctatgtgaatgtggagaaggaagactggaagctggacacactatgtgacctgtacgagacccttgccatcacccagagtgtcatcttcgtcaatacccgtcgcaaggtggactggctcactgacaagatgaggagcagggaccacactgtttctgccactcacggtgacatggaccagaacactagggacatcatcatgagggagttcaggtctggttcatcccgtgttctcatcaccaccgacctgcttgcccgtggtattgatgttcagcaggtgtccctggtcatcaactatgatctccccacccagcctgagaactaccttcatcgcattggtcgtagtggtcgtttcggtaggaagggtgttgccataaactttgtgacccgtgatgatgacaggatgcagtttgacatccagaggttctacagcgtggtgattgaggagctgccgaccaacgttgctgaccttctctga

SEQ ID NO: 4870 - DNA, 1438 bp, Lactuca sativa
  misc_feature (491)..(491): n is a, c, g, or t
  misc_feature (515)..(515): n is a, c, g, or t
  misc_feature (551)..(551): n is a, c, g, or t
  misc_feature (569)..(569): n is a, c, g, or t
  misc_feature (611)..(611): n is a, c, g, or t
  misc_feature (659)..(659): n is a, c, g, or t
  misc_feature (665)..(665): n is a, c, g, or t
  misc_feature (927)..(927): n is a, c, g, or t
  misc_feature (1210)..(1210): n is a, c, g, or t
  misc_feature (1219)..(1219): n is a, c, g, or t
  misc_feature (1221)..(1224): n is a, c, g, or t
  misc_feature (1263)..(1263): n is a, c, g, or t
  misc_feature (1287)..(1287): n is a, c, g, or t
  misc_feature (1327)..(1328): n is a, c, g, or t
  misc_feature (1348)..(1348): n is a, c, g, or t
accgactgatggcctctgtgcggggagctcacaaataacgcacacatattcctcaactcccggcgtcgatccgaggagtttgagaaaaccctaatcaaaagcttctactctctccctcaatctcttcaacacaaccagtcatggcgggcatagcaccagaaggatcccaattcgatgcacgacaatttgactccaagatgagcgagttgctttcagctgatggacaagacttctttacatcatatgatgaagtctatgacagtttcgatgccatgggtctccaagaaaatctcctgagaggcatatacgcatacggttttgaaaaaccatcggccatccaacaaaggggaatcgtccccttcaccaagggcttggatgtaattcaacaagcccaatcaggaactggaaaaacagccactttctgctctggaatcctccaacaacttgactacaatgtagttgaatgccaagctttggttttagccccaacncgtgaacttgcacaacaaattganaaagtgatgcgggccctcggtgattacttaggtgtnaaggtccacgcgtgtgtnggtgggaccagtgtccgtgaagaccaacgcatcctttcagcnggggtccacgtggttgttgggacacctggacgcgtgtttgacatgctncgcagncaatcccttcgtgctgattacatcaaaatgtttgttcttgatgaagctgatgaaatgctttcaagaggttttaaagatcagatatacgatattttccagctgttgccctcgaaggttcaggtgggggtgttctcggccaccatgccgccagaggctctggagatcacgagaaaattcatgaacaaaccggtgaggattctggtcaaacgtgacgagttgactttggaaggaatcaaacagttttatgtgaatgttgagaaanaagattggaagctggagactttgtgtgatctgtatgagacgttagcgatcactcagagtgtgatttttgtgaacacgaggaggaaggttgactggttgaccgataagatgaggagccgtgatcacacggtgtcagccacacacggtgacatggaccagaacacgagggatataatcatgcgggagtttcgttcggggtcttctcgtgttttgattactactgatttgttggcacgtgggattgatgtgcacaggtgtctttggttattaattatgatctgccnacacagccngnnnnttatcttcataggattggtcgaagtgggaggtttggganaaaaggtgtcgccattaattttgngactttggaggatgagaagatgcttgcggatattcagaanntttataatgttgtcgtggangagctgccgtcaaatgttgctgatttgatttgaggattttggttggtttttgtgtctcggggatttggattttggtggcggttttttttt

SEQ ID NO: 4871 - DNA, 1831 bp, Vigna unguiculata
  misc_feature (817)..(817): n is a, c, g, or t
  misc_feature (1811)..(1811): n is a, c, g, or t
ctctctccggcgtcatctttgatacgtcgttgtctcaaagccaccgccatcgccttcgatattaggaaaccctaactcctcaattccctctcacacactcaatcttcttcattgtttcctaattccaacttttttttatcgtcctcaaagtttgaaatcatggctgggcaggcaccggaaggatcagtgttcgatggtcgtcaatatgatgctaagatgaatgagttacttggacctgatggacaagagttttttacttcttatgacgaagtctgcgaaagctttgatgctatgggattgcaggagaaccttctaaggggtatttatgcatatggttttgagaaaccctctgccattcagcaaagggggattgttcctttctgcaagggacttgatgtaatccagcaagcacaatctggaactggaaaaactgctacgttttgctctggagttttgcagcagcttgattacagcttagttgagtgccaggcactagttcttgctcctactcgtgaacttgcacaacaaattgagaaggtcatgcgagcactaggggactatctaggtgtcaaggttcatgcttgtgttggtgggaccagtgttcgtgaagatcaacgcatcctttcaagtggggttcatgtagttgttggtactcctggacgtgtatttgatatgttgcgcagacaatctttgcgccctgattacatcaagatgtttgtattggatgaggcagatgagatgctctctcgaggttttaaggatcagatctatgatatttttcagctactgcctcctaagattcaggttggggtattcnctgccacaatgcctccagaagccctggaaatcaccaggaagtttatgaacaaacctgtgaggattcttgtaaaacgtgatgagcttaccctggaggggatcaagcagttttttgttaatgtagacaaggaggaatggaaactagagacattatgtgatctttatgaaactttggctatcacccagagtgttatctttgtgaacactagacgcaaggtagattggctgacagacaaaatgcggaatcgtgatcacacagtttcagccacccacggagatatggaccaaaacacaagggatatcatcatgagagaattccgctcagggtcctcccgtgttcttatcaccacagatcttttggcccgtggtatcgatgtgcagcaagtctcacttgttataaattatgatctgccaactcagccagagaactatctccatcgaattggtcgtagtggtcggtttgggagaaagggtgttgctataaattttgtgaccagtgatgatgaaaggatgctggttgacatccaaaagttctataatgtggtggttgaggagctgccggccaatgtagctgatctcatttgatttggtctccccttcattgttgattggtatgatttttatcatggaggctggtctctgtcattatttcatttttcatggcccaggcagggcctttctctggcaagacttgaacttaactccaaaaccggtgattttgaaatgatgggcattcttctctaattttgcgtttagcagaatgcgttgctgcaattttgttgcttgcttgtgttgtgtatgtgtatctgtcttactacagattgtagattgcctctttccgtgtgttttgtttttaatatatccgcgagatggttgtgtatatttgaaaccttttttatgttaagctggaaatatactggacttattctattatcaccctgttcatttgactctattctcgtttgaagcttctccttaatctacaaatgggaatngaagctgtttttgagttgca

SEQ ID NO: 4872 - DNA, 1645 bp, Zea mays
cttccttcctttccccgctcttctcccacacaaacgccaccgccgcatcgaatccgagacgccgatctcggattcgccgtcaccacacgctgccctcgtcgcgctctcccgccgccgccgctcgtctcgtcagccatggcaggattggcaccagaagggtcgcaatttgatgacaagcagtatgacaagaaaatgcaggagatattaactgaagacttcttcacttcatatgatgatgtttgtgaaagttttgacagcatgggactgcaagagaaccttctgagaggcatctatgcctatggttttgagaagccatcggctattcagcaaaggggaatagttcccttctgcaaggggcttgacgtgattcagcaagctcagtctggaactggaaaaacagctaccttctgttctggaatcttgcagcaacttgattatggattggttgaatgccaggcattggttcttgctccaacccgtgagcttgctcagcaaattgagaaggttatgcgtgctcttggggactatttgggtgtcaaagtgcatgcctgtgttggtggaacatctgttcgtgaggaccaaaggattcttgccagtggtgtgcatgttgttgtgggcacaccaggacgtgtgtttgatatgttgcgcaggcagtctctccgtcccgacaacatcaagatgtttgtgttggatgaggctgatgagatgctctcccgtggattcaaggatcagatctatgatatcttccagcttcttccatccaagattcaggtcggtgtcttctcagctaccatgccccctgaggcccttgagatcacgcgcaagttcatgaacaaacctgtgaggattctcgtcaagagagatgagctcacccttgagggtatcaagcaattctatgtcaatatcgacaaggaagattggaagctcgacactctgtgtgacctgtatgagaccctggcaatcacccagagtgtcatctttgtgaacacacgccgcaaggtggactggctcacggacaagatgaggagcagggaccacaccgtgtcagctacacacggtgatatggaccagaacaccagggacatcatcatgagggagttcaggtccgggtcctctcgtgtgctcatcaccaccgacctgctcgcccgtggtatcgacgtccagcaggtctcacttgtcatcaactacgacctgccgacccagccagagaactacctccaccgcatcggccgtagtggtcggtttggaaggaagggtgttgccatcaacttcgtcacccgcgacgacgagcgaatgctgtttgacatccagaggttctacaacgtgaccgttgaggagctgccggccaatgtcgccgaccttctctagatagtatggctgctaaggtttctggataaaggagtttgtttttgttaaaatacgccaacttttctctgctttggatgagtggtaaggtccggggtctgttcgtattgtggcgaaggatgggttttaagtttattttgtcgtatgcaacgtttcggaatttttgtagcgagtaggctacgtgccgctcctgggctagctgggtgctgagacactactgaagtatttttaccttagctgttgggcttatgattcgtgcaggtgtgtatgttctgtaaaa

SEQ ID NO: 4873 - DNA, 1442 bp, Brassica oleracea
  misc_feature (1401)..(1402): n is a, c, g, or t
gagctccacggcgcagatccgaggagtttccgtctctcatttgaccatttcttttctctctagatctctcttcttcactttgtgctaacagcagtcatggcaggaatggcgtcagaaggaacacaatacgatcctcgtcagtttgattctaagatgaatgccatactcggtgaggaaggagaggaaactttctacaccacttatgatgaagtctgtgatagctttgatgcaatggaactcaagtctgatctcctgagaggcatctatgcctacggttttgagaagccatctgctattcagcagagagggattattcccttctgcaagggtcttgatgtgatccagcaagctcagtctggaaccggaaagaccgctaccttctgctctggcgttcttcagcagcttgattacactctcgttcagtgccaagctcttgttttagctcccaccagagagctcgctcagcagattgaaaaggttatgagggctcttggtgactacctcggtgtcaaggttcacgcctgtgttggtggaacaagtgtccgtgaggatcaacgcattctccagtctggtgttcacgttgttgttggaacacctggtcgtgtcttcgacatgttgcgtagacagtcactccgcgctgacgccatcaagatgtttgttcttgatgaggctgatgagatgctctctcgtggtttcaaggatcagatatacgacatcttccagcttctcccttccaaggttcaggtcggtgtcttctccgccacaatgccgcctgaagctctcgagatcacaaggaagttcatgaacaaacccgtgaggatccttgtcaagcgtgacgagctgactcttgaaggtatcaagcagttttacgtcaacgttgacaaggaagagtggaagctggagacgctttgtgatctctacgagacgctagccatcactcagagtgtcatctttgtgaacacaaggcgtaaggttgattggttaacggacaaaatgaggagccgtgaccatactgtttcagccacgcacggagacatggaccagaacacgagagacatcatcatgcgtgagttcaggtctggttcttcccgtgtactcatcaccactgacctccttgcacgtggtattgatgttcagcaagtgtctctggtgattaactttgacctcccaacccaacctgagaactaccttcaccgtattggaagaagtggaaggtttgggaggaagggagtggcgatcaacttcatgacaactgatgatgagaggatgttgtcggatattcagaagttttacaatgtggtcgttgaagagttgccaagcaatgttgctgatcttctctgagtcctcctgttgtggcggcatggtaatttctttctttcttttttaccgagtaactgctgnnttttaccatcctttttaccgcagttttactatgttttgtt

SEQ ID NO: 4874 - DNA, 1850 bp, Phaseolus coccineus
catctttgatacgtcgttgtctcaaagccaccgccatcgcccttcgatttttggaaaccctaactccacaattgcctctcacagactcaatcctcttcattatttcgtaattccaacttcttccatcttcctcaaagtttgaaatcatggctgggcaggcaccagaaggatcacaattcgatggtcgtcattatgatgctaagatggatgagttactcggagctgatgggcaagatttttttacttcttatgacgaagtttgcgaaagctttgatgctatgggattgcaggagaaccttctaaggggtatttatgcatacggttttgagaaaccctctgcaattcagcaaagggggattgttcctttctgcaaggggcttgatgtaattcagcaagcacaatctggaactggaaaaactgctacgttttgctctggagttttgcagcagcttgattacagcttagttgagtgtcaggcactagttcttgctcctactcgtgaacttgcacaacaaattgagaaggtcatgcgagcactaggggactatataggtgtcaaggttcatgcttgtgttggtgggaccagtgttcgtgaagatcaacgcatcctttcaagtggggttcatgtagttgttggtactcctggtcgtgtatttgatatgctgcgcagacaatctctgcgccctgatcacatcaagatgtttgtattggatgaggcagatgagatgctctctcgaggttttaaggatcagatctatgatatttttcagctactgcctcctaagattcaggttggggtattctctgccacaatgcctccagaagcgctggaaatcacaagaaagtttatgaacaaacctgtgaggattcttgtaaaacgtgatgagcttaccctggagggcatcaagcagttttttgtcaatgtagacaaggaggaatggaagctggaaacactatgtgatctttatgaaactttggcaatcacccagagtgttatctttgtgaacactagacgcaaggtggattggctgacagacaaaatgcggaatcgtgatcacacagtttcagccacccacggagatatggaccaaaacacaagggatatcatcatgcgggaattccgctccggctcctcccgtgttcttatcaccacagatcttttggcccgtggtatcgatgtccagcaagtctcacttgttataaattatgatctgccaactcagccagagaactatctccatcgaattggtcgtagtggtcggtttgggagaaagggtgttgctatcaattttgtgaccagtgatgatgacaggatgctgcttgacatccaaaagttctataatgtgatggttgaggagctgccagccaatgtagctgatctcatttgatttggtctccccttcattgttgattggtatgatttttattatggaggcctctgtcattatttcatttttcatggccctggcagggcctttctctggcaagacttgaacttaactccaaaccggtgattttgaaatgggcatacttctctaattttgggtttagcagaatgcgttgctgcaattttgttgcttgcttgtttgtgtatctgtcttactacagattgtagattgctgctttccgtgtgttttgttttaatatatccgcgagatggttgtgtatatttgaaaccttttttatgtcgcgctggaaatatactggacttattctattatcgccctgttgatttgattctattttttacttgcagcccaattaaatttcattttcaggaccattgtgcacaggcttctctatttgtctgcaaggaagacttataattattgatatctttatacaaaaaa

SEQ ID NO: 4875 - DNA, 1673 bp, Brassica napus
ggatataaagtagaagcagttactttcttcttcttcaactccacggcgcagatccgaggagtttccgtctctcatttgaccatttcttctctctcgagatctctcttcttcactttgtgctaacagcagtcatggcaggaatggcgtcagaaggaacacaatacgatcctcgtcagtttgattctaagatgaatgccatactcggtgaggaaggagaggaaactttctacaccacttatgatgaagtctgtgatagctttgatgcaatggaactcaagtctgatctcctgagaggcatctatgcctacggttttgagaagccatctgctattcagcagagagggattattccattctgcaaaggtcttgatgtgatccagcaagctcaatctggaaccggcaagaccgctaccttctgctctggcgtgttgcagcagcttgactacactcttgttcagtgccaagctcttgttctggctcccaccagagagctcgctcagcagattgaaaaggttatgagggctcttggtgactacctcggtgtcaaggttcacgcctgtgttggtggaacaagtgtccgtgaggatcaacgcattctccagtctggtgtccacgttgtcgttggaacacctggtcgtgtcttcgacatgttgcgtagacagtctctccgcgctgatgccatgaagatgtttgttcttgatgaagctgatgagatgctctctcgtggtttcaaggatcagatatacgacatcttccagcttctcccttccaaggttcaggtcggtgtcttctccgccacgatgccgcctgaagctctcgagatcacaaggaagttcatgaacaaaccggtgaggatccttgtgaagcgtgacgagctgactcttgaaggtatcaagcagttctacgtcaacgttgacaaggaagagtggaagctggagacgctttgtgatctctacgagacgctagccatcacgcagagtgtcatctttgtgaacacaaggcgtaaggttgattggttgactgataaaatgaggagccgtgaccacacggtttcagccacgcacggagacatggaccagaacacgagagacattatcatgcgtgagttcaggtctggttcttcccgtgtactcataaccactgacctccttgcacgtggtattgatgttcagcaagtgtctctggtgattaactttgacctcccaacacaacctgagaactaccttcaccgtattggaagaagtggaaggtttgggaggaagggagtggcgatcaacttcatgacaactgacgatgagaggatgttgtctgatattcagaagttttacaatgtggtcgttgaagagttgccaagcaatgttgctgatcttctctgagtcctcctgttgtggctgcatggtaacctctttctttctttttttttaccgagaaactgctgaattttaccaccctttttaccgcagttttactatgttttgtttccagcttatttagagtttattttggcaaaatgagaagagaactcatctcatgactttttgttttgttttgtttttttgggcattatgttgaaactttcttgttaacgcgactcacaagtttctatttctcttaatcatgttttatttaatttggtggagtttccgagtttggatgtgtgtttcggctaaagt

SEQ ID NO: 4876 - DNA, 1676 bp, Brassica napus
  misc_feature (1119)..(1119): n is a, c, g, or t
  misc_feature (1125)..(1125): n is a, c, g, or t
  misc_feature (1197)..(1197): n is a, c, g, or t
  misc_feature (1496)..(1496): n is a, c, g, or t
  misc_feature (1545)..(1545): n is a, c, g, or t
agaagcagttactttcttcttcttcaactccacggcgcagatccgaggagtttccgtctctcatttgaccatttcttctctctcgagatctctcttcttcactttgtgctaacagcagtcatggcaggaatggcgtcagaaggaacacaatacgatcctcgtcagtttgattctaagatgaatgccatactcggtgaggaaggagaggaaactttctacaccacttatgatgaagtctgtgatagctttgatgcaatggaactcaagtctgatctcctgagaggcatctatgcctacggttttgagaagccatctgctattcagcagagagggattattccattctgcaaaggtcttgatgtgatccagcaagctcaatctggaaccggcaagaccgctaccttctgctctggcgtgttgcagcagcttgactacactcttgttcagtgccaagctcttgttctggctcccaccagagagctcgctcagcagattgaaaaggttatgagggctcttggtgactacctcggtgtcaaggttcacgcctgtgttggtggaacaagtgtccgtgaggatcaacgcattctccagtctggtgtccacgttgtcgttggaacacctggtcgtgtcttcgacatgttgcgtagacagtctctccgcgctgatgccatgaagatgtttgttcttgatgaagctgatgagatgctctctcgtggtttcaaggatcagatatacgacatcttccagcttctcccttccaaggttcaggtcggtgtcttctccgccacgatgccgcctgaagctctcgagatcacaaggaagttcatgaacaaaccggtgaggatccttgtgaagcgtgacgagctgactcttgaaggtatcaagcagttctacgtcaacgttgacaaggaagagtggaagctggagacgctttgtgatctctacgagacgctagccatcacgcagagtgtcatctttgtgaacacaaggcgtaaggttgattggttgactgataaaatgaggagccgtgaccacacggtttcagccacgcacggagacatggaccagaacacgagagacattatcatgcgtgagttcaggtctggttcttcccgtgtnctcatnaccactgacctccttgcacgtggtattgatgttcagcaagtgtctctggtgattaactttgacctcccaacncaacctgagaactaccttcaccgtattggaagaagtggaaggtttgggaggaagggagtggcgatcaacttcatgacaactgacgatgagaggatgttgtctgatattcagaagttttacaatgtggtcgttgaagagttgccaagcaatgttgctgatcttctctgagtcctcctgttgtggctgcatggtaacctctttctttctttttttttaccgagaaactgctgaattttaccaccctttttaccgcagttttactatgttttgtttccagcttatttagagtttattttggnaaaatgagaagagaactcatctcatgactttttgttttgttttgttttnttgggcattatgttgaaaactttcttgttaacgcgactcacaagtttctatttctcttaatcatgttttatttaatttggtggagtttccgagtttggatgtgtgtttcggctaaagtaaaaaaaaagggc

SEQ ID NO: 4877 - DNA, 1781 bp, Cenchrus ciliaris
  misc_feature (223)..(223): n is a, c, g, or t
  misc_feature (294)..(294): n is a, c, g, or t
  misc_feature (362)..(362): n is a, c, g, or t
gggccagaggggagaagcgagagagagagagagagagaacgagtcgagccgcgccccgcctccgtcggaaccccttataagccgcctcccccgaaaccctcccttcccctagtccctcctccctgctccctcctccgttgccctctccccaaacgcgaacgccaccgccgaatcgaatccgagacgccgatctcggattcgccgccgtcgcaccagctctccngcgctcctcctcgtcgccccgtcgtcgcgctctcctccccgcccgctcgtcagccatggcaggtttggcancagagggtacccagtttgacggcaagcagtatgacaacaagatgcaggagctaatgactgaggacttntttaccccgtatgatgaagtctgtgaaagttttgacaacatggggctcctagagaaccttctgagaggcatctatgcctatggttttgagaaaccatcggccattcaacaaagggggatcgttcccttctgcaaggggcttgatgtgattcagcaggctcagtctggaacagggaagacagctacattctgttctgggatcttgcagcagcttgattatgggttggttgagtgccaggcgttggttcttgctccaacccgtgagcttgcacagcagattgagaaggtcatgcgtgctcttggggactacttgggtgtcaaagtgcatgcctgtgttggtgggacatctgtccgtgaggaccaaaggattcttgctagtggtgtgcatgttgttgtgggcacgccagggcgtgtgttcgatatgctgcgcaggcagtccctacgcccggacaacattaagatgtttgtgttggatgaagctgatgagatgctctctcgtggtttcaaggatcagatctatgatatcttccagcttcttccatcaaagatccaggtcggtgtgttctctgctaccatgccccctgaggcccttgagattacccgcaagttcatgaacaagcctgtcaggattctcgtcaagagagatgagctcacccttgagggtatcaagcagttctatgtcaatgtggagaaggaagattggaagcttgacactctctgtgacctgtacgagaccctggccatcactcagagtgtcatctttgtgaacacccgccgcaaggtggactggctcacagacaagatgaggagcagggaccacactgtctctgcaacgcacggtgacatggaccagaacaccagggacatcattatgagggagttcaggtccgggtcctcccgtgtgctcatcaccactgacctgcttgcccgtggtattgatgtccagcaggtctccctggtcatcaactacgacctgccgacccagcctgagaactacctccaccgcatcggtcgtagtggtcgtttcgggaggaagggtgttgccatcaactttgtcacccgtgacgatgagcggatgctgtttgacatccagaagttctacaacgtgaccgttgaggagctgcctgccaacgtcgctgaccttctctagattgtgtcctagactcctaggtgtctgctaaggtgatggataaagaagtctatttttagttaaaaaaatatcgccaacttttctatgttctggaggagtggtaatgagtttctactatttgaattgtggctaaggatggttttctaagctttttccttctatgcaacgtttgggaaacaattttgtagcgtgtagggttgtgccgtgtcctgggctagctgggcgctgagacactaattttaccttcattgctaagatttgtctctccta

SEQ ID NO: 4878 - DNA, 1657 bp, Nuphar advena
gagagaaacacagaggagggaagtcggatctgcgtgccgtacgcttcgatttcgcaccatctccgtgccgatcgacgatcgtcgccgttgccttcgctcctgatcgatcgttactgttggtttctgtttcattgctctgttcgtagtcatggctggtttggctccagagggatcgcaatttgatgcacgtcaatatgactcaaggatgagtgaactgctttcgggtgatgcggaagagttttttgcatcctatgatgaggttcatgattcctttgattccatgggtttgcaagagaaccttttgaggggcatttatgcatatggttttgagaagccttctgcaattcagcagaggggtattgtacctttctgcaagggcctagatgttattcagcaagcacaatctggtacagggaaaacagcgacattctgctctggaattttgcagcaattggactacagcctagttgaatgtcaggccttagttcttgctcctactcgtgagttggcacagcagattgaaaaggttatgcgcgcccttggtgactacttgggcgtcaaagttcatgcatgtgttggtgggacgagtgtacgtgaagatcagcgtatactttcaagtggtgttcatgttgttgtagggactcctggccgtgtttatgacatgctgcgtagacagtctctccgacctgacaatattaaaatgtttgtactcgatgaagctgatgaaatgctttcacgtggcttcaaggatcagatatatgatatatttcagctgcttccctcgaagattcaggttggtgtcttctcagccactatgccacctgaagcgttggaaatcaccagaaagttcatgaacaagcccgtgaggatattagtgaagagagatgagctgactcttgagggtatcaagcaattttatgtgaatgtcgacaaagaggagtggaagcttgatactctttgcgatttgtatgagacactggctatcacgcagagtgttatctttgtgaacacgaggcgcaaagttgattggcttactgacaaaatgcggagccgagatcatacagtttctgcaacacatggagacatggatcagaatacccgtgatattattatgagggaattccgttctgggtcttcgcgtgttctcattacgacggatcttcttgctcgtgggattgatgtccagcaggtttctctggtgatcaactatgatcttccaacacagcctgagaactatcttcatcgaattggtcgaagtggtaggtttggaaggaaaggtgttgccataaattttattacacacgatgacgataggatgcttggagacattcagaggttctacaatgtcatcatcgaggagctgcctgctaatgttgctgatcttatttgattcagtgaacgagctgccaatcagaatagatgggtggtcctatttttgagcatctagaatttatgctgtttgtttttaaaacattttctacttttggatatcgagtaggcatgaaatggcagaaaggtgatgcgtttctcttttgttttttttttgtgggacactttctacattcctaaactgctttctatttttatttttgaattttgaggggatgttgatgcaatttcatgcaaggtttatttattgtcattcagattttgaaac

SEQ ID NO: 4879 - DNA, 1690 bp, Triphysaria pusilla
cactctctctaaactgtctatctcctcaactccacggcgtagatccgaggagttttggaatacttatcttcgctagtttcaagctttgaatcgctttttaagtcagtttatattttcgtcagatcttaagttttcatcagtcatggcaggagcagcacctgaaggctctcagtttgatgctaaatcattcgatgcaaaaatggtcgagatacttggagaagatacaggggaatttttcaccagctacgatgaggtttatgagagtttcgattctatgggcttgcaggaaaatcttctaaggggcatttatgcttatgggtttgagaagccctctgcaattcagcaaagagggattgttcccttctgcaagggcttggacgtcattcaacaggctcaatccgggactggaaaaactgcaactttctgctctgggattctgcagcagcttgactacaatgtagttgagtgccaggctcttgttcttgctcctacccgcgagcttgcacagcaaatcgagaaggttatgcgagcgcttggcgattatcttggcgtcaaggtgcacgcttgtgttggtgggacaagtgtccgtgaggatcagcgcattctttccagtggggtacatgtcgtggtcggtacgcctggacgtgtatttgatatgctgaggaggcagtctctgcgttctgattacatcaagatgtttgttttggatgaagctgatgaaatgctttccagaggtttcaaggatcagatatatgatattttccagttgctccctcctaagattcaagttggcgtgttttctgctactatgccaccagaggctctcgaaattactaggaaattcatgaacaaaccggtccgcatccttgtgaagcgtgacgagctaacccttgagggtatcaagcagttttttgtcagtgtcgaaaaagaggagtggaagcttgaaaccctatgtgatctctacgagaccttagccatcacccagagcgtcatcttcgtcaatactaggcgcaaggtcgactggctgaccgacaaaatgcgcagccgagatcacaccgtctctgccacccacggtgacatggaccaaaacacaagagatattatcatgcgcgagttcaggtctggctcgtcccgtgtcttaatcaccactgatctcttggctcgtggtatcgatgtccagcaggtttcacttgtgatcaactacgatctgccgactcagcccgagaattatctgcatcgtatcggacgaagtgggcggtttggaaggaagggtgtggcgatcaactttgtgaccaaggatgatgaacgtatgctttttgacattcagaagttttataacgtggcaattgaggagcttccggctaatgttgctgatcttctctaattggtgggtggatttttgatttcgtcgaggttaaatttgttcgctcaagttacttcctaggtttagtgttttgaactggtatttatggactatctttttgttttttgttttgggagattgaattgtcgttatttgtcgactggttctcgttcaatttccggatttcaattgctgtctggaaacttcaagtgttgccgagtttttttaatgggtttgttggttggagtctttaaaagttctaatttgctgcgtattttggttttattctaggggatgattatgaattatgttctccttattacttgc

SEQ ID NO: 4880 - DNA, 1724 bp, Triphysaria pusilla
  misc_feature (5)..(7): n is a, c, g, or t
  misc_feature (9)..(13): n is a, c, g, or t
  misc_feature (16)..(18): n is a, c, g, or t
  misc_feature (23)..(23): n is a, c, g, or t
  misc_feature (26)..(30): n is a, c, g, or t
  misc_feature (32)..(32): n is a, c, g, or t
  misc_feature (106)..(106): n is a, c, g, or t
  misc_feature (1297)..(1297): n is a, c, g, or t
  misc_feature (1650)..(1650): n is a, c, g, or t
atatnnncnnnnntcnnncattnccnnnnnancactctctctaaactgtctatctcctcaactccacggcgtagatccgaggagttttggaatacttatcttcgcnagtttcaagctttgaatcgctttttaagtcagtttatattttcgtcagatcttaagttttcatcagtcatggcaggagcagcacctgaaggctctcagtttgatgctaaatcattcgatgcaaaaatggtcgagatacttggagaagatacaggggaatttttcaccagctatgatgaggtttatgagagtttcgattctatgggcttgcaggaaaatcttctaaggggcatttatgcttatgggtttgagaagccctctgcaattcagcaaagagggattgttcccttctgcaagggcttggacgtcattcaacaggctcaatccgggactggaaaaactgcaactttctgctctgggattctgcagcagcttgattacaatgtagttgagtgccaggctcttgttcttgctcctacccgcgagcttgcacagcaaatcgagaaggttatgcgagcgcttggtgattatcttggcgtcaaggtgcacgcttgtgttggtgggacaagcgtccgtgaggatcagcgcattctttccagtggggtacatgtcgtggtcggtacgcctggacgtgtatttgatatgctgaggaggcagtctctgcgttctgattacatcaagatgtttgttttggatgaagctgatgaaatgctttccagaggtttcaaggatcagatatatgatattttccagttgctccctcctaagattcaagttggcgtgttttctgctactatgccaccagaggctctcgaaattactaggaaattcatgaacaaaccggtccgcatccttgtgaagcgtgacgagctaacccttgagggtatcaagcagttttttgtcagtgtcgaaaaagaggagtggaagcttgaaaccctgtgtgatctctacgagaccttagccatcacccagagcgtcatcttcgtcaatactaggcgcaaggtcgactggctgaccgacaaaatgcgcagccgagatcacaccgtctctgccacccacggtgacatggaccaaaacacaagagatattatcatgcgcgagttcaggtctggctcgtcccgtgtcttaatcaccactgatctcttggctcgtggtatcgatgtccagcaggtttcacttgtgatcaactacgatctgccgactcagcccgagaattatctgcatcgtatcggacgaagtgggcggtttgganggaagggtgtggcgatcaactttgtgaccaaggatgatgaacgtatgctttttgacattcagaagttttataacgtggcaattgaggagcttccagctaatgttgctgatcttctctaattggtgggtggatttttgatttcgtcgaggttaaatttgttcgctcaagttacttcctaggtttagtgttttgaactggtatttatggactatctttttgttttttgttttgggagattgaattgtcgttatttgtcgactggttctcgttcaatttccggatttcaattgctgtctggaaacttcaagtgttgccgagtttttttagatgggtttgttggttggagtctttanaagttctaatttgctgcgtattttggttttattctaggggatgattatgaattatgttctccttattacttgca

SEQ ID NO: 4881 - DNA, 1662 bp, Mimulus guttatus
acaaaaatacttctccaaaaaactccacggcgcagatccgaggagttgctctgcaatttgaccaatcacctacgcaatcgttctcaatctcttcttcgttttgattccaagttatggctgcagaaggatcgcaatttgatactcgtcagtatgactcaaggatgagtgagatacttcaacctgatcaacaagaattcttcacctcttacgatgaggtccatgaaagtttcgacgccatgggtcttcaagagaaccttctcagaggcatttatgcctatggttttgagaagccttctgctatccagcaaagaggcattgttccgttctgcaagggactcgatgttattcaacaggctcaatctggaaccggaaaaaccgccaccttctgttctggcatcttgcagcagctcgattacagtctaacacagtgccaggccttggttttggcacctactcgagaacttgcccaacagattgagaaggttatgagagccctcggtgactacctcggtgtcaaggttcatgcttgtgtaggtgggaccagtgttcgtgaggatcagcgaatcctctcagctggggtccacgttgttgtcggtacacctggccgtgtgtttgacatgctgcgaagacagtcacttcgcgctgactacatcaagatattcgtattggatgaggctgatgaaatgctctctcgtggtttcaaggatcagatatacgacatcttccaattgctgccatccaaagtccaagtcggggttttctccgccacaatgcccccagaggcactagaaatcacccgcaagttcatgaacaagcccgtccgaatcctggtcaagcgtgacgagctaacactcgagggtatcaagcaattctacgtcaacgtagaaaaggaagactggaaactcgagacgctctgcgatctctacgaaaccctagccatcacccagagcgtcatattcgtcaacaccagacgaaaggttgactggctaaccgacaagatgaggggccgcgaccacacagtttcggccacacacggtgacatggaccagaacacccgtgacatcatcatgcgcgagttccgatccggctcgtctcgtgttcttatcaccacagatttgctggcccgtggtattgatgtgcagcaagtgtcgcttgtgataaactacgatctgccaactcagcctgagaactatctgcatcgtattggacgaagcgggcggtttgggaggaagggtgtttcgattaattttctgacgactgaggatgagaagatgctcggggatattcagaagttctacaatgttgtgattgaggagcttccatcgaacgtggctgatcttctgtgaggtggcttcggttcttttttttttattttattttttcggttttggattttgtttctgagttgaaggttagggcccttttttaattttattatttagagatagttaattattctgcttttccttgtggtttttttgcctattgtctgttttgcaaaaggttgtttgtttgcatttgggtattggtgtgtgagtgtactgatagccatgcaaaattgtctgtttaggtagagagtttctgtaactttgctttattctttttcggcccaaattttgattaaaccttatttatatttatttttagcttttattctatcaa

SEQ ID NO: 4882 - DNA, 1769 bp, Cycas rumphii
ggttgctattgagtttggtatcggtgcggtttctgtagtctgctgcgcaaatttgcctcagtgtttcttctttccgttaacaggttctttcaaatctacgacacatacaatcatggcgggattggcagcagagggaactcagtttgatgctcgtcagtatgacgccaagatgaatgaaatactttctaccgagggcgaggaactttttgccacttatgatgaggtccacgagaccttcgattcaatgggattacacgaaaatcttctcagaggcatctatgcctacggttttgagaagccctctgcgatccagcagagagggattgtgccgttctgcaagggtcttgacgtgatccagcaagcccaatctggaactggcaagacggcaactttctgttccggaattctgcagcagcttgattataacttgctggaatgtcaagctttggttcttgctcctacgcgagagcttgcccaacaaattgaaaaggtcatgcgggctcttggtgattacctgcaggttaaagtacatgcttgcgttgggggcacgagtgtccgtgaagaccagcgtatcctcatgagcggagttcacgttgttgttgggacacccggtcgtgtgtttgatatgttgcgcaggcactctcttcgtcctgattacatcaagatgtttgtgttggacgaggccgatgaaatgctttctaggggtttcaaggatcagatctatgatattttccagcttcttccttcaaagattcaagtaggtgttttttcagctacgatgcctcctgaggcccttgaaatcacaagaaaattcatgaataaacctgtgagaattttagtgaagagggacgagttgacactcgagggtataaaacagttttatgtcaatgttgataaggaggactggaagcttgatactctctgtgatttgtatgagactctggctattactcagagtgttatttttgttaataccagacgaaaggttgattggctgactgacaaaatgagggctcgtgatcacacagtctcagctactcatggagacatggatcagaacaccagggatattataatgagggaatttcgatctggttcctcacgtgtcctgattacaactgacctgcttgctcgaggtattgatgtgcagcaagtgtctcttgtcatcaattatgatcttcccactcagccagagaactacctccaccgtattggtcgaagtggcaggtttggaagaaagggtgtggccatcaattttgttacaagggatgatgagagaatgttgcaagatattcagagattctacaatgtggttattgaggagcttccctcaaatgttgctgatcttctttgaggttttgtgcttgctatctgtgagaaaggtctgaggaggataagtatcgctttattatcagacaattctttaagtttattttgcctcaaaacaagtgaggtgcttccgagctttgttacttaggtatatttggggcctgtaagttgcagatttctgagtatgaagtatgcgttgggtggtaaaaatcttttattcacccagctagagacttgttttctaaccacccccctcaactcccttagtttttgcttattggcatttggcataaaaagtttaagtgggacagacgacaggaattttcttgttgcctgtgtcagtttagtgtattgcatcatggaaacacttaaatatgggatgcagtccttgcaaattttgtacgagttagattatgtatgctaaattttattgcatgtaa

SEQ ID NO: 4883 - DNA, 1271 bp, Populus trichocarpa
gctcgcaaatgatggacaagatttcttcacatcatatgatgaggtttatgacacttttgattcaatgggactgcaagagaaccttttgaggggcatctatgcctatggttttgagaagccatctgcaatccagcaaagaggaattgttccattctgcaagggccttgatgtgattcagcaggctcagtcaggaactgggaaaacagcaaccttctgctctggtattctccagcaacttgattatggtctagtgcaatgtcaagctttggtccttgcgcccactagggaacttgcacaacagattgaaaaggttatgcgggcacttggtgattatcttggcgtcaaagttcatgcttgtgttggtggcacaagtgttcgtgaggaccaacgcattcttcaagctggagttcatgttgttgttggcactcctggtcgtgtgtttgatatgttaagaaggcagtcacttcgtccagattacattaaaatgtttgtcctggatgaggctgatgaaatgctgtcccgtggttttaaggatcagatctacgatattttccagttgctgccatctaaagttcaagttggtgtgttctccgctactatgccacctgaagcccttgagatcacaaggaagttcatgaacaagcctgtgaggatcttggttaagcgtgatgagcttactcttgaaggtatcaagcaattttatgttaatgtcgataaggaggagtggaagctcgaaacactatgtgatctatatgagaccctagccatcactcagagtgtcatttttgttaacacccggcgcaaggttgactggctgacagacaagatgcgaggccgtgatcacacagtctcggctactcatggagatatggaccagaacactcgtgatatcattatgcgagaattcaggtccggctcttctcgtgttctcatcactaccgacctcttggctcgtggtattgatgttcagcaagtttcccttgtcataaattatgatctgccgactcaacctgaaaactatcttcaccgtattggacgaagtggacggtttggaagaaagggtgttgctattaactttgtgacaagtgatgatgacagaatgctgtttgatatccagaagttctataatgtggtcgtcgaggagctgccatcgaatgtggccgatctcctttgatgagatttttttgtgatggtcgaggaaaatggttccacttgttatgaaaggattgtcaggtcgccttgttattttaaagccttgtttgcatgttgtg

SEQ ID NO: 4884 - DNA, 1485 bp, Pennisetum glaucum
gtacgtcgggaggattggcaccagagggtacccagtttgacggcaagcagtatgacaacaagatgcaggagctaatgactgaggacttctttaccccgtatgatgaagtctgtgaaagttttgacaacatggggctcctagagaaccttctgagaggcatctatgcctatggttttgagaaaccatcggccattcagcaaagggggattgttcccttctgcaaggggcttgatgtgattcagcaagctcagtctggaacagggaagactgctacattctgttctggtatcttgcagcagcttgattatgggttggttgagtgccaggcgttggttctcgctccaacccgtgagcttgcacagcaaattgagaaggtcatgcgtgctcttggggactacttgggtgttaaggtgcatgcctgtgttggtgggacatccgtccgtgaggaccagaggattcttgctagtggtgtgcatgttgttgtgggcacgccagggcgtgtgtttgatatgttgcgcaggcagtccctacgcccggacaacattaagatgtttgtgttggatgaagctgatgagatgctctctcgtggtttcaaggatcagatctatgatatcttccagctgcttccatcgaagatccaggtcggtgtgttctctgctaccatgccgcctgaggcccttgagattacccgcaagttcatgaacaagcctgtcaggattctcgtcaagagagatgagctcacccttgagggtatcaagcaattttatgtcaatgtggagaaggaagattggaagcttgacactctctgtgacctgtatgagaccctggccatcactcagagtgtcatcttcgtgaacacccgccgcaaggtggactggctcacagacaagatgaggagcagggaccacactgtctctgcaacgcacggtgacatggaccagaacaccagggacatcatcatgagggagttcaggtccgggtcctcccgtgtgctcatcaccaccgacctgcttgcccgtggtattgatgtccagcaggtctccctggtcatcaactacgacctgccaacccagcctgagaactacctccaccgcattggccgtagtggtcgtttcgggaggaagggtgttgctatcaactttgccacccgtgacgatgagcggatgctgcatgacatccagaggttctacaacgtgactgtcgaggagctgcctgccaacgtcgctgaccttctctagattgtgtgtcctaggtgtctgctaaggtgctggataaagaagtctgttttagttaaaaagtatcaccaacttttctatgttctggaggagtggtaatgagtttcaactatttgaattgtggctaaggatggtttctaaacttttccttctatgcaacgtttgggaaaaattttgtagcgcgtaggggttgtgccgcgtcctgggctagctgggcgctgagacactaattttaccttcaattgctaag

SEQ ID NO: 4885 - DNA, 1664 bp, Pisum sativum
gatccggggagtttttgggaaaccctagctccgttcaactaacgccgtcgcattttcttcttcacctccgaatcttcaagctatggcaggccttgcacccgaggggtcacaatttgatgctgggaaatttgatgccagaatgaatgacttaatggctggtgatggaaatgagttctacactatttctgacgaggtttgtgaaagttttgatgctatgggcttgcaagagaatctcctcaggggcatttatgcttatggttttgaaaagccatctgccattcagcaaaggggaattgttcctttctgcaagggacatgatgttattcaacaggctcagtctggaactggaaagacggcaactttctgctctggtgttctgcagcaacttgactacaatgtgacccagtgccaggccttggttttggccccaactcgtgagcttgctcaacaaattgagaaggttatgcgggcccttggagactatctaggtgttaaggtgcatgcttgtgtgggaggtacaagtgttcgtgaagatcaacgcattctatcaagtggtgtccatgttgtggttggtactcctggtcgtgtgtttgatatgttgcgcagacagtccctccacccggattacatcaagatgtttgtgttggatgaggctgatgaaatgctctctagaggtttcaaagatcagatctacgatatatttcagcttctgccaggtaagattcaagtaggagttttctctgctacaatgcctcctgaggcacttgaaatcacaaggaagtttatgaacaaacctgtgaggatccttgtgaagcgggatgagctcaccttggagggtattaagcagttttatgtcaatgttgagaaagaggaatggaagctggacacactctgtgatctttacgagacattagcaatcactcagagtgtcatttttgttaacactagaaggaaagttgattggttgactgacaagatgcgaagccgagaccatacagtctcagctactcacggagacatggatcagaataccagggacattattatgcgtgaattccgttctgggtcttcacgtgttttgataactaccgatcttttggcacgtggtattgatgtacaacaggtgtctctggttatcaattttgatctccctacacagcctgagaactatctccaccgtattggtcgtagtggaaggtttggtagaaaaggtgttgccattaactttgtcaataaggaagatgaagcaatgctgcaagatatccagaagttttacaacgtgttagtcgaggagctgccatcaaatgtcgctgagctcctctgatgagattttgccctccatattagacgcaaattagtactttttggtggtaagtgttatggtgatgtttaccctcccactcagtttttggttttatttctgcttttgaacttatttgtttgaaagtcttggtaatttaagttgcactgtcaggtaagtactttgtgtaattctgttattggccaaattagtgttggatactcttgcacatttctagaaggcaaattttctagtgtaagttttaacatcacttaaacttcaaatacattgatgtagttttattgaagtatttagactcaagttgagatttatatgcttttatttagaccaaaaaaaaaaaaaa

SEQ ID NO: 4886 - DNA, 1620 bp, Solanum tuberosum
gacacacaaacacaacagtctcatctttctaatctattcctctttcctgaactcctgcggcgtagatccgaggagtttcagacagtctttacaaaccctaacccccaatcgcttttacccacttctcctcctactctttactctttattcctcagatctttaactcatctttatcagtctggcaccggaaggttctcaatttgatgctcgtcaatttgatgctaaaatgaccgagctgcttgggactgaacagcaggagttcttcacatcatatgatgaggttcatgacagttttgatgccatgggtttgcaagaaaaccttcttaggggaatctatgcctatggttttgagaagccatctgctatccagcaaaggggtattgttcctttttgcaagggtcttgatgtgatccaacaggcacaatctggtacaggaaagactgcaactttctgctctgggattctccagcagcttgattacagcttagtcgaatgtcaggctctggttctggctccaacccgtgagcttgcccaacagattgagaaggttatgcgagcacttggtgactatcttggtgtgaaggttcatgcctgtgtaggaggtaccagtgtccgtgaggatcagcgtatccttcaaagtggtgttcatgtggttgttggtactcctggtcgtgtatttgacatgttgcgcaggcagtctcttcgccccgaccacatcaagatgtttgttctggatgaagctgatgaaatgctctcaagaggtttcaaggatcagatttatgatattttccaattgctgccaccaaagattcaagttggtgttttctctgccacaatgccaccagaggcccttgaaattactaggaagttcatgaacaagcctgtgaggatccttgtgaagcgtgatgagctcactcttgaaggtatcaagcaattttatgtcaatgttgacaaggaagagtggaagcttgaaactctttgcgatctttacgagaccttagccatcacccagagtgtgatctttgtgaacaccaggcgtaaggttgattggctcactgataagatgcgcagccgtgatcacacagtatctgccactcatggagacatggaccagaacaccagagatatcattatgcgagagttccgatctgggtcatctcgtgtgcttatcactaccgatcttctggcacgtggtattgatgtgcagcaagtatcccttgtgattaactatgaccttcctactcagccagaaaactacttgcatcgtattggtcgtagtggacgatttggaaggaagggtgtagctatcaattttgtcacaaaggatgatgaaaggatgctttttgacattcagaagttttacaatgttgtagtggaggagctaccagccaatgtggccgatcttctttgaggtggtggttttggttgtctgagctgaattcttccttaatttaatattttattcttaggttagttagaaccgcactggactaaaagttggaaactgcagtttctgtgattcgtcgtacttttccaattttgttggttttgtctttttgtattgcaagtccacaacaacttcaggttttggatgtctttgaatttttaagtatatttgat

SEQ ID NO: 4887 - DNA, 1604 bp, Solanum tuberosum
acatattgtcttcctgaactccgcggcgtagatccgaggagtttttggaaaaaagctgcagtctttacaaaccctaattctcaaaaatccccttttcctcaaatcttcagatctctctttaactatcttcttattagctataagcggcaccagaaggttctcagtttgatgctcgtcaattcgatgcgaaaatgacggagctacttggtactgaacaacaagaatttttcacatcatatgatgaggtttatgacagttttgatgccatgggtttgcaagaaaaccttctgagaggcatctatgcctacggttttgagaagccatcagctattcagcaaaggggcatcgttcccttttgcaagggccttgatgttatccagcaggcacaatctggaactggaaagacagcaactttctgctctggagttctccagcaacttgattacagtttagttgaatgtcaggctcttgttcttgcaccaacccgtgagcttgcacaacagattgagaaggttatgcgtgcactcggtgactatctgggtgtgaaggttcatgcgtgtgttgggggtaccagtgtccgtgaagatcagcgtatccttcagagtggtgttcatgtagtggttggtactccaggccgtgtctttgacatgttgcgcagacagtctcttcgccccgaccacatcaagatgtttgttttggatgaagctgatgaaatgctctccagaggtttcaaagatcagatttatgatatattccagcttttgccaccaaaaatccaagtgggtgttttctctgccactatgccaccagaggctcttgagattactagaaagttcatgaacaagcctgtgagaattcttgtgaagcgtgatgagctcactcttgaaggtattaagcaattctatgtcaacgtcgataaggaagagtggaagctcgaaacactctgtgatctttacgagaccttggccatcacccagagtgtcatctttgttaacaccaggcgaaaggttgattggctcactgataaaatgcgtggccgtgatcacacagtatctgcaactcacggagacatggatcagaacactagagatatcattatgagggagttccgatctggctcatctcgtgtgcttatcacaaccgatctccttgctcgtggtattgatgtccaacaagtctctcttgttattaactatgacctgccaactcaaccagaaaactacctgcatcgtattggtcgtagtggacgatttggaaggaagggtgttgcaatcaactttgttaccaaggatgacgaaaggatgctttttgacattcaaaagttttacaacgtcgtaattgaggagctcccagccaatgttgctgatctcctttgactctgtgaggggaattgttccttccctactggaagtagtctaatatatttattcagagtgaacaactgcaaattttgtctggtttttgttattttgtttttggaagtgtccaaataactttggatttggttgtttgaattttgtttatttgaactatttttctatggacgttaggcttttagttctattttctaatggtggtgctatatttatgccccactagttctt

SEQ ID NO: 4888 - DNA, 1358 bp, Carthamus tinctorius
  misc_feature (312)..(312): n is a, c, g, or t
cacaaacaatctcccctttcactctctcagcactcaactcctacggccaccacccgaaaggagtttgagaaaaccctaaatcgcctccccgaatctctctcatctcaatcaatctttcccccaatcttcaaaaatcagtcatggcaggcgtagcaccagaaggttctcagtttgatactcgtcactttgactcaaaaatgaatgagctgctgtcgaccgacgggcaggacttttttacatcatatgacgaggtttatgatagttttgatgccatgggtttgcaagaaaatcttttaagaggcatctatgcanatggttttgaaaaaccatcagcaattcaacagagaggtattgtcccattctgcaagggtcttgacgtaattcaacaagctcaatctggaacagggaagaccgcaaccttttgctctggtatccttcaacaactcgactacaacgtggttgagtgtcaggccttggttctggcacccacccgtgaacttgcgcagcaaatcgagaaagttatgcgagcacttggggactaccttggtgtgaaggtgcatgcttgtgtcggtggaaccagtgttcgtgaagaccagcgcatcctctcggctggtgtccatgttgtcgttggtactcccggccgtgtctttgacatgctcaggaggcagtcacttcgcgctgattacattaagatgtttgtgttggatgaagccgatgaaatgctttccagaggtttcaaggatcagatctacgatatcttccaattgttgccatcaaaggtccaagtcgggtcttctccgcaaccatgcctcccgaggccctcgagatcacccgcaagttcatgaacaaacccgtcagaatcctcgtcaagcgtgacgagctcaccctcgaaggtatcaaacagttctacgtcaacgtcgaaaaggaggaatggaagctcgagaccctctgcgacctctacgagaccctagccgtcacccagagcgtcatcttcgtcaacacccgacgaaaagtcgactggctcaccgacaagatgcgcagccgcgaccacaccgtctcggccacccacggagacatggaccaggacacccgtgacatcatcatgcgcgagttccggtccggatcctcccgtgtcctcatcaccaccgacctcttggcccgtggcatcgacgtccagcgagtctcgctggtcatcaactacgacctctcgacccagccggagaactacctccacaggatcggtcgaagcgggcggttcgagagaaagggtgtcgcgattaactttgtgacgttggatgacgagaggatgcttgcggatattcagaagttttactacgtggtggtggagggactgccgt

SEQ ID NO: 4889 - DNA, 1520 bp, Brassica napus
atcgctcttttcttttttagtttctctctttacgattcgcttcagatccgagcttggaagatttcaagctctctctaagaaagtcttttactttttgttcccgaatccaagtcatggcaggatcagcaccagaaggcacccagtttgatactcgtcagtttgaccagaggctcaatgaagtccttgagggacaggatgagttcttcacctcctatgatgaggtccatgagagctttgatgccatgggtttgcaagagaaccttcttaggggtatctatgcctatggttttgaaaagccttctgctattcagcaaagaggaatcgttcccttttgcaagggtcttgatgtgatccagcaggctcagtctggtactggcaaaaccgccactttctgctctggtgtcttgcagcagctcgacttctcccttgtccagtgccaggctctcgtcttggctcccaccagagagcttgctcagcagatcgagaaggtcatgcgtgctctcggagactaccttggcgtcaaggtccatgcttgtgttggtggaaccagtgtccgtgaggatcagcgtatcctccaggccggtgtccatgttgtcgttggaactcccggtcgtgtctttgacatgctccgaagacagtctcttcgctccgacagcatcaagatgtttgtccttgatgaagctgatgagatgctctcccgtggtttcaaggaccagatctacgacatattccagcttctcccaccgaagattcaggtcggagtgttctcagccacgatgccgccagaggctctcgagatcacaaggaagttcatgagcaaaccggtgaggatcctggtgaagcgagacgagctcaccctcgaaggtatcaagcagttctacgtgaacgtggagaaggaagagtggaagctcgaaactctctgtgacctctacgagaccttagccatcactcagagcgtcatcttcgtcaacactcgccgcaaggtggactggctcactgacaaaatgaggagccgtgaccacacggtctcagcgactcacggagacatggaccagaacacgagagacatcatcatgagagagttcaggtctggctcttcccgtgtcctcatcactacagatctcttggctcgtggtatcgatgtgcagcaagtgtctctggtcatcaactttgacctcccgactcagccggagaattaccttcaccgtatcggaagaagtggaaggtttgggaggaaaggtgtggccattgtgacgaaggatgatgagagaatgctttttgatattcagaaattctacaatgttgttgtcgaggagcttccctcaaacgttgccgacctaaggaaaaccaccgttgttcgccgttgaagaagaagaagaaaaggttacttgtttcgcaagcttcttattttgatttttgacccaactttctctgtttctctctctctctttactcatcgatacctctcgtctcattttcgaacatatatatgtctcatctgaacatgtttcttcttaatc

SEQ ID NO: 4890 - DNA, 1490 bp, Brassica napus
gatctctttactaatcgcttcagatccgagcttggaagatttcaagctctctaagaaagtctttcacttttgttctcaatcccaagtcatggcaggatcagcacctgaaggcacccagttcgatactcgtcagtttgaccagaggctcaatgaagtccttgagggacaggatgagttcttcacctcctatgatgaggtccatgagagctttgatgccatgggtttgcaagagaaccttcttaggggtatctatgcctatggttttgaaaagccttctgctattcagcaaagaggaatcgttcccttctgcaagggtcttgatgtgatccagcaggctcagtctggtactggcaaaaccgccactttctgctctggtgtcttgcagcagcttgacttctccctcgtccagtgccaggctctcgtcttggctcccaccagagagcttgctcagcagatcgagaaggtcatgcgtgctctcggagactaccttggcgtcaaggtccatgcttgtgttggtggaaccagtgtccgtgaggatcagcgcattctccaggccggtgttcacgttgtggttggaactcccggtcgtgtctttgacatgctccgaagacagtctcttcgctctgactccatcaagatgtttgtccttgacgaagctgatgagatgctctcccgtggtttcaaggatcagatctacgacatcttccagcttctcccaccaaagattcaggtcggagtgttctcagctacgatgccaccagaggctctcgagatcacgaggaagttcatgagcaaaccggtgagaatcctggtgaagcgcgacgagctcacgcttgagggtatcaagcagttctacgtgaacgtggagaaggaagagtggaagctcgaaactctctgcgacctctacgagaccttagccatcactcagagcgtcatcttcgtcaacactcgccgcaaggtggactggctcactgacaaaatgaggagccgtgaccacacggtgtcagccactcacggagacatggaccagaacacgagagacatcatcatgagagagttcaggtctggttcctcccgtgtcctcatcacgacggatctcttggctcgtggtatcgatgtgcagcaagtgtctctggtcatcaactttgacctcccgactcagccggagaattaccttcaccgtatcggaagaagtggaaggtttgggaggaaaggtgtggcaattgtgacgaaggatgatgagagaatgctttttgatattcagaaattctacaatgttgttgttgaggagcttccctcaaacgtcgccgacctagaaaagaaaaccactgttgttcgccgttgaagaagaaaaggttacttgttttgcaagcttcttattttgatttttgacccatctttgtctgttcctctctctctatctactcatcgatacctctcgtctcattttcgaacatatatgtctcatctgaacatgtttcttcttaatc

SEQ ID NO: 4891 - DNA, 1629 bp, Aquilegia formosa
tccttaactccacggcaaagatacgaggagttaggaaaccctaaccctaaacaaagctttctattactctttttcactttcttcttcttcagcaattttcaatcaagtttcaatcagcagtcatggcgggaatggcacaagaaggattacaatttaatgcacaacattatgatagcagaatgactgaagtgctctcttcggaagggcaagatttttttacatcgtatgatgaggttcacgaaagttttgatgctatgaatcttagggagaacctactgaggggaatctacgcatatggatttgagaagccttctgcgattcaacagaggggaattgtgcccttcaccaaggggcttgatgtaattcaacaagcgcagtctggaactgggaagacagcaactttctgctcagggattttacagcagcttgattttgaattggttgaatgtcaagccttggttctggcacctactcgtgagcttgcacaacagattgagaaggttatgcgggcacttggtgattatctgagcgtgaaagttcatgcttgtgtgggtggaacaagtgttcgtgaggatcagcacattctttcaaatggtgttcacgtagttgttgggacacctggtcgtgtttttgacatgttgaggagaaagtcactccgcgcggattacattaaaatgtttgtattggatgaggctgatgagatgctttcacgaggtttcaaggaccagatctacgacatttttcagcttcttcctgcaaaagttcaggttggtgttttctcagcaacaatgcctccagaagctcttgagatcacaaggaagttcatgaacaagcctgtaaggattctagtgaagcgtgacgagctcacccttgagggtatcaagcagttctatgtcaatgttgacaaagaagaatttaagctcgaaacactctgtgatctctatgagacattagccatcacccagagtgtcatttttgtgaatactcgtcggaaggttgactggcttactgacaagatgcgtggtcgtgatcatacagtctctgccacccatggagacatggaccagaacacaagggacatcatcatgcgagaattccggtctgggtcctctcgcgtgctcatcaccactgacctcttggcccgtggtattgatgttcagcaagtatccttggtaatcaactttgatcttcctactcaaccagaaaactatctccatcgtattggtcgtagtggacgttttggaagaaaaggtgttgccatcaactttgtgactcgggatgatgagaggatgttgtatgatatccagaaattctataacgtgcagattgaggagcttccatccaacgttggtgatcttctttaaagaggtttttttattggtatatctgagggcctttttctactgaagtactatttcttttgtttttcttgagtagttagttttggaattagcatctttggagaacttctttgactgtcagtatgactgacattagcaatgagaaaaatcattcattgctcattttgaatattggtaaacatcagtggccgcaaattttgtccatttagtgatatgtaatctacacctccaatatcaaagtggtgatgccttttgttctccctgataa

SEQ ID NO: 4892 - DNA, 1629 bp, Aquilegia formosa
tccttaactccacggcaaagatccgaggagttaggaaaccctaaccctaaacaaagctttctattactctttttcactttcttcttcttcagcaattttcaatcaagtttcaatcagcagtcatggcgggaatggcacaagaaggattacaatttaatgcacaacattatgatagcagaatgactgaagtgctctcttcggaagggcaagatttttttacatcgtatgatgaggttcacgaaagttttgatgctatgaatcttagggagaacctactgaggggaatctacgcatatggatttgagaagccttctgcgattcaacagaggggaattgtgcccttcaccaaggggcttgatgtaattcaacaagcgcagtctggaactgggaagacagcaactttctgctcagggattttacagcagcttgattttgaattggttgaatgtcaagccttggttctggcacctactcgtgagcttgcacaacagattgagaaggttatgcgggcacttggtgattatctgagcgtgaaagttcatgcttgtgtgggtggaacaagtgttcgtgaggatcagcacattctttcaaatggtgttcacgtagttgttgggacacctggtcgtgtttttgacatgttgaggagaaagtcactccgcgcggattacattaaaatgtttgtattggatgaggctgatgagatgctttcacgaggtttcaaggaccagatctacgacatttttcagcttcttcctgcaaaagttcaggttggtgttttctcagcaacaatgcctccagaagctcttgagatcacaaggaagttcatgaacaagcctgtaaggattctagtgaagcgtgacgagctcacccttgagggtatcaagcagttctatgtcaatgttgacaaagaagaatttaagctcgaaacactctgtgatctctatgagacattagccatcacccagagtgtcatttttgtgaatactcgtcggaaggttgactggcttactgacaagatgcgtggtcgtgatcatacagtctctgccacccatggagacatggaccagaacacaagggacatcatcatgcgagaattccggtctgggtcctctcgcgtgctcatcaccactgacctcttggcccgtggtattgatgttcagcaagtatccttggtaatcaactttgatcttcctactcaaccagaaaactatctccatcgtattggtcgtagtggacgttttggaagaaaaggtgttgccatcaactttgtgactcgggatgatgagaggatgttgtatgatatccagaaattctataacgtgcagattgaggagcttccatccaacgttggtgatcttctttaaagaggtttttttattggtatatctgagggcctttttctactgaagtactatttcttttgtttttcttgagtagttagttttggaattagcatctttggagaacttctttgactgtcagtatgactgacattagcaatgagaaaaatcattcattgctcattttgaatattggtaaacatcagtggccgcaaattttgtccatttagtgatatgtaatctacacctccaatatcaaagtggtgatgccttttgttctccctgataa

SEQ ID NO: 4893 - DNA, 1717 bp, Mesembryanthemum crystallinum
  misc_feature (1455)..(1455): n is a, c, g, or t
  misc_feature (1472)..(1472): n is a, c, g, or t
  misc_feature (1554)..(1554): n is a, c, g, or t
gcttatagatccgaggattttggaaaccctaattttctcccaacacacaaacatcttttacgcctctctttctcctctcgatccactttcgcttcatatttcatctctctacttgttctgtcatggctgctgtacccgaaggatcacagtatgatactcgtcagtatgatacaaagatgagcgaattgcttgacactgacgtggatcaatttttcacctcgtacgatgaggtttatgaaacttttgatggcatgggtttgcaagagaatcttctgagaggaatttatgcatatggttttgagaaaccttctgctattcaacaaaggggcatagttccattttgcaagggtcttgatgttatccaacaagctcagtccggaactggaaaaacagcaaccttctgctctggcattctgcaacaacttgactacagtttagtccagtgccaagcattggtattggcacccactagagagcttgctcaacagattgagaaggttatgcgagctcttggtgattatcttggtgtgaaggtccatgcttgtgttggtggaaccagtgtccgtgaggatcaacgtatactacaaagtggtgtccatgttgtcgtcggtaccccaggtcgtgtttttgacatgttacgaaggcagtcacttcgttctgatagcattaagatgtttgtgatggatgaagctgatgagatgctttcacgaggtttcaaagaccagatttacgacatattccagctactcccaccagagattcaaatcggtgtgttttctgcaaccatgccaccagaagctttggaaatcacccgtaagttcatgaagaagcccgttcggatcttggtgaagcgtgacgagctcactttggagggtatcaaacaattctacgtcaacgttgacaaggaagaatggaagcttgaaaccctctgtgatctttacgaaaccctagccatcacccagagtgtgatcttcgtcaacacaaggcgtaaggtcgattggctcacggacaacatgcgaagccgtgaccacacagtctcggccacccacggagacatggaccagaacactagggacatcatcatgcgtgagttccgttctgggtcttctcgtgttctcatcaccaccgatctcctggctcgtggtattgatgtccagcaggtgtcccttgtcataaactacgatctcccaactcagccagagaactaccttcaccgtatcggtagaagtggaagattcggaagaaagggagttgctatcaactttgtgacccatgatgacgaaagaatgctcgctgatatccagaggttctacaacgtaacagttgaggagctgccagcaaacgtcgccgatcttatctgatgagctctctctctctctttcttcttttttccaggtttctgttctaatcgacagtttttgcccacttcataatctcattaagacatccaaaganaatggatccagaatgtngctgcctacttatttacatatttttggatatgtaggtgatagttgctgggcaggggtctctatgcccattcttatgtgtagntaggaagattcttattttatactactacttagcttccctcaaattttctgttctttctacccttgctttaatttaaaaatagtagccatttaaaaggagtgatccgattgttgaagcaaaaaaatttggctgggaaatttttggttttgaatgaataccatgg

SEQ ID NO: 4894 - DNA, 1530 bp, Triphysaria pusilla
ttctccaactccacggcgcagatccgaggagttattccgcaaattaatcaatctcaacaagcttgtttctcaattcaagaatggcaggttctgcaccagaaggttcacaatttgatgctaagcaatatgatgcaaagatgactgaaatagttgatgctggagaagaatactatacttcttatgatgtggttcatgacagttttgattcaatgtctctgctggaaaaccttcttagaggcatttatgcctatggttttgagaagccttcagccattcagcagaggggcattgttccattctgcgaggggcgtgacgttatccagcaagctcagtctggaactggaaaaactgccactttctgctctggcattctgcagcagcttgattacagcttgactcagtgtcaggccttggttttggcacccactagggaactggctcagcagatcgagaaggtcatgcgtgccctcggggacttccttggcgtcaaggttcatgcttgtgttggtgggaccagtgttcgtgaggaccagcgtattctttcagccggagtccatgttgttgttggaacccctggccgtgtgtttgacatgttacgtaggcaatcccttcgttctgacaacatcaagatgtttgttctggatgaggctgatgagatgctttcgcgtggttttaaggatcagatttacgacatcttccagctgcttcccgccaaggtccaagttggcgtgttctcagcaacaatgccacccgaagccctcgatatcaccagaaagttcatgaacaagccagtccgcatccttgtcaaacgtgatgagctaaccctcgagggtatcaagcagttttacgtcaatgtcgagaaggaagaatggaagctcgaaaccctctgcgacctttacgagacattagcaatcacccagagtgtcatctttgtcaacaccagacgaaaggtcgactggctgaccgacaacatgcgcaccagggaccacactgtctcagccactcacggtgacatggaccagaacactcgtgacatcatcatgcgtgagttccgatcgggctcgtcccgagtcctcatcaccacagatttgctggcccgtggtatcgatgtgcagcaagtttcgcttgtgatcaactttgatttgccgactcagcctgagaactatttacatcgtattggtaggagtgggaggtttgggagaaagggagtggcgattaactttatgacggttgaggatcagaagatgcttcaggatattcagaagttttataatgtggtggttgaggagttgccctcgaatgtggctgatcttctttgaggttctgattagggttttttgatggtataaatgagggacaagtggtgtttttttatttaatttttatttttgttgctagataatgtgtttttcagttggtttttattttggggagattgttatgttgttacacacttgtgaaaggtgagcaatatgatatactaattcaattttggatgtaggtatgtaacgtattttgatttttggacct

SEQ ID NO: 4895 - DNA, 1394 bp, Lactuca sativa
tactcatctcaaacacacagccttttctttcactcgcactcaaattccctcaactccacggccacccgaggagtttgagaaaaccctaaaaagcctcctcaaaaatctctcaactttttctctaaatctttccaccaatctgcaaatcagtcatggcaggagcagcaccagaaggttcccagtttaatgctcagcaatttgattccaaaatgaatgaattgctttcaaccgatggacaagactttttcacctcatacgatgaagtttatgatagttttgatgccatgggtttgcaagaaaacctcttgagaggcatctatgcatatggttttgaaaaaccatctgcaattcaacaaaggggaatagtcccattctgcaagggtcttgatgtgatccaacaagctcaatcaggaacaggaaagactgcaactttttgctctggaatccttcaacagcttgactacaatgtagtcgagtgtcaagctttggttcttgcacccactcgtgaacttgctcaacaaattgaaaaagtcatgcgggccctaggggactaccttggagtcaaagtccacgcgtgcgtgggtgggaccagtgtccgtgaggatcaaaggatcctctctgctggggtccacgtggttgttggtacacctggacgtgtctttgacatgctcaggaggcagtcactacgtgccgattacatcaagatgtttgtcttggatgaagctgatgaaatgctctcaagaggtttcaaagatcagatttatgatatcttccagttgttgccatcgaaagtccaagtgggtgtgttctccgctacaatgccaccagaagctttagaaatcacccggaaattcatgaacaaacccgtgagaattctcgtgaaaagagacgaacttaccctcgaaggtatcaaacagttttacgtgaacgttgaaaaggaagaatggaaactcgaaacactctgtgacctttacgaaaccctagcaatcacccagagtgtcattttcgtaaatacgcgtcgaaaggttgactggttgaccgacaaaatgcgttcccgggaccacactgtgtccgccacccacggtgacatggaccaaaacacgcgtgacatcatcatgcgggagtttcgatcgggatcttcacgtgtgttgatcactacagatcttttggcacgtgggattgatgtgcaacaggtgtcacttgttatcaattatgatcttccaacacagcctgagaattatcttcataggattgggcgaagtgggaggtttgggagaaagggtgtggccattaattttgtcactttggatgatgaacggatgcttgcgatattcagaagttttataatgttgtgggtgaggagttgccttccaatggtgcggatctcatataag

SEQ ID NO: 4896 - DNA, 1631 bp, Physcomitrella patens
agatgcactggtcctgtggggaggtggggttgaaagccctattccgaagacgtgttgagtccttttgtgcttgctgctgcgccgtcgtcctcacccgaccgcctctgctgcctcctctaacgcactgatcatagtatggcaggttctgctcccgaaggttcccagttcgatgcacgccaatatgacgccaagatggagaacatcttgtcggccgagggcgaggacttcatttcgacgtgggaggaggttcacgacacttttgatgtgatgggtctacatgagaaccttctgagaggaatttacgcctatggttttgagaagccatctgctatccaacagcgtggaatcgttcccttcaccaagggtcttgatgtcattcaacaagcccagtctggaactggcaagacagctactttttgctctggtattctccaacaattggattatcagcttcttgagtgccaagctctggttttggcacccactcgggaacttgcccagcagattgagaaggttatgcgcgcgttaggtgactatctccaggttaaggtacatgcctgtgtcggaggtaccagtgtcagggaggatcagcgaattttgcaagctggtgttcacgttgttgttggaactcctggccgtgtgtacgacatgttgcgaagaaacgcactccgtgctgattcaatcaagtgcttcgtgctggacgaggccgatgagatgctttcgaggggattcaaggatcagatttatgacatcttccagcttcttccacagaagcttcaagtgggtgtgttttctgccacaatgccacccgaagcgcttgagatcaccaggaagttcatgaacaagccagtgaagatcttggtcaagagagacgaactgactctggagggtatcaagcagttttacgtgaatgtagacagggaggagtggaaattagacacactatgtgatctttatgaaaccctggccattacgcagagtgttattttcattaacacccgccgaaaggtcgactggcttaccgataagatgcgagctcgcgaccacaccgtctctgcaacacacggagatatggaccaaaacacccgtgacatcatcatgcgtgagttccgttcagggtcatcccgagtgctcattaccaccgatctcctggctcgtggtatcgacgttcaacaggtttctctggtcatcaattacgatctgcctacccagcctgagaactatctccaccgtattggacgaagtgggcgttttggacgtaagggtgtagctatcaacttcgtcacaagggatgacgatcgcatgcttcaggatattcaaaagttctacaacaccgtgatcgaggagttgccttccaatgttgcagatcttttatgagttgtggatagtgtctcctttagcaccaggaagagggagtgttttatagatgtttcggtgcccttctaagtgctggtcggggaagtatcagtgcggggtggaatggaaggctagcttgccggtttaaatgattatttgagggcaggtattttagaagggtcaggtctctgcacgagccagcactggttggaagtgtattgatcatatcgggaggactggaagttcttaggcagtaactaagaaagtttttgcta

SEQ ID NO: 4897 - DNA, 1618 bp, Theobroma cacao
  misc_feature (677)..(677): n is a, c, g, or t
  misc_feature (712)..(712): n is a, c, g, or t
  misc_feature (856)..(856): n is a, c, g, or t
  misc_feature (1052)..(1052): n is a, c, g, or t
  misc_feature (1074)..(1074): n is a, c, g, or t
  misc_feature (1107)..(1107): n is a, c, g, or t
  misc_feature (1175)..(1175): n is a, c, g, or t
  misc_feature (1184)..(1184): n is a, c, g, or t
  misc_feature (1217)..(1217): n is a, c, g, or t
  misc_feature (1240)..(1240): n is a, c, g, or t
  misc_feature (1253)..(1253): n is a, c, g, or t
  misc_feature (1257)..(1257): n is a, c, g, or t
  misc_feature (1260)..(1260): n is a, c, g, or t
  misc_feature (1326)..(1326): n is a, c, g, or t
  misc_feature (1349)..(1349): n is a, c, g, or t
  misc_feature (1354)..(1354): n is a, c, g, or t
  misc_feature (1371)..(1371): n is a, c, g, or t
  misc_feature (1382)..(1382): n is a, c, g, or t
  misc_feature (1400)..(1400): n is a, c, g, or t
  misc_feature (1416)..(1416): n is a, c, g, or t
  misc_feature (1423)..(1423): n is a, c, g, or t
cggggattagctccttgctccaaaacctttaaactgctgttcctgtccaaaaagaactgttcttcagatccggttagagttttctccaaacctctaaccttaaattcattactttcttgtttcaattcaatctcgaaaacaacgacaatcaaaccaaacagtcatggctggacttgcaactgacggatcacagtatgatgctcatcaatatgacagcaaaatgaatgaattgctttctgatgaaggaaaagagttctttactacttatgatgaggtctgtgagagctttgataaaatgggtttgaaagaaaacctcctaagaggcatctatgcttatggatttgagaagccttcagcaattcagcaaaggggaattgttcccttctgcaaaggtctagatgtaattcagcaagcacagtctggtactggtaaaacagcaacgttctgttctgggatcttgcagcagctggattatgatttagtacaatgtcaagctttggttcttgctcccactagagagcttgcacaacagattgagaaagtcatgcgtgcccttggtgattatttgggagtaaaagttcatgcatgtgttggtggaaccagtgtccgggaggatcaacggatccttgctgctggtgtccatgttgttgttggtactcctggtcgtgtttttgacntgcttcgtaggcagtcccttcgtgcagatgccatnaggatgtttgtcctggatgaagctgatgaaatgctttcccggggttttaaagatcagatctatgatatcttccagcaactccctgcgaaaatccaggttggtgtattttctgcaacaatgccacctgaggctcttgagattacncggaaattcatgaacaaaccagtcagaattcttgtaaagcgtgatgagcttacccttgaaggtattaagcagttttacgtcaatgttgacaaggaggagtggaagcttgacacactttgtgatctctatgaaactctggccatcactcagagtgtcatctttgttaacaccagacgcaaagtcgattggcttaccnatcaattgcggagccgtgatcncacggtgtctgccacccatggagacatggaccngaacacaagggatattatcatgcgtgagttccgttcaggatcttcacgtgtgctgatcaccaccgatntcttggctngagggattgatgtccagcaggtctccttggttnttaactatgatttgccgactcancctgagaactatnttcnccncattggtcgaagtggaaggtttgggaggaaaggtgttgcaatcaactttgtgacgagagatgatgncaggatgctgactgacatccagnggttntacaacgtggtgattgnggagctgcctnccaatgttgcggatttgntctgattggttcattntcatacncaagagcatacatgtctgtttgttttagttagggaaaggttaaaccggatttggtttgttggacttcattataattattgtctttttttttttttttggttctggtctcctgggtttttgtgaaatcttgttcgttgcgatgttccaaggctcaaattttgattaaaaacagagataaatgaattttcttgcgca

SEQ ID NO: 4898 - DNA, 2066 bp, Marchantia polymorpha
  misc_feature (1976)..(1976): n is a, c, g, or t
  misc_feature (1979)..(1979): n is a, c, g, or t
tgctgagctccaccgccgctactgctgtgcgccgccgtctctcacaagagaaactcttgcacatcatccccccccaaatcaatcgacagcatggcaggtttggctccagaaggatctcagtttgacgcccgacagtatgaccagaagatggaccaagttcttaaccaggaaggagaagactttatctccacctgggatgaggttcacgagaccttcgatgctatgggtctccacgagaacttgttaaggggcatctacgcctacggtttcgagaagccgtctaccattcaacaacgtggtatcgtccccttctgcaagggtttggacgtcattcagcaggcacaatctggaacgggaaagaccgctactttctgttcaggtatcttgcagcagctcgattataatctggttgagtgccaggctctagttctggctcctactcgtgagttggctcagcagattgagaaggttatgagggcacttggagactaccttcaagtgaaggtgcacgcctgtgtcggtggaaccagtgtgcgtgaggatcagcgaatcctccaagccggagtacatgttgttgttggtactcctggtcgtgtgtacgatatgttaaggcgccatgccctgagacccgagtcaatcaagtgctttgtcctcgatgaggctgatgaaatgttatcccgaggattcaaggaccagatttacgatatcttccagcttctgccacagaagcttcaggttggagttttctcagcaacaatgcccccagaggcactcgagatcaccaggaagttcatgaacaagccagttaagattcttgtaaagagagatgaacttaccctggagggtattaagcagttctatgtaaatgttgacagggaagaatggaagcttgataccttatgcgatctctacgagacgctggccatcacccagagtgtcatcttcatcaacaccaggaggaaggtcgactggttgaccgataagatgcgcgcacgagaccataccgtctccgccacccacggtgacatggaccagaacacccgtgatatcatcatgagggagttccgttctggatcatcgcgtgttttgatcaccaccgatctgttggctcgtggtatcgacgttcaacaagtatcccttgttattaactacgacttacccacccagcccgagaactacctccaccgtattggacgaagtggtcgattcggaaggaagggagttgccatcaattttgtcaccaaggaagatgagaggatgctgcaggacatccagcgcttctacaacaccgtcatcgaagagcttccatccaacgtcgctgatcttctctaagttgtgattgttgatgaagggctgacaacaccgagtatcttgagctaacatgagtcaacagctggtgcccgaggattgctgttgcaagtatgatcggctcatcttttgtaacacaagtgtcgagggagggtgacctttgtatcacaagtgtcaagggagggtgattattagccaatttgggatgtactcatgcctgagtaatcaaatgaggtagaggggctggcatggataatatcaagcgatggcggggttttgcacggagtggtgtgattttccaggtctggtcaagcactccattcgatgtattgctacattcagtaaggaagaggctgtacatcttagctattgagcttaattgactcgccttttgcgaggctagtcagtgaggcgttcttttaggaatgtgctttttctttaggaccgtgatcgaacaacaacattgcatttaaaagtgcactcttgaaatttacaggtttctttgagctgtgtgtgttgagggaaatgcgatgagttgaataattaagttatttttgttaatgaggtgtaggcaaaaagattttcggtacaaacaccctcaaatcctacgtttacgattgtttaatattttgatgagaatatagacaggactttacttaaaaatctanaanacggtgtcatgtctcaaaattatcgtgactgttgagtgtaaactttgaagatgaatttgagtttggttatatctctcaaaaaaaaaa

SEQ ID NO: 4899 - DNA, 1688 bp, Physcomitrella patens
ctactgagatgcactggtcctgtggggaggtggggttgaaagccctattccgaagacgtgttgagtccttttgtgcttgctgctgcgccgtcgtcctcacccgaccgcctctgctgcctcctctaacgcactgatcatagtatggcaggttctgctcccgaaggttcccagttcgatgcacgccaatatgacgccaagatggagaacatcttgtcggccgagggcgaggacttcatttcgacgtgggaggaggttcacgacacttttgatgtgatgggtctacatgagaaccttctgagaggaatttacgcctatggttttgagaagccatctgctatccaacagcgtggaatcgttcccttcaccaagggtcttgatgtcattcaacaagcccagtctggaactggcaagacagctactttttgctctggtattctccaacaattggattatcagcttcttgagtgccaagctctggttttggcacccactcgggaacttgcccagcagattgagaaggttatgcgcgcgttaggtgactatctccaggttaaggtacatgcctgtgtcggaggtaccagtgtcagggaggatcagcgaattttgcaagctggtgttcacgttgttgttggaactcctggccgtgtgtacgacatgttgcgaagaaacgcactccgtgctgattcaatcaagtgcttcgtgctggacgaggccgatgagatgctttcgaggggattcaaggatcagatttatgacatcttccagcttcttccacagaagcttcaagtgggtgtgttttctgccacaatgccacccgaagcgcttgagatcaccaggaagttcatgaacaagccagtgaagatcttggtcaagagagacgaactgactctggagggtatcaagcagttttacgtgaatgtagacagggaggagtggaaattagacacactatgtgatctttatgaaaccctggccattacgcagagtgttattttcattaacacccgccgaaaggtcgactggcttaccgataagatgcgagctcgcgaccacaccgtctctgcaacacacggagatatggaccaaaacacccgtgacatcatcatgcgtgagttccgttcagggtcatcccgagtgctcattaccaccgatctcctggctcgtggtatcgacgttcaacaggtttctctggtcatcaattacgatctgcctacccagcctgagaactatctccaccgtattggacgaagtgggcgttttggacgtaagggtgtagctatcaacttcgtcacaagggatgacgatcgcatgcttcaggatattcaaaagttctacaacaccgtgatcgaggagttgccttccaatgttgcagatcttttatgagttgtggatagtgtctcctttagcaccaggaagagggagtgttttatagatgtttcggtgcccttctaagtgctggtcggggaagtatcagtgcggggtggaatggaaggctagcttgccggtttaaatgattatttgagggcaggtattttagaagggtcaggtctctgcacgagccagcactggttggaagtgtattgatcatatcgggaggactggaagttcttaggcagtaactaagaaagtttttgctacatcttgcgtgttcttgaggacttgcgaccaattgtatttgttgatagtct

SEQ ID NO: 4900 - DNA, 1816 bp, Pinus taeda
gccgggggtgtatccccggttgagaaactggataacctgctggtcctaacgtagaagaggcgaaggcataccctaagctcttcctctttgtgccgttgctgctgctgtctgctctgctttgcgaattggcatcgcgaaccatttctgctattcgatctcagcttggattaaatcttaataatcatggccggagcggtagcagatgcgactttgttcgacgctcgtcagtatgacgccaagatgaaggaaatactttcaacagaaggagacgagctctttgcaagctacgatgaagttcacgaaagcttcgatgaaatgggcttacacgagaatcttctcagaggcatctacgcctatgggtttgagaagccatctgcgattcagcagaggggaatcgtgccgttctgcaagggtcttgatgtgatacagcaggcccagtctggaacgggcaagacagctactttctgttccggaattctgcagcaactcgactatggcttgctggaatgccaggctttggttctcgcccccacccgagagcttgcacaacaaatcgaaaaggtcatgcgcgctctcggggattacttgcaggttaaagttcatgcctgcgtaggtggaaccagtgttcgtgatgatcagcgtatactcatgagtggagttcatgttgttgttggaaccccaggccgtgtgtttgacatgttacgcaggcactctcttcgcccagattacatcaagatgtttgtgctggatgaagccgatgaaatgctttccaggggtttcaaagaccagatctatgatatttttcagctactcccttcaaagattcaggtgggtgttttctctgctacaatgcctcctgaagcacttgagatcaccaggaaattcatgagtaagcctgtgaggattctagtgaagagggatgagttgactcttgagggtatcaagcagttctatgttaatgttgaaaaagaggattggaaacttgacacactgtgtgatctgtatgagaccctggcaatcacacaaagtgttatttttgttaacaccaggcgaaaggttgattggttgacagacaagatgagagctcgtgaccacactgtctctgccactcatggggacatggatcaaaacaccagggatatcattatgagggaatttcgatctggatcctcacgtgtcctgattacaactgatctgctggcacgtggtattgatgtgcaacaagtctcactggtcatcaactatgaccttcctacccagccagaaaactatctccatcgaattggtcgtagtggcaggtttggaaggaagggtgtggcaattaactttgttacaagagatgatgagagaatgctacaagacattcagaggttctacaatgtggttgttgaggagcttccttctaatgttgctgatcttctttgaggtcttgttaggaagatcttgcgagatattcaaattatcatttttaattttattgtcggacaattctttatcttggctcataacatgtgacatgttttgaaatctttggggcctatgaatttgagatttattagtatttggtgtaggtgttgggtgctaaaagcttgctgttcacccagataaggactattcaagtttttgtccgttggtcgtatttgacataaaaaattctcatgtgatacagacaacaattttttgatgtttctgagttgtctgtattgtttgatttattccatttgttgaacctctgatgtatgagatgcactccttggaaattttgtaccacttagattatttgtgaaaccaatggttacatgcaatatgatgcaat

SEQ ID NO: 4901 - DNA, 1824 bp, Pinus taeda
  misc_feature (3)..(3): n is a, c, g, or t
gcngggggtgtatccccggttgagaaactggataacctgctggtcctaacgtagaagaggcgaaggcataccctaagctcttcctctttgtgccgttgctgctgctgtctgctctgctttgcgaattggcatcgcgaaccatttctgctattcgatctcagcttggattaaatcttaataatcatggccggagcggtagcagatgcgactttgttcgacgctcgtcagtatgacgccaagatgaaggaaatactttcaacagaaggagacgagctctttgcaagctacgatgaagttcacgaaagcttcgatgaaatgggcttacacgagaatcttctcagaggcatctacgcctatgggtttgagaagccatctgcgattcagcagaggggaatcgtgccgttctgcaagggtcttgatgtgatacagcaggcccagtctggaacgggcaagacagctactttctgttccggaattctgcagcaactcgactatggcttgctggaatgccaggctttggttctcgcccccacccgagagcttgcacaacaaatcgaaaaggtcatgcgcgctctcggggattacttgcaggttaaagttcatgcctgcgtaggtggaaccagtgttcgtgatgatcagcgtatactcatgagtggagttcatgttgttgttggaaccccaggccgtgtgtttgacatgttacgcaggcactctcttcgcccagattacatcaagatgtttgtgctggatgaagccgatgaaatgctttccaggggtttcaaagaccagatctatgatatttttcagctactcccttcaaagattcaggtgggtgttttctctgctacaatgcctcctgaagcacttgagatcaccaggaaattcatgagtaagcctgtgaggattctagtgaagagggatgagttgactcttgagggtatcaagcagttctatgttaatgttgaaaaagaggattggaaacttgacacactgtgtgatctgtatgagaccctggcaatcacacaaagtgttatttttgttaacaccaggcgaaaggttgattggttgacagacaagatgagagctcgtgaccacactgtctctgccactcatggggacatggatcaaaacaccagggatatcattatgagggaatttcgatctggatcctcacgtgtcctgattacaactgatctgctggcacgtggtattgatgtgcaacaagtctcactggtcatcaactatgaccttcctacccagccagaaaactatctccatcgaattggtcgtagtggcaggtttggaaggaagggtgtggcaattaactttgttacaagagatgatgagagaatgctacaagacattcagaggttctacaatgtggttgttgaggagcttccttctaatgttgctgatcttctttgaggtcttgttaggaagatcttgcgagatattcaaattatcatttttaattttattgtcggacaattctttatcttggctcataacatgtgacatgttttgaaatctttggggcctatgaatttgagatttattagtatttggtgtaggtgttgggtgctaaaagcttgctgttcacccagataaggactattcaagtttttgtccgttggtcgtatttgacataaaaaattctcatgtgatacagacaacaattttttgatgtttctgagttgtctgtattgtttgatttattccatttgttgaacctctgatgtatgagatgcactccttggaaattttgtaccacttagattatttgtgaaaccaatggttacatgcaatatgatgcaatatttttcg

SEQ ID NO: 4902 - DNA, 1827 bp, Picea glauca
gctctttgtgccgttgctgctgctgtctgctttgctctgcgaattcgcctcccgaaccatttctgctattcgatctcagcttggtttaaattttcaatcatggccggagtggtagcagatgcaactttgttcgacgctcgtcagtatgacgccaagatgaaggaaatactttcaacagaaggagacgagctcttcgcaagctacgatgaagttcacgagagcttcgatgaaatgggcctacacgagaatcttctcagaggcatctatgcctatgggtttgagaagccgtctgcgattcagcagaggggaatagtgccgttctgtaagggtcttgatgtgatacagcaagcccagtccggaacgggcaagacagcgactttctgttccggaattctgcagcaactcgactatggcttgctggattgccaggctttggttctcgcccccacccgagagcttgcacagcaaatcgagaaggtcatgcgcgctctcggggattacttgcaggttaaagttcatgcctgcgtaggtggaaccagtgttcgtgatgatcagcgtattctcatgagtggagttcatgttgttgttggaaccccaggccgtgtgtttgacatgttgcgcaggcactctcttcgccccgattacatcaagatgtttgtgttggacgaagccgatgaaatgctttccaggggtttcaaggatcagatctatgatatttttcagctgctcccttcaaagattcaggtgggcgttttctctgctacaatgcctcctgaagctcttgagatcaccaggaaattcatgagtaagcctgtgaggattctagtgaagagggatgagttgacacttgagggtatcaagcagttctatgtgaacgttgaaaaggaggattggaaacttgatacattgtgtgatctgtatgaaacactggcaatcacacaaagtgttatttttgttaacaccaggcgaaaggttgactggctgactgacaagatgagagctcgtgaccacacagtctctgctactcatggggacatggatcaaaacaccagggatattattatgagggaatttcgatctggatcctcacgtgttctgattacaactgatctgctggcccgtggtattgatgtgcaacaagtctcactggtcatcaactatgaccttcctacccaaccagaaaactacctccatcgaattggtcgtagtggcaggtttggaaggaagggcgtggcaattaactttgttacaaaggatgatgagagaatgctacaagacattcaaaggttctacaatgtggttgtcgaggagcttccttctaatgttgctgatcttctttgaggttttgttctgcgctttgaaagaaagttctcgtgagatattcaacttatcatttttatttttattgtcagacaattctttatcttggctcaaaacaagtgacgtgttttgagtagttatcttttgggcctttaaatttgagatttcttagtattggagtaggtgtcgggtagtaaaaacttgctattcacccagatagagactcggctttttattcaagtttatgtatgttggtggtatttgacataaaaattctgatgtggtacaggcaacagtaattttttgatgtttctgagttgtctgtattgtttgatttattccattgttgaagctcttgtgtatgagatgcactccttggaaattttgtacgagttggattctttgtgctatcaattgtcacatgcaattaggcattgtgcctgttattatatgacgcaatatttttctgaatgtgccatttgtaaagtaaactgcaatttttcagca

SEQ ID NO: 4903 - DNA, 1571 bp, Brassica napus
gggtcaatcgattttgcactttctctctctctaaaactctttgtttcatctcttgggttcagatccgagttcggaaggtttccaagcactccaaagcctttcacttttgctcttaaagctttcatctctctctctctctctctctcccacacaactcaaacaagtcatggcaggatcagcaccagaaggcacacagtttgacacgcgtcagtttgatcagaagctcaacgaagtcctggagggacaggacgagttcttcacctcgtatgatgaggtccatgagagctttgatgccatgggtctccaagagaaccttcttaggggcatctatgcttatggttttgaaaagccatctgctattcagcaaagaggaatcgtacccttttgcaacggtctcgacgtgatccagcaggcacagtccggtaccggcaaaaccgccactttctgctctggtgtcttgcagcagctcgacttcacccttgtccagtgccaggctctcgtcttggctccaaccagggagcttgctcagcagattgagaaggtcatgcgtgctctaggagactatcttggcgtcaaggtccacgcctgtgtcggtggaaccagtgtccgtgaggatcagcgtatcctccaagccggtgtccacgtcgtggtgggaacaccaggtcgtgtgttcgacatgctcagaagacagtctcttcgcgctgactccatcaagatgtttgttcttgacgaagccgatgagatgctctcacgcgggttcaaggaccagatctacgacatcttccagctcctcccgccgaagatccaagtcggtgtgttctcggccacaatgccaccggaggctctcgagatcacgaggaagtttatgagcaaaccggtgaggatcttggtgaagcgcgacgagctgactctcgaaggtatcaagcagttttacgtgaacgtggagaaggaagattggaagctggagactctttgcgacctctacgagacgttagccatcactcagagcgtcatcttcgtcaacactcgtcgcaaggtggactggctcacggataaaatgaggagccgtgaccatacggtgtcggctactcacggagacatggaccagaacactagagacattatcatgagagagttcaggtctggttcttcgcgtgtgctgatcacgactgatctcttggctcgtgggattgatgtgcagcaagtgtctctggttattaactttgatctgccgactcagcctgagaactaccttcaccgtattggtaggagtgggaggtttgggaggaaaggtgtggcgattgtgacgaaggatgatgagaggatgctttttgatattcagaagttttacaatgtggttgttgaggagcttccatcgaacgtagctgatctggaagaaaaaggttacttggtttgcaagtttcttatttgacttttgacccatctctctctctctttctgaatcatctcgagaccagttttttatttatttctagtattcaaccaactctttcgaacatatgttgtttcttctgaccatttttcttttttaatctcatgcaatgtttacc

SEQ ID NO: 4904 - DNA, 1250 bp, Arabidopsis lyrata
cagtcatggcaggaatgacgtcggatggaacacaatatgatcctcgtcagtttgatactaagatgaatgccgtactcggcgaggaaggagaggaaacattctacactaactatgacgaagtttgcgatagctttgatgcaatggaactgaaaccagatcttcttaggggtatttatgcttatggttttgagaagccttctgctattcagcagagaggaattattccattctgcaagggtcttgatgtcatccagcaagctcaatctggaactggaaagaccgctaccttttgctctggtgttttacagcagctagatattagtttggttcaatgccaagctcttgttttggctcctacccgagaacttgcccagcaaattgaaaaggttatgagggcacttggtgactatcttggcgtcaaggctcaggcttgtgttggtggaactagtgttcgtgaggatcaacgcgttcttcagtctggtgttcatgttgttgttggaacccctggtcgtgtctttgacttgttgcgtagacaatccctccgcgctgatgcaatcaaaatgtttgttcttgatgaagctgatgaaatgctctctcgtggtttcaaggatcagatatacgacatcttccagcttcttccttccaaggttcaggtcggtgttttctctgctacaatgccacccgaagcccttgagatcacaaggaagtttatgaacaaaccagtcaggattctggtcaagcgtgacgagctgactcttgaaggtataaagcagttttatgtcaatgtagacaaggaagagtggaaactcgagacactatgcgatctctacgagacactagccatcacgcaaagtgtcatctttgtgaacacaaggcgtaaggttgattggctaaccgacaaaatgagaagccgtgaccacactgtctcagccacacacggagacatggaccagaacacaagagacatcatcatgcgggaattccgctctggatcttcccgtgtcctcataaccactgaccttcttgctcgtggtatcgatgttcagcaagtctctcttgtcataaactttgacctcccaacccaaccggagaattaccttcaccgtattggaagaagtggaaggtttggaagaaagggagtggcaatcaatttcatgacaacggaggatgagagaatgttggctgatattcagaggttttacaatgtggtcgttgaggagttgccaagcaatgttgctgatcttctctga

SEQ ID NO: 4905 - DNA, 1667 bp, Arabidopsis thaliana
aagcaaagtaaaacctaaaaaaaaaaaaagaccgtaagtagttacaagggtggaagtataaaggagcagtcttttcttcttctttcaaccccacggcgcagatcctacgagtttggtctttgtctctatcttttcaatctttctctctcaatcgctcttcaatttgataacagcaaagtcatggcaggaatggcatctgatggaactcaatatgatcctcgtcagtttgatactaagatgaatgccattctcggcgaggaaggagaggaaacattctacactaactatgacgaagtttgcgacagctttgatgcaatggaattgcaaccagatcttctcaggggtatttatgcttacggtttcgagaagccttctgctattcagcaaagaggaattattccattctgcaagggtcttgatgtgatccagcaagctcaatctggaactggaaagaccgctaccttttgctctggtgttttacagcagctcgatattagtttggttcaatgccaagctcttgttttggcacctacccgagaacttgcccagcaaattgaaaaggttatgagggcacttggtgactaccttggcgtcaaggctcaggcttgtgttggtggaacaagtgttcgtgaggatcaacgtgttcttcagtctggtgttcatgttgttgttggaacccctggtcgtgtctttgacttgttacgcagacaatccctccgtgctgatgcaatcaaaatgtttgttcttgatgaagctgatgaaatgctctctcgtggtttcaaggatcagatatacgacatcttccagcttcttccttccaaggttcaggttggtgttttctctgctacaatgcctcccgaagcccttgagatcacaaggaagttcatgaacaaaccagtcaggattctggtcaagcgagacgagctgactcttgaaggtatcaagcagttttatgtcaatgtagacaaggaagagtggaaactcgagacactatgcgatctctacgagacactggccatcactcaaagcgtcatctttgtgaacacaaggcgtaaggttgattggctaaccgacaaaatgagaagccgtgaccacactgtttcagctacacacggagacatggaccagaacacaagagacatcatcatgcgcgaattccgctctgggtcttcccgtgtcctcataaccactgacctccttgctcgtggtatcgatgttcagcaagtctctctggtcataaactttgacctcccaacccaaccggagaattaccttcatcgtattggaagaagtggaaggtttgggagaaagggagtagcaatcaatttcatgacatcggaggatgagagaatgatggctgatattcagaggttttacaatgtggtcgttgaggagttgccaagcaatgttgctgatcttctctgaagcctttcttttttctgttttttactgagaaagtgctgtgtttacccctttttttggcagcttctctatgctttgatttttgttttcaggctactacttagatttatagttcttggctaaaagcgaacataactcattacatgattttgcttttttggcaatcaagaatttcggcattatttatctttttgtgaacgtggcttacaaggaaggatactctatgagactaaagacttttctct

SEQ ID NO: 4906 - DNA, 1392 bp, Brassica napus
tctctctcctacacaactcaaacaagtcatggcaggatcagcaccagaaggtacacagtttgatactcgtcagtttgaccagaagctcaatgaagtcctcgagggacaagatgagttcttcacctcgtatgatgaggtccatgagagctttgatgccatgggtcttcaagagaaccttcttaggggcatctatgcctatggttttgaaaagccatctgctattcagcaaagaggaatcgtacccttttgcaacggtctcgacgtgatccagcaggcacagtctggtaccggcaaaaccgccactttctgctctggggtcttgcagcagctcgacttcacccttgtccagtgccaggctctcgtcttggctccaaccagggagcttgctcagcagattgagaaggtcatgcgcgctctaggagactatcttggcgtcaaggtccacgcctgtgtcggtggaaccagtgtccgtgaggatcagcgtatcctccaagccggtgtccacgtcgtggtgggaactccaggtcgtgtgttcgacatgctcagaagacagtctctccgcgctgactccatcaagatgtttgtcctcgacgaagccgacgagatgctctcacgcgggttcaaggaccagatctacgacatcttccagctcctcccaccgaagatccaagtcggtgtgttctcagccacaatgccgccggaggctctcgagatcacgaggaagtttatgagcaaaccggtgaggatcttggtgaagcgcgacgagctgactctcgaaggtatcaagcagttttacgtgaacgtggagaaggaagactggaagctggagactctctgtgacctctacgagacgttggccatcactcagagcgtcatcttcgtcaacactcgtcgcaaggtggactggctcacggataaaatgaggagccgtgaccatacggtgtcggcgactcacggagacatggaccagaacactagagacattatcatgagagagttcaggtctggctcttcgcgtgtgctgatcacgaccgatctcttggctcgtgggattgatgtgcagcaagtgtctttggttattaactttgatctgccgactcagcctgagaactaccttcaccgtattggtaggagtgggaggtttgggaggaaaggtgtggcgattgtgaccaaggacgatgagaggatgctttttgatattcagaagttttacaatgtggttgttgaggagcttccatcaaacgtagccgatctggaagaaaaggttacttggtttgcaagtttcgtatttgatttttgacccctctctctctctttctgaatcatctcgagaccagtttttcattttttttttctagtattcaaccaactctttcgaacatatgttgtttc

SEQ ID NO: 4907 - DNA, 1495 bp, Lolium multiflorum
caccagaaggctcccagttgatgctaagcactatgacaccaagatgacagagctgctgagccaaggcgacactgaggagtttttcacttcctacgatgaagtgcacgagagctttgatgacatgggcctccaagagaaccttctcagaggcatctatgcttatggttttgagaagccatcagccattcagcagagaggaatcgtccccttctgcaagggactcgatgtgatccagcaagctcagtctggaacaggaaagactgccaccttctgctctggaatcctgcagcagcttgactatggcttggtcgactgccaggctctggtccttgctcccacccgtgagctggcgcagcagatcgagaaggtcatgcgtgctcttggtgactacctaggtgtgaaggtgcacgcgtgtgttggtggaacatctgttcgtgaagaccagaggattcttgccagtggtgtgcacgttgttgtcggcacacctggtcgtgtgtttgacatgctgcgcaggcagtctctccgcccggatcacatcaagatgtttgtgctggatgaagctgatgagatgctttcacgtggtttcaaggatcagatctatgatatcttccagcttcttccaggaaagattcaggttggggtgttctctgctaccatgcctcctgaggcccttgagatcacccgcaagttcatgaacaagcctgtgaggattcttgttaagagagatgagcttacccttgagggtatcaagcagttctatgtcaatgttgagaaggaagagtggaagctggatactctctgtgacctgtacgagaccttggccattacccagagtgtcatctttgtgaacacccgccgcaaggtggactggctcactgacaagatgaggggaagggaccacacagtgtctgccacacacggagacatggaccagaacactagggacatcatcatgagggagttcaggtctgggtcttctcgtgtgctcatcaccaccgacctgctggctcgtggtattgatgtccagcaagtctccctcgtcatcaactatgacctgccgactcagcctgagaactacctccatcgcattggtcgtagtggtcggttcgggaggaagggagttgccatcaacttcgtcacacgcgaggatgagaggatgctgttcgacatccagaagttctacaacgtggtcattgaggagctccccggaaaatgttgctgaccttctctagattataatcttaggaattgcagtctggataagagtttattttgtttaatatctccaactctaattctggtagagtggtaaggtctgggtctatttgaattgtggttaaggacggtctttatttttcctatgcaatgttcggaaatttttgtagtgcgtaggctgtgctgtttcctgggctagctgggttagagtgacactacttgagtaatgagtacttttacttttcggtgtgaagctatgtgttcttgccaatctaatctt

SEQ ID NO: 4908 - DNA, 1905 bp, Physcomitrella patens
gaaagccctagtctgaatagacgcaaactctttttgagtttgctgctgctctgcgccgtcgtcgtgctcgtcgtcgcactctcttgctcctccgttcgcgctcccagatcgttgtgaagtgctatggctggttctgctcccgaaggttctcagttcgatgcccgccagtatgatgccaagatggagactgtcttggctggcgagggtgaggacttcatttccacatgggaggaggtccacgagacctttgatgtgatggatctacatgagaatcttttaaggggaatttacgcatatggttttgagaagccatctgctattcaacagcgtggtattgtaccctttaccaagggcctcgatgttattcagcaagcacaatcagggactggcaagactgctaccttctgctctggtattcttcaacaattggattatcaactccttgagtgtcaagcactggttttggcaccaactagggagcttgctcaacagattgagaaggttatgcgagctctaggtgattatctccaggtaaaggtacatgcgtgtgttggaggtaccagcgtaagggaggatcagagaattttgcaagctggagtccatgttgtggtgggtactcctggtcgtgtgtacgatatgttgcgtaggaacgcacttcgtgctgatgcaatcaagtgcttcgtgctggacgaagctgacgaaatgctctcgaggggattcaaggatcagatttatgacattttccagcttcttccccagaagcttcaagttggtgtgttctctgccaccatgccacccgaagctcttgaaatcaccagaaaattcatgaacaagcctgtgaagatcttggtaaagagagatgagctgacccttgagggtatcaagcagttttacgtgaatgtagacagagaggagtggaaattggatacattgtgtgatctatacgaaactttggccattacacagagtgtcatattcatcaacactcgccgaaaggtcgactggctcaccgacaagatgcgagctcgcgaccacaccgtgtctgcgacccatggagatatggaccagaacacccgtgatattatcatgcgtgagttccgctcaggctcatcccgagtgcttattaccaccgatctccttgctcgtggtatcgacgttcaacaagtgtctctggttatcaactacgacttgcctacccagcctgagaactaccttcaccgtatcggacgtagtgggcgtttcggacgtaagggtgtggcgatcaactttgtaacaagagatgacgatcgcatgctccaagatattcagaggttctacaacactgtgatcgaggagctgccttccaatgttgcagatcttttgtgagttgttgatattgttttctgtagcaccaggaagaaggggtacttcgtagatatgccggtgccctttccagtgctggtcgcggaagtagtattgcgtaaaggccagattgacggatcgaatgattgtttaggaggagattctttagaaggatcaggccttaacacgagtctgcgctggttggaagtgccttgatcggatttggaggactggaatttatggggcagttaacgaaggaagtatttgttactatctagaagacttgttgtggccaatcgtatttattgggaggcttgtttctttctggagattgatgttgtcgatctgcatttgtgtgatcttatgtcttagccttgcgctcggtgatttctcgcacaactctcataatcgcgtgtttcttcaaccagtacccaatcgatttgtataactccggcttctgatagtccagaagatggacgtagaatatcaacagtttgaagcgctctgggaagatggaacatcatgctaaagaaataaaagtttcaatcactccgttgtatttgt

SEQ ID NO: 4909 - DNA, 1670 bp, Physcomitrella patens
acttgaggcgacgagaagcgtcagctcttcctcttggctgcaatccccgacagcgccgtcacgctcgtttcctttgacgctctctcttccacttcctccgcaattgcccgcagcgaagtagtatggctggatctgcacccgaagggtctcagttcgatgctcgccaatatgacgccaagatggagaatatcttgagcggcgagggagatgatttcatttctacttgggaagaggtccacgagacgtttgacgtcatgggtcttcacgagaaccttctcaggggtatatacgcctacggtttcgagaagccgtccgccatccagcagcgtggaattgtccctttcacaaagggtctggatgttatccaacaagcccagtccggcacaggcaagaccgcgacattttgctctggtatcttgcagcagttggactaccagcttttggagtgccaagctttggtgctggcacccacccgcgagttggcacagcagatcgaaaaggtgatgcgcgcccttggcgactacctgcaggtgaaggtacacgcgtgcgtgggagggaccagtgtgagagaggaccagaggattttgcaggccggtgttcacgttgtggtcggtacacctgggcgtgtgtacgacatgttgcgcaggaacgcactgcgcgcggactccatcaagtgctttgtgctggatgaggccgatgagatgctttctcgggggtttaaggatcagatttacgacatctttcagctgctgccccagaagcttcaagtgggtgttttctctgctaccatgcctcctgaagccctcgagatcacaaggaagttcatgaacaagccggtgaagatcttggtgaagagagacgaattgactctggagggcatcaagcagttctacgtgaatgtagaccgcgaggagtggaagttggacaccctgtgcgacctgtacgaaactttggcgatcacccagagtgtgatcttcatcaacacccgccggaaggtggactggttgactgacaagatgcgcgctcgtgatcacaccgtgtcggctactcacggagacatggaccagaacacccgggatatcatcatgcgtgagttccgctcaggatcttcccgggtgttgatcacaacggacctgttggcgcgtggcattgatgtgcagcaggtgtctttggtgataaactacgacctgccaacccagccggagaattaccttcaccgtatcggtcgcagtgggcgattcgggcgtaagggagtggccatcaattttgtgacgaaggaggatgagcgcatgctccaggatattcagaggttctacaacactgtgattgaggagcttccatctaatgttgcggatcttctgtaagtcgcggaaagttcttcggaagcacgagggccggaagcagcatttcctcaaggtctgcttgaggaaggatcctgtgtaaagttttggagcgactactttgttagaatccacctcgttctcacctgtcggttctgcccatttgcgttttgttctatggtacattatgcatgctagtctgaagagaggaaagagtaggaaatccagcctcgagaggctttgagttgcagatttagggcagagaggtatgtgggtcgcaaatgaggccaaattccttataattagaatatatggagaatttccgagcga

SEQ ID NO: 4910 - DNA, 1895 bp, Physcomitrella patens
cctactgggaaaagccctagtctgaatagacgcaaactctttttgagtttgctgctgctctgcgccgtcgtcgtgctcgtcgtcgcactctcttgctcctccgttcgcgctcccagatcgttgtgaagtgctatggctggttctgctcccgaaggttctcagttcgatgcccgccagtatgatgccaagatggagactgtcttggctggcgagggtgaggacttcatttccacatgggaggaggtccacgagacctttgatgtgatggatctacatgagaatcttttaaggggaatttacgcatatggttttgagaagccatctgctattcaacagcgtggtattgtaccctttaccaagggcctcgatgttattcagcaagcacaatcagggactggcaagactgctaccttctgctctggtattcttcaacaattggattatcaactccttgagtgtcaagcactggttttggcaccaactagggagcttgctcaacagattgagaaggttatgcgagctctaggtgattatctccaggtaaaggtacatgcgtgtgttggaggtaccagcgtaagggaggatcagagaattttgcaagctggagtccatgttgtggtgggtactcctggtcgtgtgtacgatatgttgcgtaggaacgcacttcgtgctgatgcaatcaagtgcttcgtgctggacgaagctgacgaaatgctctcgaggggattcaaggatcagatttatgacattttccagcttcttccccagaagcttcaagttggtgtgttctctgccaccatgccacccgaagctcttgaaatcaccagaaaattcatgaacaagcctgtgaagatcttggtaaagagagatgagctgacccttgagggtatcaagcagttttacgtgaatgtagacagagaggagtggaaattggatacattgtgtgatctatacgaaactttggccattacacagagtgtcatattcatcaacactcgccgaaaggtcgactggctcaccgacaagatgcgagctcgcgaccacaccgtgtctgcgacccatggagatatggaccagaacacccgtgatattatcatgcgtgagttccgctcaggctcatcccgagtgcttattaccaccgatctccttgctcgtggtatcgacgttcaacaagtgtctctggttatcaactacgacttgcctacccagcctgagaactaccttcaccgtatcggacgtagtgggcgtttcggacgtaagggtgtggcgatcaactttgtaacaagagatgacgatcgcatgctccaagatattcagaggttctacaacactgtgatcgaggagctgccttccaatgttgcagatcttttgtgagttgttgatattgttttctgtagcaccaggaagaaggggtacttcgtagatatgccggtgccctttccagtgctggtcgcggaagtagtattgcgtaaaggccagattgacggatcgaatgattgtttaggaggagattctttagaaggatcaggccttaacacgagtctgcgctggttggaagtgccttgatcggatttggaggactggaatttatggggcagttaacgaaggaagtatttgttactatctagaagacttgttgtggccaatcgtatttattgggaggcttgtttctttctggagattgatgttgtcgatctgcatttgtgtgatcttatgtcttagccttgcgctcggtgatttctcgcacaactctcataatcgcgtgtttcttcaaccagtacccaatcgatttgtataactccggcttctgatagtccagaagatggacgtagaatatcaacagtttgaagcgctctgggaagatggaacatcatgctaaagaaataaaagttcaa

SEQ ID NO: 4911 - DNA, 1919 bp, Physcomitrella patens
acttgaggcgacgagaagcgtcagctcttcctcttggctgcaatccccgacagcgccgtcacgctcgtttcctttgacgctctctcttccacttcctccgcaattgcccgcagcgaagtagtatggctggatctgcacccgaagggtctcagttcgatgctcgccaatatgacgccaagatggagaatatcttgagcggcgagggagatgatttcatttctacttgggaagaggtccacgagacgtttgacgtcatgggtcttcacgagaaccttctcaggggtatatacgcctacggtttcgagaagccgtccgccatccagcagcgtggaattgtccctttcacaaagggtctggatgttatccaacaagcccagtccggcacaggcaagaccgcgacattttgctctggtatcttgcagcagttggactaccagcttttggagtgccaagctttggtgctggcacccacccgcgagttggcacagcagatcgaaaaggtgatgcgcgcccttggcgactacctgcaggtgaaggtacacgcgtgcgtgggagggaccagtgtgagagaggaccagaggattttgcaggccggtgttcacgttgtggtcggtacacctgggcgtgtgtacgacatgttgcgcaggaacgcactgcgcgcggactccatcaagtgctttgtgctggatgaggccgatgagatgctttctcgggggtttaaggatcagatttacgacatctttcagctgctgccccagaagcttcaagtgggtgttttctctgctaccatgcctcctgaagccctcgagatcacaaggaagttcatgaacaagccggtgaagatcttggtgaagagagacgaattgactctggagggcatcaagcagttctacgtgaatgtagaccgcgaggagtggaagttggacaccctgtgcgacctgtacgaaactttggcgatcacccagagtgtgatcttcatcaacacccgccggaaggtggactggttgactgacaagatgcgcgctcgtgatcacaccgtgtcggctactcacggagacatggaccagaacacccgggatatcatcatgcgtgagttccgctcaggatcttcccgggtgttgatcacaacggacctgttggcgcgtggcattgatgtgcagcaggtgtctttggtgataaactacgacctgccaacccagccggagaattaccttcaccgtatcggtcgcagtgggcgattcgggcgtaagggagtggccatcaattttgtgacgaaggaggatgagcgcatgctccaggatattcagaggttctacaacactgtgattgaggagcttccatctaatgttgcggatcttctgtaagtcgcggaaagttcttcggaagcacgagggccggaagcagcatttcctcaaggtctgcttgaggaaggatcctgtgtaaagttttggagcgactactttgttagaatccacctcgttctcacctgtcggttctgcccatttgcgttttgttctatggtacattatgcatgctagtctgaagagaggaaagagtaggaaatccagcctcgagaggctttgagttgcagatttagggcagagaggtatgtgggtcgcaaatgaggccaaattccttataattagaatatatggagaatttccgagcgaattttgcgtctgattgtaatttcttttatgggagccacataatcagccacttgctgccgttattagtgtgctcaacgttgtgagttgtgtggattccctttgctttgccacggagaggtattcggtgtactgccgggggtagagttggtaatgatacggctgtgtctgatggtgtcttgctgctgacgcggtgttatcgtagtggccgttctgccaagccccacaaagcaaaattgtcccgaattcgtc

SEQ ID NO: 4912 - DNA, 1283 bp, Centaurea maculosa
  misc_feature (171)..(171): n is a, c, g, or t
  misc_feature (382)..(382): n is a, c, g, or t
  misc_feature (385)..(385): n is a, c, g, or t
  misc_feature (400)..(400): n is a, c, g, or t
  misc_feature (429)..(429): n is a, c, g, or t
  misc_feature (439)..(439): n is a, c, g, or t
  misc_feature (472)..(472): n is a, c, g, or t
  misc_feature (475)..(475): n is a, c, g, or t
aacatcccttcctcaactccacggcgtcgatccgaggagtttgagaaaaccctaattttatcaacaactccttcttactcttttctctcaaatcgctttaacacaatcagccatggcaggcgtagcaccagaaggatctcaattcgatgctcggcaatttgactccaaaangagcgagctgctctcagctgatggacaagacttctttacatcctatgatgaggtctacgaaagtttcgatgccatgggtctacaagagaatcttttgaggggcatatacgcatatggttttgagaaaccatcagcaattcagcagaggggaattgttcccttcaccaagggtctcgatgttattcaacaagcgcaatctggaaccggaaanacngccactttttgctcnggtatccttcaacagcttgattacaacgnggttgaatgncaggctttggttttggcacctactcgtgagctngcncagcagatcgagaaggtcatgcgggcccttggtgactaccttggtgtaaaggtccatgcttgtgttggtggaaccagtgttcgtgaggaccagcgcatcctctccgctggggtccacgtggtggttggtactcctggccgtgtgtttgacatgcttcgcaggcagtcccttcgtgctgattacatcaagatgtttgtgttggatgaagctgacgaaatgctttcaagaggttttaaggatcagatctacgacatcttccagttgttgccgtcaaaggttcaggtcggagttttctccgcaaccatgccccccgaggccctcgagataacccgaaagttcatgaacaaacccgtgaggattcttgtgaagcgtgacgagctcaccttagaaggtatcaagcagttctacgtcaacgtcgagaaagaggaatggaaactcgagaccctttgcgacctttacgagaccctggcgatcacccagagcgtcatcttcgtgaacacacgaaggaaggtcgactggctaaccgacaagatgaggagccgtgaccacaccgtctcgaccacccacggagacatggaccagaacacccgagacatcatcatgcgggaattccgttccggttcttcccgggtcctcatcaccaccgatcttttggctcgtgggattgatgtgcaacaagtatcgctcgttataaactacgatttgccgacacagccggagaactacctccacaggattggacgaagtggtcggttcgggagaaagggtgtggcgatcaatttcgtgacgttggatgacgagaagatgc

SEQ ID NO: 4913 - DNA, 2344 bp, Physcomitrella patens
gcgcagtggtgccgtgcctctttctttcaaggctgccattctcgtttgacagcgccgtttcgatcgtgcactctttgtcgacgtctcccccgatttccctccgctactattcattgcacaccaaaatggctggatctgcaccagaaggatctcagttcgatgcccgccagtatgacgcgaagatggagaccatcttgggcggcgagggagaggacttcatttccacatgggaggaggtccacgagacgttcgacgtgatgggtcttcacgagaaccttctgaggggcatttatgcgtacggtttcgagaagccgtcggccatccagcagcgcggaatcgtgccgttcacgaaggggttggacgtgatccagcaagcccagtccggtacgggtaagaccgcgacgttttgctcaggcatcctgcagcagttggactaccagcttttggagtgccaagccttggtgttggcacccacccgtgagctggcccagcagatcgagaaggtgatgcgcgcactgggcgactaccttcaggtgaaggtgcacgcgtgcgtgggaggaaccagtgtgagggaggaccagaggattttgcaggcgggtgtgcacgtggtggtgggaacacccgggcgtgtgtacgacatgttgcgcaggaatgcgctgcgcgcggattccatcaagtgcttcgtgctggacgaggccgatgagatgctttctcggggtttcaaggaccagatttacgacatcttccagctgctgccccagaagcttcaagtgggcgtgttctccgccaccatgcccccggaagccctcgagatcacgaggaagttcatgaacaagccggtgaagatcctggtgaagagggacgagttgacgctggagggtatcaagcagttctacgtgaacgtggaccgcgaggagtggaagttggacaccctgtgcgacctgtacgagacattggcgatcacccagagcgtgatcttcatcaacacccggcggaaggtggactggttgacggacaagatgcgcgcccgtgaccacaccgtgtcggccactcacggagacatggatcagaacacccgggacatcatcatgcgagagttccgttcggggtcttcccgagttttgatcacaacggacctgttggcgcggggtatcgacgtgcagcaggtgtctttggtgatcaactacgacctgccaactcagccggagaactaccttcaccgtatcggtcgcagtgggcggttcgggcgcaagggagtagcgataaactttgtgacgaaggaggacgagcgcatgctccaggacatccagaggttctacaacaccgtggttgaggagctcccgtcgaatgtcgcggatcttctgtaggtcggggatagttctgcagcagcacaaggatcgggagcagtattttctcaaggtctgcttaaggatcctgtgtaaagttttggaacggctcctttgttagaatccacgtcgttgtcgcctgtcggttctgcccatatgcgtttgtactgcggtggtgcattacgcttgctagtctgaagagaaggaacagtgggagatgcggcctcgagaggccttgagttgcagatttaggggcagaggcatgtgggtcccaaatgaggccaaattcctggtaattagaatatatggagtatttttgagcgaattttgtttctgattgtaatttcttttacgagagccacgtgattcagccacttgctgtcggtgttactgtgggggtgggtcgattgccctcgccttggccacagggaggctttgcgtgttgtactgccgggaatgcagacggtggtggtgcgaggaagaccgtattgtgctgtgcatctgtgcaaacgttgtgggctacgggtccgggactgatgcagggtcatcgatacgacgtcttgttgtttttgttgcagtgggtgtatggagtgtgttggtcagtcggagcacttccattatctcgggctatggcaccggtcgtcgatggttgtcgatgttggtgcgaggaaggacgagcagtgattggtcactttggagggtcctctctgggtcgtttgaggcgtggttgctcgagttgtcgcaaggttgcgagcatgcggagccaggtagtgcaggagtcagagctgacggggaatgagggactgcaaggtcgtttgtgtaccgctggggacctagaagcatggagaagtcattggatgcgtacaagtcgcagtgcaagtcgcaccaccatatcgttttcctcgcactcttggggtggcgtaggggtacaggggggcacacattaccatactcgtaatgcaatatttcttagacggaaaaactgttttgatgattga

SEQ ID NO: 4914 - DNA, 1931 bp, Eragrostis curvula
  misc_feature (6)..(7): n is a, c, g, or t
  misc_feature (11)..(11): n is a, c, g, or t
  misc_feature (1050)..(1050): n is a, c, g, or t
  misc_feature (1053)..(1054): n is a, c, g, or t
  misc_feature (1056)..(1056): n is a, c, g, or t
  misc_feature (1068)..(1068): n is a, c, g, or t
  misc_feature (1080)..(1080): n is a, c, g, or t
  misc_feature (1092)..(1092): n is a, c, g, or t
  misc_feature (1164)..(1164): n is a, c, g, or t
  misc_feature (1181)..(1181): n is a, c, g, or t
  misc_feature (1193)..(1193): n is a, c, g, or t
  misc_feature (1247)..(1247): n is a, c, g, or t
  misc_feature (1259)..(1259): n is a, c, g, or t
  misc_feature (1265)..(1265): n is a, c, g, or t
  misc_feature (1274)..(1274): n is a, c, g, or t
  misc_feature (1281)..(1282): n is a, c, g, or t
  misc_feature (1284)..(1284): n is a, c, g, or t
  misc_feature (1299)..(1299): n is a, c, g, or t
  misc_feature (1319)..(1320): n is a, c, g, or t
  misc_feature (1322)..(1323): n is a, c, g, or t
  misc_feature (1330)..(1330): n is a, c, g, or t
  misc_feature (1344)..(1344): n is a, c, g, or t
  misc_feature (1347)..(1347): n is a, c, g, or t
  misc_feature (1353)..(1353): n is a, c, g, or t
  misc_feature (1357)..(1357): n is a, c, g, or t
  misc_feature (1360)..(1360): n is a, c, g, or t
  misc_feature (1378)..(1378): n is a, c, g, or t
  misc_feature (1380)..(1380): n is a, c, g, or t
  misc_feature (1382)..(1382): n is a, c, g, or t
  misc_feature (1385)..(1385): n is a, c, g, or t
gggggnntttnctctctgcgctgcgcgtcgttcgtctccgccgacgaatccgagacttcgatctcgggtttaccgcagcgcaccaagcctccaaccaacagttcgatcctctctcctctccgcgcatcagtcatggcgggaatggcaccagagggcactcagtttgatgccaagcactacgactccaaattgcaggagctgctgagctctggtgagactgaggagttcttcactccatatgatgaagtttttgaaagttttgatgacatgggcctccaagagaatctgctgagaggcatttatgcttatggttttgagaagccttctgctattcagcagagaggaattgttcccttcaccaaggggcttgatgtcatccagcaggcacaatcaggaacaggaaagactgcaactttctgttccgggatcttgcagcagctcgactatggtttggttgagtgccaggccttggtccttgccccaacccgtgagcttgcccagcaaattgagaaagtcatgcgtgcccttggtgattaccttggtgtgaaagttcatgcatgtgtgggaggaacctctgtccgtgaggaccaaaggattcttgcaagtggtgttcatgttgttgttggcacacctggtcgtgtgtttgacatgctccgccggcagtctctccgccctgatcacatcaagatgtttgtcctggatgaagctgatgagatgctttctcgtggtttcaaggatcagatttatgacatcttccagctcctcccagcaaaaattcaggttggagttttctctgccaccatgcctccggaggcccttgagattacccgcaagttcatgaacaaacctgtgagaatccttgtgaagagggatgagcttacccttgagggtatcaagcagttctatgtgaatgttgagaaggaagactggaagctggacaccctctgtgacctgtatgagaccctggctatcactcagagcgtcatctttgtcaacacccgccgcaaggtggactggcttactgacaagatgaggagcagggaccacacngtnncngctactcacggngatatggaccanaacactaggganatcatcatgagggagttcaggtctggttcatcccgtgtgctcatcaccactgacctccttgctcgtggtatngatgtgcagcaggtgtncctggtcatcanctatgaccttccgacacagccagagaactacctccatcgcattggtcgtagtgntcgttttggtangaaggntgttgccancaacttnntnacccgtgacgatganagaatgctttttgacatccnnannttctacnatgtggttattgangancttccngccnacnttgctgaccttctgtgancnanttnaaaaaaagaaaacctaaaaaaatggacaagggcaactgataaagctatgtttttgtttaaataatcaccaattttccccaccgggggaaggattggtaaaggttgggggatctttggtaaagctctggaccgggcaaattattcaaatttttcggaaggccatgatcatgagaaactatataaaaattccacagcccgatataatgttttatcgttttattttatacactttaaatagccaaaattcgtacgactgtaatattctctttttatcgttttctttttcttatgatataatcatatgtgagtccacatctttttcctacttcttcatttaattgcttcatttactactatataatataataaaataacaattaaaaaaaccaatacaataattgataaatactctctatatcatctatactcaaaatttatcttattcacttacaaaatcgataaaattacactaggtttctttaacataataaattataaataatccacaacattaaaattatctgtctagacgtattatataatata

SEQ ID NO: 4915 - DNA, 1807 bp, Physcomitrella patens
aggggttgggacttgagaggccgggtgggggctggcaggcacgcagcagcagcactcgcaccagtcaggagggcctgatatagcgacgcccagcgatgcagcagagttctttcgtgacctccgccgtcacgccccgcttcggctctcgcccgcgtcgttgcaagctcaagctcgcgctcctcctgctcctctcgcccgccctcgcttcttcgactctcgcaccgcaagcattccagcatggcaggttctgcgccagaaggatcccagttcgacgcgcgccagtatgacgcgaagatggagaccatcttgggcggcgagggagaggacttcatttccacatgggaggaggtccacgagacgttcgacgtgatgggtcttcacgagaaccttctgaggggcatttatgcgtacggtttcgagaagccgtcggccatccagcagcgcggaatcgtgccgttcacgaaggggttggacgtgatccagcaagcccagtccggtacgggtaagaccgcgacgttttgctcaggcatcctgcagcagttggactaccagcttttggagtgccaagccttggtgttggcacccacccgtgagctggcccagcagatcgagaaggtgatgcgcgcactgggcgactaccttcaggtgaaggtgcacgcgtgcgtgggaggaaccagtgtgagggaggaccagaggattttgcaggcgggtgtgcacgtggtggtgggaacacccgggcgtgtgtacgacatgttgcgcaggaatgcgctgcgcgcggattccatcaagtgcttcgtgctggacgaggccgatgagatgctttctcggggtttcaaggaccagatttacgacatcttccagctgctgccccagaagcttcaagtgggcgtgttctccgccaccatgcccccggaagccctcgagatcacgaggaagttcatgaacaagccggtgaagatcctggtgaagagggacgagttgacgctggagggtatcaagcagttctacgtgaacgtggaccgcgaggagtggaagttggacaccctgtgcgacctgtacgagacattggcgatcacccagagcgtgatcttcatcaacacccggcggaaggtggactggttgacggacaagatgcgcgcccgtgaccacaccgtgtcggccactcacggagacatggatcagaacacccgggacatcatcatgcgagagttccgttcggggtcttcccgagttttgatcacaacggacctgttggcgcggggtatcgacgtgcagcaggtgtctttggtgatcaactacgacctgccaactcagccggagaactaccttcaccgtatcggtcgcagtgggcggttcgggcgcaagggagtagcgataaactttgtgacgaaggaggacgagcgcatgctccaggacatccagaggttctacaacaccgtggttgaggagctcccgtcgaatgtcgcggatcttctgtaggtcggggatagttctgcagcagcacaaggatcgggagcagtattttctcaaggtctgcttaaggatcctgtgtaaagttttggaacggctcctttgttagaatccacgtcgttgtcgcctgtcggttctgcccatatgcgtttgtactgcggtggtgcattacgcttgctagtctgaagagaaggaacagtgggagatgcggcctcgagaggccttgagttgcagatttaggggcagaggcatgtgggtcccaaatgaggccaaattcctggtaattagaatatatggagtatttttgagcgaattttgtttctgattgtaattcttt

SEQ ID NO: 4916 - DNA, 1270 bp, Solanum lycopersicum
tctttctagtcatggcgggtgcagctcctgatggatcccaatttgatgctcgtcaatttgattcaaaaatgacagagttgctaaatgctgaagggcaagagttttttacctcatatgacgaggcttatgatacttttgatgctatggaattgaaggaggatctcctgaaaggcatttatgcatacggttttgagaaaccctcagcaatccagcaaaggggaattgtacctttttgcaaaggtcttgatgtgattcagcagtctcagtctggaacgggaaagactgctactttttgttctggagttctgcaacaactggactatgaactgttaggttgtcaagcattggtcttggcacctactcgtgagcttgcacaacaaattgagaaggtcatggaagcacttggacagtgtcttaaagtcaaggttcatgcgtgtgtgggaggtaccagtgtccgtgaggatcaaaggatcctttcaattggggttcatgttgttgtgggaacacctggacgtgtgtttgacatgttgagaagacagtctctccgcgctgatcacattaaaatgtttgtattggatgaagctgatgaaatgctctccagagggttcaaggatcagatctatgatattttccagctattgcctcctaagattcaggttggtgttttctctgccacaatgcctcctgaggcccttgagatcacaaggaagttcatgaacaaacctgtgaggattcttgtgaaacgtgatgaactgaccttagaaggtatcaaacagttttatgtgaatgtggaaaaggaagaatggaagtttgacaccctttgcgatctatatgaaaccttagccatcacacagagtgttatttttgtgaatactcgtcgcaaagttgacttgttaacagagcagatgcaaagcaaagaccatacagtctcagctacccacggtgacatggaccacaaaactagggatgttataatgcatgaattccgaagtggttcctctcgtgttctcatcaccactgatcttttagccagaggaattgatgtccaacaagtctccctcgtcataaactatgatctccccactcaacctgaaaattaccttcatcgtattggacgtagtggacggtttggtaggaagggtgttgcaatcaattttgtaaccatggatgatgagagaatgctttctgacattcaaagtttttacaacatggtgattgaggagcttccagcaaatgtcgctgatctcctataagcttcctgctacaagaa

SEQ ID NO: 4917 - DNA, 1223 bp, Ricinus communis
tcatggcaggtttggcactagaaggatcacaatttgacgccaggcagctctcaaatgacgcacaagaattcttcacctcaagtgatgaggtgtatgacagttttgatgcaatgggattgcaagagaaccttctgaggggcatctatgcttatggttttgagaagccttctgcaatccagcaaagaggaattgttccattctgcaagggtcttgatgtaattcagcaggcgcagtcaggaactggaaaaacagcaactttctgctctggcgttctccaacaacttgattatggtctagtccaatgtcaggcattggtcttggctccgactagagaattggcgcagcagattgacatggttctgcgggcccttggtgattatctagatgttaaggtccatgcttgtgtaggtggcacaagtgttcgcgaggatcaacggattcttcgagctggcgttcatgttgttgtgggaactcctggtcgtgtgtttgacatgctgagaaggcagtcacttcccgcagattacatcaagatgttcgtattggatgaggctgatgaaatgctttcacgtggtttcaaggatcagatctacgacattttccagtttctgccagcaaaagttcaggttggtgtgttctctgccaccatgccaccagaagctctggatatcacaaggaagttcatgaacaagcctgtcaggatcttggtcaagcgtgacgagcttacccttgagggtataaagcagtattatgtccacgttgacaaggacgaatggaaacttgaaacactctgcgatctctacgagacactacccatcgctcagagtgtcatttttgtcaacacgaggcgcaaggttgattggctcactgacaaaatgcgaagccgtgatcacacagtctcagcaacacatggggatatggatcagaacgctagcgatgttattatgagggaatttcgttccggttcttctcgtgttctcatcgccactgatctcttggctcgtggcattgatgtgcagcaagtctctcttgtcataaactatgatctgacgactcaacctgagaactatcttcatcgcattggtagaggtggcaggttcggaagaaaaggcgttgccatcaattttgtgactaaggaagatgatagaatgctgtttgagattcagaagttctataatatggtcatccaggagctgccagcaaacgttgctgatctccagttatga

SEQ ID NO: 4918 - DNA, 1221 bp, Ricinus communis
atggcaggtttggcactagaaggatcacaatttgacgccaggcagctctcaaatgacgcacaagaattcttcacctcaagtgatgaggtgtatgacagttttgatgcaatgggattgcaagagaaccttctgaggggcatctatgcttatggttttgagaagccttctgcaatccagcaaagaggaattgttccattctgcaagggtcttgatgtaattcagcaggcgcagtcaggaactggaaaaacagcaactttctgctctggcgttctccaacaacttgattatggtctagtccaatgtcaggcattggtcttggctccgactagagaattggcgcagcagattgacatggttctgcgggcccttggtgattatctagatgttaaggtccatgcttgtgtaggtggcacaagtgttcgcgaggatcaacggattcttcgagctggcgttcatgttgttgtgggaactcctggtcgtgtgtttgacatgctgagaaggcagtcacttcccgcagattacatcaagatgttcgtattggatgaggctgatgaaatgctttcacgtggtttcaaggatcagatctacgacattttccagtttctgccagcaaaagttcaggttggtgtgttctctgccaccatgccaccagaagctctggatatcacaaggaagttcatgaacaagcctgtcaggatcttggtcaagcgtgacgagcttacccttgagggtataaagcagtattatgtccacgttgacaaggacgaatggaaacttgaaacactctgcgatctctacgagacactacccatcgctcagagtgtcatttttgtcaacacgaggcgcaaggttgattggctcactgacaaaatgcgaagccgtgatcacacagtctcagcaacacatggggatatggatcagaacgctagcgatgttattatgagggaatttcgttccggttcttctcgtgttctcatcgccactgatctcttggctcgtggcattgatgtgcagcaagtctctcttgtcataaactatgatctgacgactcaacctgagaactatcttcatcgcattggtagaggtggcaggttcggaagaaaaggcgttgccatcaattttgtgactaaggaagatgatagaatgctgtttgagattcagaagttctataatatggtcatccaggagctgccagcaaacgttgctgatctccagttatga

SEQ ID NO: 4919 - DNA, 1482 bp, Brassica napus
ggatatctattatctcttaacctcaattctcttaagaagatcttttacttttgctcttaatcaacctcaaagtcatggcaggatcggcaacacagtttgatgatgcgcgtcagtttgatcaggcactcagtgaaatcctggagggacacgatgagttcttcacctcctatgatgaggtttatgagagttttgatggcatgggtttgcaagagaaccttcttaggggtatctatgcttatggttttgaaaagccttctgctattcagcaaagaggaatcgtacccttttgcaagggtcttgatgtgatccagcaggcacagtctggtactggaaaaaccgcaactttctgttctggtgtcttgcagcagcttgacgtcacccttgtccagtgccaagctctggtcttggctcccaccagggagcttgctcagcagattgagaaggtcatgcgtgctctcggagactacattggcgtcaaggttcatgcctgtgttggtggtaccagtgttcttgacgataagcgtatcctccaagctggtgtccatgttgttgttggaactccaggtcgtgtctttgacatgctccaaagacagtcacttcgctctgactgtataaagatgtttgtccttgatgaagctgatgaaatgctctcccgtggtttcaaggatcagatctatgacatattccagcttctcccaccaaagattcaagtaggagtgttctcagctacaatgccaccagaagctctcgagatcacaaggaagttcatgagcaaaccagtgagaatcttggtgaaacgtgacgagctaacacttgaaggtatcagacagttctacgtggacgtggacaaagaagagtggaaattcgaaactctctgtgacctctacgagacattagccatcactcagagtgtcattttcgtcaacactcgtcgcaaagttgactggctcacagaaaaaatgagaagccgtgaccacacagtctcagccactcacggagatatggaccaaaacacgagagacatcatcatgagagagttcaggtctggttcttctcgtgttctcatcacaaccgatctcttggctcgtggtattgacgtgcagcaagtgtctctggtcatcaactttgaccttccaactcagccagcgaattaccttcaccgtatcggaagaagtggaaggtttgggaggaaaggtgcggcgattaactttgtgactcgtgatgatgagaaaatgcttgctgatatccagaagttttacaatatggttgttgaggagcttccatcaaacctagctgatctgctttgaacccttgtttcgctgatgaagaataaaaggttacttgttttgcaaggttcttgtttggttttctatccatctgtcttctcttaaagtatattttaccaactctttggaacatatgtctcgtctgactaaccttcatcttcatctcatgcaataatatttttagtttctgttgtaa

SEQ ID NO: 4920 - DNA, 1434 bp, Brassica rapa
tacttttgctcttaatcaacctcaaagtcatggcaggatcggcaacacagtttgatgatgcgcgtcagtttgatcaggcactcagtgaaatcctggaaggacaggatgagttcttcacctcctatgatgaggtttatgagagttttgatggcatgggtttgcaagagaaccttcttaggggtatctatgcttatggttttgaaaagccttctgctattcagcaaagaggaatcgtacccttttgcaagggtcttgatgtgatccagcaggcacagtctggtactggaaaaaccgcaactttctgttctggtgtcttgcagcagcttgacgtcacccttgtccagtgccaagctctggtcttggctcccaccagggagcttgctcagcagattgagaaggtcatgcgtgctctcggagactacattggcgtcaaggttcatgcctgtgttggtggtaccagtgttcttgacgataagcgtatcctccaagctggtgtccatgttgttgttggaactccaggtcgtgtctttgacatgctccaaagacagtcacttcgctctgactgtataaagatgtttgtccttgatgaagctgatgaaatgctctcccgtggtttcaaggatcagatctatgagatattccagcttctcccaccaaagattcaagtaggagtgttctcagctacaatgccaccagaagctctcgagatcacaaggaagttcatgagcaaaccagtgagaatcttggtgaaacgtgacgagctaacacttgaaggtatcagacagttctacgtggacgtggacaaagaagagtggaaattcgaaactctctgtgacctctacgagacattagccatcactcagagtgtcattttcgtcaacactcgtcgcaaagttgactggctcacagaaaaaatgagaagccgtgaccacacagtctcagccactcacggagatatggaccaaaacacgagagacatcatcatgagagagttcaggtctggttcttctcgtgttctcatcacaaccgatctcttggctcgtggtattgacgtgcagcaagtgtctctggtcatcaactttgaccttccaactcagccagcgaattaccttcaccgtatcggaagaagtggaaggtttgggaggaaaggtgcggcgattaactttgtgactcgtgatgatgagaaaatgcttgctgatatccagaagttttacaatatggttgttgaggagcttccatcaaacctagctgatctgctttgaacccttgtttcgctgatgaagaataaaaggttacttgttttgcaaggttcttgtttggttttctatccatctgtcttctcttaaagtatattttaccaactctttggaacatatgtctcgtctgactaatcttcatcttaatctcatgcaataatatttttagtttctgtta

SEQ ID NO: 4921 - DNA, 1920 bp, Selaginella moellendorffii
aggctgcaggtgatcaatgcttgcttctcgggagacacggtggaaggcattctacatgcattggaaagggagcggggcgacggcgacgatgagtggctggacaaggccacgagcaagctcaagggagcatctccgacgagcctcaagatcaccctggcatcgattcgtagaggcaggcaggagtccctcgccgagtgcctggcaagggagtaccgcatgagcttccgtgcggtgtcggcaaagtactcgggagacttttacgaggggtgccgggcgatcctgatagacaaggacaaccggccgcggtgggatcccagcaagctcgagggcgtgtcgcgcgaggtggtggagggctattttgcggcgctgggcgacggggaagggggggagctgcagctgccggttggcgagcggggcgcgggagctcggtctcgtgctcggatttgatgagaatgggacgccacgtaagactccccgcatgtataaaaaggaggcgtgggcatggctatgggggtttgccctatctttgtacttgggctctgctcaagtcaccaaattcgatcttcgcttccaggaggtattgcagataatggctggcttggcacccgagacctctcaattcgatccccggcagtatgaccagaagatggagtttgcgttggaaggagacgatgtgatatcgagctgggacgaggtgaacgagacattcgactccatgggcttgcacgagaatctgctgcgagggatctacgcctacggctttgaaaagccctctaccatccagcagaggggaatcgtgccgttttgcaaggggatcgacgtgatccagcaggcccagtccggcaccggcaagacggccacgttttgctccggcatcctgcagcagctcgactacaacaatgtcgagtgccaggcgctggtgctggcgcccaccagggagctggcgcagcagatcgagaaggtgatgcgggcactgggtgactacctgcaggtgaaggtgcacgcctgcgtcggcggcaccgacgtccgccaggaccagagaatcctgcaggccggcgtccatgtggtggtaggcactcctggtcgcgtctacgatatgctcaggcgtcgcgcgctgcggccggactacatcaagatgtttgtcctggacgaggcggacgagatgctgtcccgcggtttcaaggaccagatttacgacatcttccagctccttccctccaaggtccaggtgggcctcttctccgccacaatgccgcccgaggcgctggagatcacccgcaagttcatgaacaagccggtgcgcattctcgtcaagcgagacgagctgacgctggagggtatcaagcagttttacgtgaacgtggaacgagaggactggaaactggacacgctgtgcgacctgtacgagacgctggccatcacgcagagcgtcatcttttgcaacacccggcgcaaggtggactggctcaccgacaagatgaggagccgcgaccacaccgtgtctgcgacgcacggcgacatggaccagaacacccgcgacatcatcatgcgcgagttccggtcgggctcgtcccgcgtgctcatcaccaccgacttgctcgcgcgcggcatcgacgtccagcaggtgtcgctggtgatcaactacgaccttccgacgcagccggagaattatctgcatcgaattggtcgcagcggtcggtttgggcggaagggcgtggccatcaactttatggtgagagaggacgagaggatgcttcatgacatccagaagttttacaacactgtcattgaggagctgccaaacaacgtcgcggacctcatctaatgtgttatggttgtgagaggggggtttgtagcagcatgttttgaaccaagtgataagcttatataccacagtaattaaaagtctgcctttctaac

SEQ ID NO: 4922 - DNA, 1413 bp, Selaginella moellendorffii
ctatctttgtacttgggctctgctcaagtcaccaaattcgatcttcgcttccaggaggtattgcagataatggctggcttggcacccgagacctctcaattcgatccccggcagtatgaccagaagatggagtttgcgttggaaggagacgatgtgatatcgagctgggacgaggtgaacgagacattcgactccatgggcttgcacgagaatctgctgcgagggatctacgcctacggctttgaaaagccctctaccatccagcagaggggaatcgtgccgttttgcaaggggattgacgtgatccagcaggcccagtccggcaccggcaagacggccacgttttgctccggcatcctgcagcagctcgactacaacaatgtcgagtgccaggcgctggtgctggcgcccaccagggagctggcgcagcagatcgagaaggtgatgcgggcgctgggtgactacctgcaggtgaaggtgcacgcctgcgtcggcggcaccgacgtccgccaggaccagagaatcctgcaggccggcgtccatgtggtggtaggcactcctggtcgcgtctacgatatgctcaggcgtcgcgcgctgcggccggactacatcaagatgtttgtcctggacgaggcggacgagatgctgtcccgcggtttcaaggaccagatttacgacatcttccagctccttccctccaaggtccaggtgggcctcttctccgccacaatgccgcccgaggcgctggagatcacccgcaagttcatgaacaagccggtgcgcattctcgtcaagcgagacgagctgacgctggagggtatcaagcagttttacgtgaacgtggaacgagaggactggaaactggacacgctgtgcgacctgtacgagacgctggccatcacgcagagcgtcatcttttgcaacacccggcgcaaggtggactggctcaccgacaagatgaggagccgcgaccacaccgtgtctgcgacgcacggcgacatggaccagaacacccgcgacatcatcatgcgcgagttccggtcgggctcgtcccgcgtgctcatcaccaccgacttgctcgcgcgcggcatcgacgtccagcaggtgtcgctggtgatcaactacgaccttccgacgcagccggagaattatctgcatcgaattggtcgcagcggtcggtttgggcggaagggcgtggccatcaactttatggtgagagaggacgagaggatgcttcatgacatccagaagttttacaacactgtcattgaggagctgccaaataacgttgcggacctcatctaatgaccaacgccgtgttatggttgtgagaggggggtttgtagcagcatgttttgaaccaagtgataagcttatataccacagtaatttaaagtctgcctttctaacatc

SEQ ID NO: 4923 - DNA, 1304 bp, Gossypium hirsutum
  misc_feature (141)..(141): n is a, c, g, or t
  misc_feature (231)..(231): n is a, c, g, or t
  misc_feature (387)..(387): n is a, c, g, or t
  misc_feature (426)..(426): n is a, c, g, or t
gcggggacttaagatttgttgtattgttattttgccttttcgctatcgtctttgcctatcaactccacggcgcagatccgaggagtctctatttctcaatccaaacaaccgctctaaacactctcttcttttattgctccnactcttccagtcatggcaggtttggcaccagaaggatcccaatttgatgctcgtcaatatgatcagaaaatgagtgatttgctccaaacngatggagatgattttttcacttcttatgatgaagtttatgacagttttgatgcaatgggacttcaagagaaccttctgaggggcatctatgcatatggttttgagaagccctcagcgattcagcaaagaggaattgttccattctgcaagggtctngatgtgatacaacaggcacagtctgggaccggaaagacngcgactttttgctctggaattttgcagcaacttgattacggtatagtccaatgccaggctctggttttggcacccactagggagttggctcaacagatcgagaaggtgatgcgggcacttggtgattaccttggtgtgaaggtccacgcttgtgttggtgggactagtgttcgcgaggatcagcgaaatcttcaaagtggtgttcatgttgttgttggtacacctggtcgtgtcttcgatatgttgagaaggcaatcactccgtccagattatattaagatgtttgtcttggatgaggctgatgaaatgctctcccgtggttttaaggatcagatctatgacatcttccagcttcttccgggcaagattcaggttggggtattttctgctacaatgccacccgaagccctagagatcactcggaagttcatgaacaaacctgtgagaattttggttaagcgcgacgaactaaccctggagggtatcaagcagttttatgttaatgttgaaaaggaagagtggaagctggaaacactttgcgatctctatgaaacactggccattacccaaagtgtcattttcgtgaacacgaggcgcaaggttgactggctaactgacaagatgcgaagtcgagaccacacagtttctgccacccatggagatatggaccagaatacgcgtgatgtcatcatgcgggaattccgttctggttcttcccgtgttctcatcactaccgatctgttagcccgtggtattgacgtgcagaaagtctcccttgtcataaactatgatctgaccactcaaccagaaaactacctccaccgaatcggacgaagtggaaggttcgggagaaaaggtgttgccataaactttgtgac

SEQ ID NO: 4924 - DNA, 1332 bp, Catharanthus roseus
  misc_feature (84)..(84): n is a, c, g, or t
  misc_feature (96)..(97): n is a, c, g, or t
  misc_feature (110)..(110): n is a, c, g, or t
  misc_feature (138)..(138): n is a, c, g, or t
  misc_feature (268)..(268): n is a, c, g, or t
  misc_feature (422)..(422): n is a, c, g, or t
  misc_feature (470)..(470): n is a, c, g, or t
  misc_feature (482)..(482): n is a, c, g, or t
  misc_feature (501)..(501): n is a, c, g, or t
  misc_feature (568)..(568): n is a, c, g, or t
aagccccataaaaatactcactacagcagtcttcacccctctttcagtactactcttttcttcttcctgaactccgcggcgtanatccgaggagtnntggaaaaaatcancctcagaaaaccctacatcacatctttnacgaaacgatttagatcttcatctcttcactgctatcaggagtcatggctggacttgcacctgaaggttctcaatttgatgctcgtcaatttgatgccaaaatgactgagctactcaatactgatggacnggaattcttcacatcatatgatgaggtttatgacagttttgattccatgggattacaagaaaaccttcttaggggtatctatgcttatggttttgagaagccttctgctattcagcaaagaggaattgttcccttttgcaagggtctcgatgtnatccagcaagcacaatcaggaactggaaagacagccacattctgctcnggaattcttcancaacttgactataacttanttgaatgtcaagctttggttcttgcgcccaccagggaacttgcacagcaaattgagaaggtcatgcnagcacttggtgactatcttggtgtcaaggttcatgcttgtgttggtggaacaagtgtccgtgaggatcagcgaattctttccagtggagttcatgttgttgttggtacacctggtcgtgtgtttgacatgttaaggaggcagtctcttcgtcctgattacatcaagatgtttgttttggatgaagctgatgagatgctctcaagaggtttcaaagaccagatttacgatattttccagctccttcctccaaagatccaggttggcgtgttctcagccacgatgccacctgaggcccttgaaatcacaaggaagttcatgaacaagcctgttaggattctcgtgaagcgtgatgagctaacccttgagggtatcaagcagttctatgtcaatgttgaaaaggaagaatggaaacttgaaaccctctgtgatctttatgagacccttgccataacacagtctgtcatatttgttaacaccaggcgtaaggttgattggctgactgacaagatgcgaagccgtgaccatacagtctcagccacccatggagacatggatcaaaacacaagagacatcattatgcgggagttccgttctggctcttcgcgtgtgctcataacaactgatcttcttgcccgtggtattgatgttcaacaagtttcacttgttatcaactatgatctcccgactcagccagagaactacctgcatcgtattggtcgtagtggacggtttggtaggaagggtgttgcaatcaactttgtga

SEQ ID NO: 4925 - DNA, 1510 bp, Brassica napus
gggcccccgtagccagggttaatagctgatatgaatcgtatggacattaggccggggatattattatctcttaacctcaattctcttaagaagatcttttacttttgctcttaatcaacctcaaagtcatggcaggatcggcaacacagtttgatgatgcgcgtcagtttgatcaggcactcagtgaaatcctggagggacacgatgagttcttcacctcctatgatgaggtttatgagagttttgatggcatgggtttgcaagagaaccttcttaggggtatctatgcttatggttttgaaaagccttctgctattcagcaaagaggaatcgtacccttttgcaagggtcttgatgtgatccagcaggcacagtctggtactggaaaaaccgcaactttctgttctggtgtcttgcagcagcttgacgtcacccttgtccagtgccaagctctggtcttggctcccaccagggagcttgctcagcagattgagaaggtcatgcgtgctctcggagactacattggcgtcaaggttcatgcctgtgttggtggtaccagtgttcttgacgataagcgtatcctccaagctggtgtccatgttgttgttggaactccaggtcgtgtctttgacatgctccaaagacagtcacttcgctctgactgtataaagatgtttgtccttgatgaagctgatgaaatgctctcccgtggtttcaaggatcagatctatgacatattccagcttctcccaccaaagattcaagtaggagtgttctcagctacaatgccaccagaagctctcgagatcacaaggaagttcatgagcaaaccagtgagaatcttggtgaaacgtgacgagctaacacttgaaggtatcagacagttctacgtggacgtggacaaagaagagtggaaattcgaaactctctgtgacctctacgagacattagccatcactcagagtgtcattttcgtcaacactcgtcgcaaagttgactggctcacagaaaaaatgagaagccgtgaccacacagtctcagccactcacggagatatggaccaaaacacgagagacatcatcatgagagagttcaggtctggttcttctcgtgttctcatcacaaccgatctcttggctcgtggtattgacgtgcagcaagtgtctctggtcatcaactttgaccttccaactcagccagcgaattaccttcaccgtatcggaagaagtggaaggtttgggaggaaaggtgcggcgattgtgactcgtgatgatgagaaaatgcttgctgatatccagaagttttacaatatggttgttgaggagcttccatcaaacctagctgatctcccttgtttcgctgatgaagaataaaaggttacttgttttgcaaggttcttgtttggttttctatccatctgtcttctcttaaagtatattttaccaactctttggaacatatgtctcgtctgactaaccttcatcttcatctcatgcaataatatttttag

SEQ ID NO: 4926 - DNA, 1409 bp, Artemisia annua
aaaaaagtcatggcaggtgttgcagcagaaggatctcacttcgatactcgtcaatttgactccaaaatggatgagttgctttcagccgacggacaagacttctttacatcatatgacgaggttaccgaaacttttgacgccatgggtttgctagagaatcttctgagaggcatatatgcatatggttttgagaaaccatccgcaatccagcaaaggggaattgtacccttcaccaagggtcttgacgtcattcaacaagctcaatctggaacagggaagactgcaactttttgctctggcattcttcaacaacttgactacaacttggtggaatgccaagccttggttttggcacccactcgtgaacttgcccaacaaattgagaaagttatgcgtgcacttggtgactaccttggtgtaaaggttcatgcttgtgttggtggaaccagtgttcgtgaggaccagcgtatcctctcggctggtgttcatgctgttgttggtacacctggacgtgtgtttgacatgttgaggaggcagtcgttgcggtccgactatatcaagatgtttgtgctggatgaggctgatgagatgctttcaagaggattcaaggatcagatttacgacatctttcaattgctgccaccaaaggtacaagttggagtcttttctgcaacaatgcccccagaggcactggaaatcacaaggaagttcatgaataaacccgtgaggattcttgtgaagcgtgatgagctcacattggaaggtattaaacagttttatgtcaatgttgaaaaggaggactggaagcttgagacactctgtgatctgtacgaaacattggccatcactcagagtgtcatctttgtcaacacacgtcgtaaggttgactggttgaccgataagatgagaagcagagatcacaccgtgtcagcaacacatggagacatggaccagaacacaagagacatcatcatgcgtgagttccgttctggatcttcacgtgtactcatcaccacagatcttttggctcgtggtattgacgtgcagcaagtttctctagtcatcaactatgatcttcctactcagcccgagaactaccttcaccgtattggacgaagtggtcggtttggaagaaagggtgttgccatcaatttcgttggatgactcaagaatgctttcggatatccagaagttctacaatgtggttgtggaggagctcccttcgaatgttgctgacctgatctaattaaattttgtttcattgaatgtttatttaggaaactactttttgctcagaagagtatggattgacattagcttattttagattaatctcatctattttattatcagatttgctgcaattggttgttactgtgttttacagtatttcattccaagttgttaca

SEQ ID NO: 4927 - DNA, 1395 bp, Selaginella moellendorffii
aaattacatcgcgcagtcatggcaggaatggcaccggagggctcgcaattcgatccccgtcagttcgatcagaaaatggaattcgccctcgagaccggcgaggaggccctctcgacctgggaggaggttaacgagacattcgattcgatgggtctccacgagaatctcctgcgagggatctatgcctacggttttgagaagccatcggcgatccagcagcgaggaatcgtcccgttttgccggggcctcgacgtgatccagcaagcccagtcggggaccggcaagacggctacgttttgctcgggcattctccagcagcttgacggacacctgaacgagtgccaggcgctcgtcctcgctcctacccgcgagctcgcccagcagatcgagaaggtgatgcgagcgctcggggattacttgcaaaccaaagttcacgcttgcgtcggcggcacggacgtccgccaggaccagaggatctgccaggcgggtgttcacgtcgtggttggaactcctggccgtgtctacgatatgctccgccgccgggccctccgctccgagcacatcaggatgttcgtcctggacgaggcggacgagatgctctcccgtggattcaaagaccaaatctatgatatcttccagctcctgcccgccaaggtccaggtgggcctcttctccgccaccatgccgcccgaggcgctggagatcacccgcaagttcatgagcaacccggtccggatcctcgtcaagcgcgacgagctgacgctggagggtatcaagcagttctacgtgaacgtggagcgcgaggactggaaactggacacgctgtgcgacctgtacgagacgctggccatcacgcagagcgtcatcttttgcaacacccgtcgcaaggtggactggctcacggacaagctgcggagccgcgaccacacggtgtcggcgacgcacggcgacatggatcaaaacacccgcgacatcatcatgcgcgagttccggtcgggatcgtcgcgagttctcatcaccaccgacttgctcgcgcgcgggatcgacgtccagcaggtgtcgctggtgatcaactttgatcttcccacgcagccggagaactacctgcatcgaatcgggcgcagcggtcggtttgggcgcaagggagtggcgatcaacttcttgaccaaggacgacgagaagatgctcttcgacatccagaagttctacaacaccgtcatcgaggaactgccgagcaacgttgcggacctcatctgagcagcgtgagtttttgctttattcgtctatttcttcttttttgttttggcctctaggctgctgtgcggaagttttgttttcgctctctcttttcgtttttgtacttttagttcggcaaaggaatcatgaattcacttg

SEQ ID NO: 4928 - DNA, 1521 bp, Phaseolus coccineus
ccgaggagttactcctttgctcttttttctctttccttattgcaataccaacccttcaagtttccaccagttatggcaggtttggctccagaaggaacacaatttgatggtcgccagtatgatgctaagatgagtgaattgctttccactgatgggcaagaattcttcacctcttatgatgaagtctacgaaagctttgatgcaatgggattacaagaaaatcttctgcgagggatatatgcttatggttttgagagaccttctgcaatccagcaacgaggaattgttcctttctgcaagggtctggatgtgattcaacaggctcaatctggaacaggaaagacagcaacattctgttctggaattttgcagcagcttgattatggattggttcagtgccaggctttggttttggcaccaacaagggagctagcacagcagattgagaaagttatgcgagctcttggtgattacctgggtgttaaggttcatgcttgtgttggtgggacaagcgtccgtgaggatcagcgcattctccaagctggtgtccacactgttgttggcactcctggccgtgtgtttgacatgctgcgaaggcagtctcttcgcccagattgcataaagatgtttgttttggatgaggctgatgaaatgctttcacgaggtttcaaggatcagatctatgacatcttccagctgctgccatccaaaattcaggttggggtgttctctgctacaatgccgccagaagcccttgagattacaaggaagttcatgaataagccagtgagaatcttggtaaagcgtgatgaactgaccctggagggtatcaaacagttttatgtgaatgttgacaaggaagagtggaagctagagacattatgcgacctttatgagactctggccatcacccagagtgtcatttttgtgaataccaggcgcaaggtcgactggctcactgacaagatgagaagcaatgaccacacagtctctgccacccacggtgacatggaccaaaacacgcgtgacatcatcatgcgcgaattccggtccggctcgtctcgggttctcattaccacggaccttctggcccgtggcatagatgtgcaacaagtgtctctggtgataaactatgatctgccaacccagcctgaaaactatctccaccgcatagggcgtagtggccggtttggaagaaaatgagttgctataaactttgtgacaacagatgattccagaatgctgtctgatattcagaagttctacaatgtgactgtagaggagctgccatcaaatgttgctgatttgctctgatgagttaatttttgttctctgttaagtcatcagtcatcaggcctttttttattgctatctcattttctctcgctctaaatattttatccacattagagatcaaagacatatgatctgatgctatttgtattggattctataaattttgtttaaatcaatcgattaattagcaggttgctgtttcaagcctgcatttacttcgaaaaa

SEQ ID NO: 4929 - DNA, 1270 bp, Brassica rapa
ttgcactttctctctctataaactctttgttctatctcttcacattcgggttcagatccaaagtctttcacttttgctcttaaaagctttcatctctctcctacacaactcaaactcaagtcatggcaggatcagcaccagaaggtacacagtttgatactcgtcagtttgaccagaagctcaatgaagtcctcgagggacaagatgagttcttcacctcgtatgatgaggtccatgagagctttgatgccatgggtcttcaagagaaccttcttaggggcatctatgcctatggttttgaaaagccatctgctattcagcaaagaggaatcgtacccttttgcaacggtctcgacgtgatccagcaggcacagtctggtaccggcaaaaccgccactttctgctctggggtcttgcagcagctcgacttcacccttgtccagtgccaggctctcgtcttggctccaaccagggagcttgctcagcagattgagaaggtcatgcgcgctctaggagactatcttggcgtcaaggtccacgcctgtgtcggtggaaccagtgtccgtgaggatcagcgtatcctccaagccggtgtccacgtcgtggtgggaactccaggtcgtgtgttcgacatgctcagaagacagtctctccgcgctgactccatcaagatgtttgtcctcgacgaagccgacgagatgctctcacgcgggttcaaggaccagatctacgacatcttccagctcctcccaccgaagatccaagtcggtgtgttctcagccacaatgccgccggaggctctcgagatcacgaggaagtttatgagcaaaccggtgaggatcttggtgaagcgcgacgagctgactctcgaaggtatcaagcagttttacgtgaacgtggagaaggaagactggaagctggagactctctgtgacctctacgagacgttggccatcactcagagcgtcatcttcgtcaacactcgtcgcaaggtggactggctcacggataaaatgaggagccgtgaccatacggtgtcggcgactcacggagacatggaccagaacactagagacattatcatgagagagttcaggtctggctcttcgcgtgtgctgatcacgaccgatctcttggctcgtgggattgatgtgcagcaagtgtctttggttattaactttgatctgccgactcagcctgagaactaccttcaccgtattggtaggagtgggaggtttgggaggaaaggtgtggcgattaactttgtgac

SEQ ID NO: 4930 - DNA, 1246 bp, Orobanche aegyptiaca
aattttcacgatctctgttctccaactccacggcgcagatccgaggagttaatcagcaaatttaatcagctctcacaacaagttcttctttattcaaatcaaagtatggcaagtttggcaacagaagcttcacaatttgatactcgtcagtttgatgctagaatgactgagttgctccacgcagatggagaggaattctttactaattatgacgtgattaatgagacattcgattctatgggtctgcaggaaaaccttctcagaggcatctatgcctatggttttgagaagccatctgccatccagcaaaggggcattgttcctttctgccaggggctcgatgttattcagcaggctcagtctggaactggaaaaactgctactttctgttctggcattttgcagcagcttgattatggtttaactcagtgtcaggccttggtttttggcacccactagagaacttgcacaacagattgagaaggttatgcgagcacttggtgacttccttggtgtgaaggtccatgcatgtgttggtggtaccagtgttcgtgaggaccagaggattctttctgctggggttcatgttgttgttggaacccctggtcgtgtttttgacatgctgcgaagacagtcgcttcgtgcggacaacatcaggatgtttgtcttggacgaggctgatgagatgctgtctcgtggttttaaggatcagatatacgatatcttccagatgctgccggctaaagtacaggtcggtgtgttctccgctaccatgcccccagaagccctcgagatcacacggaaattcatgaacaagcccgtccgtattctggtcaaacgtgacgagttgaccctcgagggtatcaaacagttctatgtcaacgtcgataaggaagagtggaagctcgagactctgtgcgacctttacgaaaccctagccatcactcagagcgtcatctttgtcaacaccagacggaaggtggactggctcaccgacaaaatgcggggacgtgaccataccgtctcggccacccacggcgacatggaccagaacacgcgtgacatcatcatgcgcgagtttcgttccggctcttcacgggtcctcatcactaccgatctcttggcccgtggtatcgacgttcagcaagtgtcgctagtgattaactatgacctcccgacccagcccgagaactatcttcacagaattggaaggagtgggaggttcggaaggaagggagtcgcgatt

SEQ ID NO: 4931 - DNA, 1700 bp, Pinus taeda
gagagttcatacggcggcggaggtgctttcagtgacctccacctcaattatcttccgctattttttatcacggaaatcttcgcttcagcttcctttttaagatcaagggtttctcagcgaaaaggtaaaactaggaaatggcagctgcggatccggccggaaacaacttcgacgccaagagctatgacaaaaacatgcagagcgtccttggaggagaagagctttactctacctgggaggaggttcatgaaacttttgactccatggggcttcaggaaaaccttttaagaggaatttatgcatatggttttgagaagccatctgccatccagcagagagggattgttcctttctgccaaggtcttgatgttatccagcaagcacaatcaggaacaggaaagactgccactttctgttcaggaattctacaacagttggactacagtatccctgagtgtcaagctctagttttggccccgacacgagaactagcccagcagatagagaaagttatgagggcacttggtgattaccttcaagtaagagtacatgcatgtgttggtgggacaagcatccgagaggacctccgtattctccaagctggtgttcatgttgttgtggggacaccgggtagggtctatgacatgctgcggcggcgtgccttgcgtccagactcaatcaaaatgtttgtgcttgatgaagcagatgaaatgctatcacgtggatttaaggatcagatatatgatatctttcaattgctacctgcaaatctccaagttggtgttttctctgccaccatgcctcctgaggccttggagattacgaggaagttcatgactaatccggtcaggattcttgtgaaaagagacgagcttacgctggagggtatcaaacaattctatgttaatgtagagcgagaggattggaagcttgatacactatgtgatctgtatgaaactttggcaatcacacagagtgtgattttcatcaataccaggaggaaggtagattggctgacagatcaaatgcgagctcgggatcacacagtttctgcaacccatggtgacatggatcagaacacaagagacatcattatgagggaattcaggtctggatcttctcgagtcctgatcaccactgatctattggcccgaggtattgatgtacaacaagtgtctcttgttatcaactatgacttaccaacacagcctgaaaactaccttcaccgtattggtcggagtggacgatttggcaggaagggtgtggccatcaactttgttaccaaagatgacgagagaatgctgcaggacatacagagattctataacgtggtaattgaagaattgccaagtaatgttgctgatttaatataaagatattgcacaagcagcattatctgtactatgccgtgtgcagtgagttgagtacgttatcttttgggttgaatactcttccgccctcttgattctgtaaattgttaacaactattttgttcggtgaaacattctgtatttcttggaccttgcttaacggtattgctttgttgtaaatcttatctgagagggagccattttaagctctttgctcgccctctcagggttttataagtttattcataatacaaggttgagagagtgtagtgactgttttctgcacttggatgttatgcctattttgaaatttaatggatcaaacttatt

SEQ ID NO: 4932 - DNA, 1746 bp, Pinus taeda
acaggaaaatttgttacttagagagttcatacggcggcggaggtgctttcagtgacctccacctcaattatcttccgctattttttatcacggaaatcttcgcttcagcttcctttttaagatcaagggtttctcagcgaaaaggtaaaactaggaaatggcagctgcggatccggccggaaacaacttcgacgccaagagctatgacaaaaacatgcagagcgtccttggaggagaagagctttactctacctgggaggaggttcatgaaacttttgactccatggggcttcaggaaaaccttttaagaggaatttatgcatatggttttgagaagccatctgccatccagcagagagggattgttcctttctgccaaggtcttgatgttatccagcaagcacaatcaggaacaggaaagactgccactttctgttcaggaattctacaacagttggactacagtatccctgagtgtcaagctctagttttggccccgacacgagaactagcccagcagatagagaaagttatgagggcacttggtgattaccttcaagtaagagtacatgcatgtgttggtgggacaagcatccgagaggacctccgtattctccaagctggtgttcatgttgttgtggggacaccgggtagggtctatgacatgctgcggcggcgtgccttgcgtccagactcaatcaaaatgtttgtgcttgatgaagcagatgaaatgctatcacgtggatttaaggatcagatatatgatatctttcaattgctacctgcaaatctccaagttggtgttttctctgccaccatgcctcctgaggccttggagattacgaggaagttcatgactaatccggtcaggattcttgtgaaaagagacgagcttacgctggagggtatcaaacaattctatgttaatgtagagcgagaggattggaagcttgatacactatgtgatctgtatgaaactttggcaatcacacagagtgtgattttcatcaataccaggaggaaggtagattggctgacagatcaaatgcgagctcgggatcacacagtttctgcaacccatggtgacatggatcagaacacaagagacatcattatgagggaattcaggtctggatcttctcgagtcctgatcaccactgatctattggcccgaggtattgatgtacaacaagtgtctcttgttatcaactatgacttaccaacacagcctgaaaactaccttcaccgtattggtcggagtggacgatttggcaggaagggtgtggccatcaactttgttaccaaagatgacgagagaatgctgcaggacatacagagattctataacgtggtaattgaagaattgccaagtaatgttgctgatttaatataaagatattgcacaagcagcattatctgtactatgccgtgtgcagtgagttgagtacgttatcttttgggttgaatactcttccgccctcttgattctgtaaattgttaacaactattttgttcggtgaaacattctgtatttcttggaccttgcttaacggtattgctttgttgtaaatcttatctgagagggagccattttaagctctttgctcgccctctcagggttttataagtttattcataatacaaggttgagagagtgtagtgactgttttctgcacttggatgttatgcctattttgaaatttaatggatcaaacttattagaatacgagttcttttaactttcgt

SEQ ID NO: 4933 - DNA, 1789 bp, Pinus taeda
cggccgggggcgttcattcgacgctccaataagcacatcaacacaccactgaaattcatccataaatatatttattactcgagcgttgatacggtgcccaggtgatctaacatattccattctcttcggctgttttaattacggaaatcttcctttcggcgttcttttcagatcaagggtttttcagagcgaaaatacaaagtaaaactggaaaatggcgggtgtggagcaggccggaaacaacttcgatgccaagaactacgacaagaacatgcagagtgtccttggaggagaagaactttattctacctgggaggaagttaatgaaacgttcgactcaatggggcttcaggaaaacctcttaagaggaatttatgcatatggttttgagaagccttccgcaatccagcagagaggaatcgttcctttctgccaaggtctcgatgttattcagcaagcacaatctggaacggggaagactgcgaccttctgttcaggaattctacaacagttggactacagcctcccacagtgccaggcactggttttggccccaacccgagaattagcccaacagatagagaaagttatgagggcacttggtgattatttacaagtaagagtacatgcatgtgttgggggtacaagcattcgagaggatcttcgtattcttcaagctggtgtccatgttgttgtagggacaccaggtagggtctatgatatgctgcggcgtcatgccttgcgttctgattcaattaaaatgtttgtgcttgatgaagcggatgaaatgctctcacgtggatttaaggaccagatatatgatatctttcaattgctaccgccaaatcttcaagttggtgttttttcggccaccatgcctcccgaggcattggagattacaagaaagttcatgaataatccggttagaattcttgtgaaaagagatgagcttaccctggagggtatcaaacagttttatgtcaatgtagaacgagaagattggaaacttgatacactgtgtgacctgtatgaaactttggcaatcacacagagtgtgattttcatcaatactaggcggaaggtagattggctcacagatcaaatgcgagctcgagatcatacagtgtctgcaacccatggtgacatggatcagaacacaagagacatcattatgagggaattcaggtctggatcctccagagtgttgatcaccactgatctcctggctcgaggtattgatgttcaacaggtgtctcttgttattaactatgatttaccaacacaacctgaaaactacctccaccgtattggtcgtagtggacgatttggcaggaagggtgttgccatcaactttgttaccaaggatgatgagagaatgctgcaggacatccagagattctataatgtggtaatcgaagagttgccaaataatgttgctgatttgatatagagatattgcagaagcagtgcatctgtactatgcattgtgcagcgagttgagtacttttgggttgaatactcttcctccctcttgcatctgaaaattgtgaacgactgttttgcattgtggtgtaatatgggtttctaggaacctttagtaactgtattgctttgttgtaatcttagctgagagggagccattttaattgcgttacttgccctctcaaggattttataacttaatactcataatatgaggttgagagagtgtagagtgagttgtctgcacttttatgctattcatattttgacctttttattaatcaaactagtgagaatatgaaatttt

SEQ ID NO: 4934 - DNA, 1782 bp, Pinus taeda
ggcgttcattcgacgctccaataagcacatcaacacaccactgaaattcatccataaatatatttattactcgagcgttgatacggtgcccaggtgatctaacatattccattctcttcggctgttttaattacggaaatcttcctttcggcgttcttttcagatcaagggtttttcagagcgaaaatacaaagtaaaactggaaaatggcgggtgtggagcaggccggaaacaacttcgatgccaagaactacgacaagaacatgcagagtgtccttggaggagaagaactttattctacctgggaggaagttaatgaaacgttcgactcaatggggcttcaggaaaacctcttaagaggaatttatgcatatggttttgagaagccttccgcaatccagcagagaggaatcgttcctttctgccaaggtctcgatgttattcagcaagcacaatctggaacggggaagactgcgaccttctgttcaggaattctacaacagttggactacagcctcccacagtgccaggcactggttttggccccaacccgagaattagcccaacagatagagaaagttatgagggcacttggtgattatttacaagtaagagtacatgcatgtgttgggggtacaagcattcgagaggatcttcgtattcttcaagctggtgtccatgttgttgtagggacaccaggtagggtctatgatatgctgcggcgtcatgccttgcgttctgattcaattaaaatgtttgtgcttgatgaagcggatgaaatgctctcacgtggatttaaggaccagatatatgatatctttcaattgctaccgccaaatcttcaagttggtgttttttcggccaccatgcctcccgaggcattggagattacaagaaagttcatgaataatccggttagaattcttgtgaaaagagatgagcttaccctggagggtatcaaacagttttatgtcaatgtagaacgagaagattggaaacttgatacactgtgtgacctgtatgaaactttggcaatcacacagagtgtgattttcatcaatactaggcggaaggtagattggctcacagatcaaatgcgagctcgagatcatacagtgtctgcaacccatggtgacatggatcagaacacaagagacatcattatgagggaattcaggtctggatcctccagagtgttgatcaccactgatctcctggctcgaggtattgatgttcaacaggtgtctcttgttattaactatgatttaccaacacaacctgaaaactacctccaccgtattggtcgtagtggacgatttggcaggaagggtgttgccatcaactttgttaccaaggatgatgagagaatgctgcaggacatccagagattctataatgtggtaatcgaagagttgccaaataatgttgctgatttgatatagagatattgcagaagcagtgcatctgtactatgcattgtgcagcgagttgagtacttttgggttgaatactcttcctccctcttgcatctgaaaattgtgaacgactgttttgcattgtggtgtaatatgggtttctaggaacctttagtaactgtattgctttgttgtaatcttagctgagagggagccattttaattgcgttacttgccctctcaaggattttataacttaatactcataatatgaggttgagagagtgtagagtgagttgtctgcacttttatgctattcatattttgacctttttattaatcaaactagtgagaatatgaaattttt

SEQ ID NO: 4935 - DNA, 1602 bp, Raphanus sativus
  misc_feature (19)..(19): n is a, c, g, or t
  misc_feature (583)..(583): n is a, c, g, or t
  misc_feature (700)..(700): n is a, c, g, or t
  misc_feature (709)..(709): n is a, c, g, or t
  misc_feature (1237)..(1237): n is a, c, g, or t
  misc_feature (1306)..(1306): n is a, c, g, or t
gctacctatcgctcttttnttttagtttatctctttaccattcgcttcagatccgagcttggacgatttcaagctctctctctaagacgaaagaagaaagtctttcacttttgtttctcaatctcccaagtcatggcaggatcagcccctgaaggcaacacagtttgatgatgcgcgtcagtttgatcaggcactcagtgaaatcctggagggaaaggatgagttcttcacctcctatgatgaggtttatgagagttttgatgacatgggtttgcaagagaaccttcttaggggtatctatgcttatggttttgaaaagccttctgctattcagcaaagaggaatcgtacccttttgcaagggtcttgatgtgatccagcaggcacagtctggtactggaaaaaccgcaactttctgctctggtgtcttgcagcagcttgacgtcacccttgtccagtgccaagctctggtcttggctcccaccagggagcttgctcagcagattgagaaggtcatgcgtgctctcggagattaccttggcgtcaaggtccacgcctgtgtcggtggtaccagtgttcgtgangatcagcgcattctccaggccggtgtccatgttgtcgttggaactccaggtcgtgtctttgacatgctccgaagacagtcacttcgctctgacagcatcaagatgtttgtcctcgangaagctgangaaatgctctcccgtggtttcaaggatcagatctacgacatattccagcttctcccaccaaagattcaggtcggtgtgttctcagctacgatgccaccagaggcgctcgagatcacgaggaagttcatgagcaaaccggtgagaatcttggtgaagcgtgacgagctaactctcgaaggtatcaagcagttctacgtgaacgtggagaaagaagagtggaagctcgaaactctctgtgacctctacgagacgttagccatcactcagagtgtcatcttcgtcaacactcgtcgcaaggtggactggctcactgacaaaatgaggagccgcgaccacacggtctcggccacccacggagacatggaccagaacacgagagacatcatcatgagagagttcaggtctggttcttcccgtgttctcatcacgaccgatctcttggctcgtggtatcgatgtgcagcaagtctctctggtcatcaacttcgacctcccaactcagccggagaactaccttcaccgtatcggnagaagtggaaggtttgggaggaaaggtgtggcgattaacttcgtgactcgtgacgatgagagaatgctntttgatattcagaaattctacaatgtggttgttgaggagcttccctcaaacgtcgccgacctgctttgaagaagaagaacagaaaaccaccgttgttcgccgccggagaagaagtaaaaggttacttgtttcgcaagcttcttgttttgatttttgacccatctttctctgtttctctctttgctcatcgacacctctttctcattttcgaacatatatgtctcatctgaacatgtttcttcttaatctcatgcaatatttatttttactttcttgtttgatgcacaaagttttca

SEQ ID NO: 4936 - DNA, 1564 bp, Mesembryanthemum crystallinum
  misc_feature (1)..(1): n is a, c, g, or t
  misc_feature (24)..(24): n is a, c, g, or t
  misc_feature (27)..(27): n is a, c, g, or t
naatccatgctctgtagcgatggnggncgcgtcgacgggattgcaagagaatcttctcagaggaatctatgcttatggttttgagaaaccttctgctattcaacaaaggggaattgtacccttctgccagggtcttgatgtaattcagcaagcccaatctggtacaggaaagacagctactttctgctctggaatcctgcagcagctggactatgagttgttggaatgtcaagctcttgtccttgctcctactagggagcttgctcaacagattgagaaggttatgcgggcccttggtgattatttgggtgttaaggtacatgcatgtgtcggtggaacgagtgtccgtgaggatcaaagaatccttgctgcaggagtacatgtggttgttggtactcctgggcgtgtcttcgacatgctgcgtaggcaatcccttcgtgctgatcgcatcaaaatgtttgttctggatgaggctgatgagatgctttcccgaggtttcaaggatcagatttatgacattttccagcaactacctcccaagatccaggtcggagtattttccgctactatgccccctgaggcccttgagataacaaggaagttcatgaacaaacctgtgaggattcttgtgaagcgtgatgagcttactcttgagggtatcaagcagttctatgtcaatgttgacaaggaggagtggaagcttgacactctttgtgacctttacgaaaccctggctatcacccagagtgtcatctttgtgaacaccaggaggaaggtcgactggttgaccgaccaaatgagggcccgtgaccataccgtgtcagccacacacggagacatggaccagaatactagggacatcattatgcgggaattccgttctggatcctctcgtgtgcttattaccaccgatcttcttgctcgtggtattgatgtgcagcaagtctctctggttatcaactacgacttgccgactcaacccgagaattaccttcacaggattggacgaagtggacggttcggaaggaagggtgttgctatcaattttgttacccgtgatgatgagaggatgctggctgatatccagaagttttacaatgtggtggttgaggaactccctgctaacgttgcggatcttatctgatgactgcaagtgtcagttgcctcttgtttgtttgaggtaagatgtttgtgtgtctagtttagtcaagattttgagcaagtgttgtttattgggtgatcattatttatgacataacagtaacagttcactgttagtactttgtggtgttcgtttcttatctcctattctgggaacatcacttaattgtattgtagatgccccaggttaaaattttgtaggagccctagagacgctttaaattgtactgtattttgggtcaaggagagtgttgtctttggcagtttttgccaacttactggtattatgtggcgtttcctgtcattctgcacgcacttgtattcttgcttgcggtgtggattgccacatttatgttgtgatgatactcacagatgtattcgataggttttctcctttagctat

SEQ ID NO: 4937 - DNA, 1780 bp, Picea glauca
atccgtatataacactcaaacactaccgaaattcatccataaatatatatattactcgagcgttgatacggtggcggaggcgatctaacgtacttctgttctcttcggctattttaatcacggaaatcttcctttcggcgttcttttcagatcaaagggtttctcagagcgaaaataaagtaaaactggaaaatggcgggtgtggatcaggccggaaacaacttcgacgccaagaactatgacaagaacatgcagagtgtccttggaggagaagaactttattctacgtgggaggaagttaatgaaacgtttgactccatggggcttcaggaaaaccttttaagaggaatttatgcatatggttttgagaagccatctgctatccagcagagggggattgttcctttctgtcgaggtcttgatgttattcagcaagcacaatcgggaacaggaaagactgcaactttctgttcaggaattctacaacagttggactacaatgtcccagagtgtcaggcactagttttggccccaacccgagaactagcccaacagatagagaaagttatgagggcactaggtgattacctacaagtaagagtacatgcatgtgttggggggacaagcattcgagaggaccttcgtattctccaagctggtgttcatgttgttgtggggacaccaggtagggtctatgatatgttgaggcgtcgtgccttgcgtcctgattcaattaaaatgtttgtgcttgatgaagcagatgaaatgctatcacgtggatttaaggaccagatatatgatatctttcaattgctaccttcaaatctccaagttggtgttttctcggccaccatgcctcctgaagcattggagattacaaggaagttcatgaataatccagtcaggattcttgtgaaaagagatgagcttaccctggagggtatcaaacagttttacgtcaatgtagagcgagaagattggaagcttgatacactgtgtgacctatatgaaactttggcaatcacacagagtgtgattttcatcaataccaggcgtaaggtagattggctcacagatcaaatgcgagctcgagatcacactgtgtctgcaacccatggtgacatggatcagaacacgagagacatcattatgagggaattcaggtctggatcttccagagtgttgatcaccactgacttattggcccgaggtatcgacgtacaacaagtgtctcttgttatcaactacgacttaccaacacagcctgaaaactacctccaccgtattggtcgtagtggacgatttggtaggaagggtgtggccatcaactttgttaccaaggatgatgagagaatgctgcaggacatccagagattctataatgtggtaattgaagagttgccaaataatgttgctgatttgatatagagagattgcagaagcagtgcatctgtactatgcagtgtgcagtgagttacttttgggttgaatactcttcctccctcttgcttctgaaaattgttaaccactattttgctggtggagtaatgtggatttcttggacctttagtaactgtattgctttgttgtaatcttagctgagagggagccattttaatttctttactcgccctctcaaggatttattaacttaatatcattatgaggttgagagtgtagagtgagttgtctgcacttagatgctattcatattttgaccttttttatcaatcaagctagtgagaatatgaaatttttagctattgtacatctatcttat

SEQ ID NO: 4938 - DNA, 1703 bp, Mesostigma viride
  misc_feature (228)..(228): n is a, c, g, or t
  misc_feature (843)..(843): n is a, c, g, or t
  misc_feature (870)..(870): n is a, c, g, or t
  misc_feature (1694)..(1694): n is a, c, g, or t
cccgccgcaacgcgtgggttagcgactccattgcgagtttgacgaccagtctcttccgaactactctcaatcatggcgggtgaaggacaatacgatgccaggggttatgatcagaagatggaaggatttctgcaggacgaggagcttatctctacgtgggacgaggttgcggagtcttttgatcagatgaacctgcacgagaacctgttgcgtggtatctattcttanggtttcgagaagccgtctgcaatccagcagcgcggcattgtccccttcacgcgcggcctggacgtgatccagcaggcccagtccggtaccggcaagacggccaccttctgtgcgggcatcctgcagcagctggactactcgctgctccagtgccagggcctggtgctggccccgacgcgcgagctggcgcagcagatcgagaaggtcatgcgcgcgctgggcgactacctgggcgtgaagtgccacgcgtgcgtgggtggcacgagcgtgcgggaggaccagcgcatcctgcaggggggcgtccacgtcgtggtgggcacgcccggccgtgtgtacgacatgctgcggaggcacgcgctgcgctccgactgcatccgcatgttcgtgctggatgaggccgacgagatgctctcccgcggtttcaaggaccagatctacgacatcttccagctgctgccgcccaagctgcaggtgggtgtgttctcggccacgatgccgcccgaggcgctggagatcacgcgcaagttcatgagcaagccggtcaagatcctggtcaagcgtgacgagctgaccctggagggtatcaagcagttctacgtgaacgtggaccgcgangactggaagctggacacgctgtgcganctgtacgagacgctggccatcacgcagtcggtcatcttctgcaacacccgccggaaggtggactggctgaccgacaagatgcgtgtgcgcgaccacaccgtgtcggccacgcacggtgacatggaccagaacacgcgtgacatcatcatgcgcgagttccggtcgggctcctcgcgcgtactcatcaccacggatctgctcgcccgcggtatcgacgtgcagcaggtctcgctcgtcatcaactacgacctcccgctccagccggagaactacctgcaccgcattgggcgctcgggtcggtttgggcgtaagggtgtggccatcaacttcgtgaccaaggacgacgagcggctcgtccaggacatccagcgcttctacaacaccacgatcgaggagctgccaaacaacgtcgccgatctgatctaaatccggccggaagggagggatgagagccggggcctgcgcgctggtttctggggcgagacggccgcgtggctgcttgatttccgaggcagggtccctttggggactgttgactggaagacaggcgagcctttataattattgcgttgcttggaagagtcgactcaccccttgtaatttttttaggtattgtagagcctgatctggcgcatgagcacttcgccacgcaacttagttgacccacccgtcagttttcgctagtcgaaacgcttcgcttgcccaaccccactggattggcagtgggataacttaacctcaatgcccacctcaatgcagtttactagtctttttgcaagttacgggaatacctttatctattaccttgaataaattcctgatanggtgactgc

SEQ ID NO: 4939 - DNA, 1354 bp, Arachis hypogaea
tgcgttcactgagggacaaaatacgggacctcttatgatgaagtctatgacagctttgatgctatgggattgcaagaaaatcttctgagaggcatatatgcttatggttttgagaggccttctgcaatccagcaaagaggaattgttcctttttgcaaaggtctggatgtgattcaacaggctcagtctggaactgggaagaccgctacattttgttctggaattttgcagcagcttgattacggattggttcagtgtcaggctcttgtgttggcaccgacaagggagctagcgcagcagattgagaaggttatgcgagcacttggcgattaccttggtgttaaggttcatgcttgtgttggagggacaagtgttcgtgaggatcagcgcatcctccaagctggagtacatactgttgttggtactcctggacgtgtttttgacatgctgcggaggcaatctcttcgcccagatcacataaagatgtttgttttggatgaggctgatgaaatgctctcacgtggtttcaaggatcagatctatgacatcatccagctactgccaggcaaaattcaggttggagtgttttctgctacaatgccaccagaagctcttgagattacaagaaagttcatgaataagccagtgaggatcctggttaagcgtgatgagctgaccctcgagggtatcaagcagttctatgtcgatgttcagaaggaagagtggaagctggagacattgtgcgacctttacgagactctggctattactcagagtgtcattttcgtgaataccagacgcaaggtggattggttgactgacaagatgcgagccaatgaccacactgtctcagccacccatggtgacatggaccaaaacactagggatattatcatgagggaattccggtccggttcttctcgagttctcatcaccaccgacctcctggctcgtggtatcgatgtgcagcaagtttcactggtcataaactatgatctgcctactcaaccagaaaactacctccaccgtattggccgtagcgggcgttttggaagaaaaggtgttgctataaactttgtgacacaggatgatgccagaatgctgtctgatattcagaagttctacaatgtgaatgtggaggagctgccatccaatgttgctgatttgctctgatgagttaatttttgtttctgttaagtcatcagggcctacttttttgacaattaccattatatccctcttttgtggttaaaaaaaaattgttatctgatgctattcatgatggaattggatggattctacaaaacatgtttaatttattagcagtgctgttatagcctgccattccttttca

SEQ ID NO: 4940 - DNA, 1780 bp, Picea glauca
ccatagaaaaattgattgctcgagcgtttatacggcggcggaggtgatctgacatacctctacctctattatcttctgctatttttatcaaggaaatcttctcttcagcgtcctttttaagttaatccggcctctctccgctaaatccagccccagatagatagatttcccctccttttttaaggtcctctgtattgtctttcaatctttgaggagattatcacaaaaaatattgcagatcaggatttctcagcgaaaagggtaaaagtagaaaatggcaggtgtggatcaggctggaaacaacttcgacgccaagagctatgacaaaaacatgcagagtgtccttggaggagaagaactttactctacctgggaggaagttcatgaaacttttgactccatggggcttcaggaaaaccttttaagaggaatttatgcatatggttttgagaagccatctgccatccagcagagagggattgttcctttctgccagggtcttgatgttatccagcaagcacaatcaggaacaggaaagactgcaactttctgttcaggaatactacaacagttgaactacaatgtccctgagtgtcaggctctagttttggccccgacacgagaactagcccagcagatagagaaagttatgagggcacttggtgattacctacaagtaagagtacatgcatgtgttggtgggacaagcattcgagaggacctccgtattcttcaagctggtgttcatgttgttgtggggacaccaggaagggtgtatgacatgctgcggcggcgtgccttgcgtcctgattcaatcaaaatgtttgtgcttgatgaagcagatgaaatgctatcacgtggatttaaggatcagatatatgatatctttcaattgctacctacaaatctccaagttggtgttttctctgccaccatgcctcctgaggccttggagattacgaggaagttcatgactaatccggtcaggattcttgtgaaaagagacgagcttacgctggagggtatcaaacaattctatgtaaatgtagagcgagaggattggaagcttgatacactgtgtgacctatatgaaactttggcaatcacacagagtgtgattttcatcaataccaggcggaaggtagattggctcacagatcaaatgcgagctcgagatcacacagtttctgcaacccatggtgacatggatcagaacacaagagacatcattatgagggaatttaggtctggatcttctcgagtcttgatcaccactgacctattggcccgaggtattgatgtacaacaagtgtctcttgttatcaactatgacttaccaacacagcctgaaaactacctccaccgtattggtcggagtggacgatttggtagaaagggtgtggccataaactttgttaccaaggatgacgagagaatgctgcaggacatccagagattctataacgtggtaattgaagaattgccaaataatgttgctgatttaatataaagatattgcagaagcagcatatctgtactatgccgtgtgcagtgaattgagtagggtatcttttgggttgaatactcttcctctctcttgattctgtaaattgttaacaactattttgtgcggtggagcattctgtatttcttggaccttgcttaacagtattgctttgttgtaatcttatctgagagggagccattttaagctctttactcgccctctcagggctttataagtttattcataatacaaggttgagagagagtttagtga

SEQ ID NO: 4941 - DNA, 1888 bp, Picea glauca
taaagttaacacccgagcgttaataaggcggcgcaggcgatctcacaggcctgtaatatcttcggctattttaatcacgggaatcttctcttcggcgtcttttttaagatcgaggttttctcagtgcgaaaataagatagaacttgaaaatggcgggtgtggatccggccggaaataacttcgacgccaagagctatgacaaaaacatgcagagtgtccttggaggagaagaactttattccacctgggaggaagttaatgaaacctttgactccatggggcttcaggaaaaccttctaagaggaatttatgcatatggttttgagaagccatctgctatccaacagagagggattgttcctttctgccaaggtcttgatgttatccagcaagcacaatcaggaacaggaaagacagcaactttctgttcaggaattctacaacagttggactacaatgttcctgagtgccaggcactagttttggccccaactcgagaactagcccagcagatagagaaagttatgagggcacttggtgattacctacaagtaagggtacatgcatgtgttggtgggacaagcattcgagaggatctccgtattctccaagctggtgttcatgttgttgtggggacaccaggtagagtctatgacatgctgcggcgtcgtgccttgcgtcctgattcaatcaaaatgtttgtgctcgatgaagcagatgaaatgctatcacgtggatttaaggaccagatatatgatatctttcaattgctaccttcaaatctccaagttggtgttttctcggccaccatgcctcctgaagccttggagattacaaggaagttcatgaataatccagtcaggattcttgtcaaaagagatgagcttaccctggagggtatcaaacagttctatgtcaatgtagagcgagaggattggaagcttgatacactgtgtgacctatatgaaactttggcaatcacacagagtgtgattttcattaataccaggagaaaggtagatatgctcacagatcaaatgcgggctcgagatcatacagtgtctgcaacccatggtgacatggatcaaaacacaagagacatcatcatgagggaatttaggtctggatcttctcgagtgttgatcactactgacctattggcccgaggtattgatgtacaacaagtgtctcttgttatcaactatgacttgccaacacagcctgaaaactacctccatcgtattggtcgtagtggacgattcggtagaaagggtgtggccatcaactttattaccaaggacgatgagagaatgctgcaggacatccagagattctataatgtggtagttgaagaattgccaaataatgttgctgatttaatataaatatatctcagaagcagcccatatgtacgatgcagtgtgcagtgagttgagtacgctttatcttttgggttgaaaactcttcctcccatttgattctgaaaattgttaacaactgttttgtgtggagtaatgtattacttggacctttagtaactgtattgctttgttgtaatctcacatgagagggagccattttaagctttttactcgctctctcaaggtttttataagttaatacgcataatatgagcttgagagtatgtaacctctcaaagattttataagttaatttgcataatatgaggttgagagattgtaccctcaaagtttttataactcatgtgcataatatggggttgagagagtgcagtgagtgaattttctgcactctgtcattcatattctgattttttatggatcggactacttagaacatgtgcctttttaaccattgtacatctatcttgtttaggcatttttgattaagcatgccttttgcagct

SEQ ID NO: 4942 - DNA, 1706 bp, Chlamydomonas reinhardtii
cctgcttaagcggcctcttcagctttcaaaacagctccttaaccgttttctttttcgcgggcctgaggccctgttcgaagcacaaccagcaaacatggctgccgcgccggttgagcgcaccggtttcgatgaccgcgccttcgacacgaagatgcagcagttcctgggcaacaacgaggacaagttctacaccgactgggaggagagctttgagagcttcgaccagatgaacctgcacgagaacctgctgcgcggcatttacgcgtacggtttcgagaagccctcggccattcagtcgaagggtatcgtgccgttcaccaagggcctggacgtgattcagcaggcccagtcgggcacgggcaagaccgccaccttctgcgccggcatcctgaacaacatcgattacaactcgaacgagtgccaggcgctggtgctggctcccacccgtgagctggcgcagcagattgagaaggtcatgcgcgccctgggcgacttcctgcaggttaagtgccacgcctgcgtgggtggcaccagcgtgcgtgaggacgcccgcatcctgggcgccggcgtgcaggtcgtggtcggtacccccggccgtgtcttcgacatgctgcgccgccgctacctgcgcgcggactccatcaagatgttcaccctggacgaggccgatgagatgctgtctcgcggtttcaaggaccagatctacgacatcttccagctgctgccccccaagctgcaggtcggtgtgttctccgccaccctgccccctgaggcgctggagattacccgcaagttcatgaacaagcccgtgcgcattctggtgaagcgcgatgagctgaccctggagggtatcaagcagttctacgtgaacgtggacaaggaggagtggaagctggacacgctgtgcgacctgtacgagacgctggccatcacccagtccgtcatcttcgccaacacccgccgcaaggtggactggctgacggacaagatgcgcgagcgcgaccacaccgtgtccgccacccacggcgacatggaccagaacacgcgcgatgtgatcatgcgcgagttccgctccggctcgtcgcgtgtgctgatcaccaccgacctgctggcccgcggcattgacgtgcagcaggtgtcgctggtcatcaactacgacctgcccacccagcccgagaactacctgcaccgcattggtcgctcgggccgcttcggacgcaagggtgttgccatcaacttcgtgaccaaggacgacgagcgcatgctccaggacatccagcggttctacaacaccgtgattgaggagctgccctcgaacgtcgctgacctcatctaagcgctctactaccaccaaatgtgcgctagcccctgggtccagccgatcccaagcacggggcgaagcctgcaggatgtgaagggcacggggcagggcgcgccgccacgcagccgccccgtgacccgacaacgtgctgtacgtgctgcgctgcgagtccttttgaacacgggccgtcgttgcgggtggtaaacgtgaacctgtgttgaggcgggtcggcgcagcttcggttgcagccatttgagagagaaggaagtttgccggtttgcaaacggcaggagttttgtcgcgaccgccatatgtttgacgccttttgagagtgccacaccgctgcccaacctattcgtatgactgtaaggacgcaagtctgcga

SEQ ID NO: 4943 - DNA, 1863 bp, Pinus taeda
ggggctcttcgaattttaatacccaagcggtaataaggcggcggaggcgatctcataggtcgctaacatcttgggctatttttagcacgggaattttcacttcggcgtctcttcgcagatcgagggtttctcaggcaaaaataagataaaattcgaaaatggcgggtgttgaagcggctggaaacaacttcgacgccaagaactatgacaaaaacatgcagagtgtccttggaggagaagaactttattctacctgggaggaagtgaatgaaacctttgactctatggggcttcaggaaaaccttctaagaggaatttatgcgtatggttttgagaagccatctgctatccaacagagagggattgttcctttctgtcaaggtcttgatgttatccagcaagcgcaatcaggaacaggaaaaactgcaactttctgttcaggaattctacaacagttggactacaatgttccagagtgtcaggcactagttttggccccaactcgagaactagcccagcagatagagaaagttatgagggcacttggtgattacctacaagtaagagtacatgcatgtgttggtgggacaagcattcgagaggatctccgtattctccaagctggtgttcatgttgttgtggggactccaggtagggtctatgacatgctgcggcgccgtgccttgcgtcctgattcaatcaaaatgtttgtactcgatgaagcagatgaaatgctatcacgtggatttaaggaccagatatatgatatttttcaattgctaccttcaaatctccaagttggtgttttctcggctaccatgcctcctgaagctttggagattactaggaagttcatgaataatccagtcaggattcttgtcaaaagagatgagcttaccctggagggtatcaaacagttctatgtcaatgtagaacgtgaggactggaagcttgatacactgtgtgacttatacgaaactttggcaatcacacagagtgtgatttttatcaataccagaagaaaggtagatatgctcacagatcaaatgcgagctcgggatcatacagtgtctgcaacccatggtgacatggatcagaacacaagagacatcatcatgagggaatttaggtctggatcttctcgagtgttgatcaccactgacctattggcccgaggtattgatgtacaacaagtgtctcttgttatcaactatgacttaccaacacagcctgaaaactacctccaccgtattggtcgtagtggacgattcggtagaaagggtgtggccatcaactttattaccaaggatgatgagagaatgctgcaggacatccagagattctataatgtggtagttgaagaattgccgaataatgttgctgatttaatataaatgttttgcagaagcagcccatatgtacggtgcagtgtgcagtgagttgagtacactttatcttttgggttgaaaactcttcctcccttgtgattctgaaaattgttaactactattttgtgtggtggagtaatgtattacttggacctttagtaactgtattgttttgttgtaatctcatatgagagggagccattttaagctcttttcttgccctctcaaggtctttacaagtcagtactcataatatgagcctgagagagtgtaacttctcaaagagtttataagttaatatgcataatatgtcgttgagagagtgtaccctctcaaagtttttgtaacttaatatgcttaatatgaggttgagagaatgtagtgagtgaatattctgcaatctgttattcatagtaccctctcaaagtttttgtaacttaatatgcttaatatgaggttgagagagtgtagtgag

SEQ ID NO: 4944 - DNA, 2043 bp, Pinus taeda
gcaggtacgggggctcttcgaattttaatacccaagcggtaataaggcggcggaggcgatctcataggtcgctaacatcttgggctatttttagcacgggaattttcacttcggcgtctcttcgcagatcgagggtttctcaggcaaaaataagataaaattcgaaaatggcgggtgttgaagcggctggaaacaacttcgacgccaagaactatgacaaaaacatgcagagtgtccttggaggagaagaactttattctacctgggaggaagtgaatgaaacctttgactctatggggcttcaggaaaaccttctaagaggaatttatgcgtatggttttgagaagccatctgctatccaacagagagggattgttcctttctgtcaaggtcttgatgttatccagcaagcgcaatcaggaacaggaaaaactgcaactttctgttcaggaattctacaacagttggactacaatgttccagagtgtcaggcactagttttggccccaactcgagaactagcccagcagatagagaaagttatgagggcacttggtgattacctacaagtaagagtacatgcatgtgttggtgggacaagcattcgagaggatctccgtattctccaagctggtgttcatgttgttgtggggactccaggtagggtctatgacatgctgcggcgccgtgccttgcgtcctgattcaatcaaaatgtttgtactcgatgaagcagatgaaatgctatcacgtggatttaaggaccagatatatgatatttttcaattgctaccttcaaatctccaagttggtgttttctcggctaccatgcctcctgaagctttggagattactaggaagttcatgaataatccagtcaggattcttgtcaaaagagatgagcttaccctggagggtatcaaacagttctatgtcaatgtagaacgtgaggactggaagcttgatacactgtgtgacttatacgaaactttggcaatcacacagagtgtgatttttatcaataccagaagaaaggtagatatgctcacagatcaaatgcgagctcgggatcatacagtgtctgcaacccatggtgacatggatcagaacacaagagacatcatcatgagggaatttaggtctggatcttctcgagtgttgatcaccactgacctattggcccgaggtattgatgtacaacaagtgtctcttgttatcaactatgacttaccaacacagcctgaaaactacctccaccgtattggtcgtagtggacgattcggtagaaagggtgtggccatcaactttattaccaaggatgatgagagaatgctgcaggacatccagagattctataatgtggtagttgaagaattgccgaataatgttgctgatttaatataaatgttttgcagaagcagcccatatgtacggtgcagtgtgcagtgagttgagtacactttatcttttgggttgaaaactcttcctcccttgtgattctgaaaattgttaactactattttgtgtggtggagtaatgtattacttggacctttagtaactgtattgttttgttgtaatctcatatgagagggagccattttaagctcttttcttgccctctcaaggtctttacaagtcagtactcataatatgagcctgagagagtgtaacttctcaaagagtttataagttaatatgcataatatgtcgttgagagagtgtaccctctcaaagtttttgtaacttaatatgcttaatatgaggttgagagaatgtagtgagtgaatattctgcaatctgttattcatagtaccctctcaaagtttttgtaacttaatatgcttaatatgaggttgagagagtgtagtgagtgaatattctgcaatctgtcattcatatttcgattttttatggatccgactagttagaacatgggtatttttttttatcattgtacagctgttttgtttaggcattttgattaagcatgccttttgcagctattgtcggtataagtattttaatgcaaggtaatattcctg

SEQ ID NO: 4945 - DNA, 1720 bp, Volvox carteri
cctgcgataaagcgggccataactgctcttataagattttcgttgccttcgttttacgggcctgagagccctatttgagcaaacctgcaagcatggctgcccctcctgttgaacaacgtactggcttcgatgaccgcgccttcgactcgaagatgcaggccttcctcacgaacaaccaggataacttttacaccgattgggaggagagctttgagagcttcgaccagatgaacctgcacgagaacttgctgcgtggcatctacgcatacggttttgagaagccctcggccattcaggcaaagggtatcgtacccttcaccaagggcctggatgtgattcagcaggctcagtctggcacgggcaagacggccaccttctgcgccggtattcttaacaacctggactacaacctgaatgagtgccaggcgctggttctggctccaacccgcgagctggctcagcagattgagaaggtcatgcgcgctctgggcgacttcctgcaggtcaagtgccacgcctgcgtcggtggcaccagcgtgcgtgaggacgcgcgcattttgggtgcaggtgtgcaggttgtggtgggcacccccggtcgcgtgttcgacatgctgcgccgtcggtacctgcgcgcggacaacatcaagatgttcgtactggatgaggccgatgagatgttgtctcgcggcttcaaggaccagatctacgacatcttccagctgctgccgcctaagctgcaggtgggcgtcttctcagccactctgccccctgaggcgctggagatcacccgcaagttcatgaacaagccggtgcgcattctggtcaagcgtgatgagctgaccctggagggtatcaagcagttctatgtggatgtggacaaggaggaatggaagctggacactctctgcgatctgtacgagacgctggccattacgcagtccgtcatcttcgcgaacacgcgccgcaaggtcgactggctaacggagaagatgcgcgagcgcgatcataccgtatcggcaacgcacggtgacatggagcagaatgcccgcgatgtgatcatgcgggagttccgttccggctcatcgcgtgtgctgatcaccacggatctgctggctcgcggtatcgacgtgcagcaggtttctctggtcatcaactacgacctgccaacgcagccggagaactacctgcaccgcattggtcgctcgggccgctttggtcgcaagggtgtggcgattaacttcatcgtcaaggaggacgagcgtatgctccaggacatccagcggttctacaacaccgtggtggaggagctgccttcgaacgtcgctgacctcatctgaagttccatatgcgcaaaaaaagcttgcttacattgtcaaaaaagcaaagcctgcaggatgcatcaggcgagaggcaagagggcagcccctacgcttctgctccgctactgtttgcgcagagtgcgcttcgatagtgctgtgcatcgcagtactgcatgctaaggctgcgccgtggcgcgttactccggcgaggttgaaaacttgcaaatggggcagctaggaaaacagcttatggtgttcttgttggcggcaggattcatgatggtatgattgcccaggttctgcagttccggacgtccgctgcccgcttaccacaaatgtaagaaacactttagtctccttttctgtggttacgggggtggtgtgcaaacatgaacgaaagg

SEQ ID NO: 4946 - DNA, 1187 bp, Taraxacum officinale
gccccccgaggagtttgagaaaaccctaaaaagcctccctaaaaatctctcaactttctctctaaatctttcaatcaatctgcaaatcagtcatggcaggcgctgcaccagaaggttctcaattcaatgctcagcaatttgactcaaaaatgaatgagttgctctcactgacgggcaagactttttcacatcatatgatgaagtctacgatagtttcgatgccatgggtctccaagaaaaccttctaagaggcatctatgcatacggttttgaaaaaccatctgcaatccaacaaagaggaatcgtcccattctgcaagggactcgatgtcatccaacaagcccaatcaggaaccggtaaaaccgcaactttctgctccggaatcctccaacaactggactacaatgtagtcgagtgccaagccttggtcctggcacccacccgtgaactcgcccaacaaatcgaaaaagtcatgcgggccctcggtgactacctcggggtcaaagtccacgcgtgcgtgggcgggaccagtgtccgtgaagaccaacgcatcctctctgctggggtccacgttgttgttgggacacctggacgtgtcttcgacatgcttagaaggcaatcacttcgcgctgactacatcaagatgtttgtcctagatgaagctgatgaaatgctctctagaggtttcaaagaccagatctatgatatcttccaattgcttccatcgaaagtacaagtgggggtattttctgccacaatgccgccagaagctttggaaatcacccgcaagttcatgaacaaacccgtgagaatcctcgtgaaaagagacgaacttaccctcgaaggaatcaagcagttttacgtgaatgtggaaaaagaagactggaaacttgaaaccctctgtgacctttacgaaaccctagcaatcacccaatccgtcatcttcgtgaacacgcgccgaaaggtcgactggctaaccgacaaaatgcggtcgcgggaccacaccgtgtcagcaacccacggtgacatggaccagaacacgcgtgacatcatcatgcgggagtttcggtccgggtcatcgcgagtgttgattacaaccgatctgttggctagagggattggtgtgcaacaggtgtcgttggtgattaattatgatttgccaactcagccggagaattatcttcaca

SEQ ID NO: 4947 - DNA, 1332 bp, Brassica rapa
  misc_feature (73)..(73): n is a, c, g, or t
  misc_feature (1114)..(1116): n is a, c, g, or t
gaactccacggcgcagatccgaggagtttccgtctctcatttgaccatttcttctctctcgagatctctcttnttcactttgtgctaacagcagtcatggcaggaatggcgtcagaaggaacacaatacgatcctcgtcagtttgattctaagatgaatgccatactcggcgaggaaggagaggaaactttctacaccacttatgatgaagtctgtgatagctttgacgcaatggaactcaagtctgatctcctgagaggcatctatgcctacggttttgagaagccatctgctattcagcagagagggattattcccttctgcaaaggtcttgatgtgatccagcaagctcagtctggaaccggaaagaccgctaccttctgctctggcgttcttcagcagcttgattatactctcgttcaatgccaagctcttgttctggctcccaccagagagctcgctcagcagattgaaaaggttatgagggctcttggtgactacctcggtgtcaaggttcacgcctgcgttggtggaacaagtgtgcgtgaggatcaacgcattctccagtctggtgtccacgttgttgttggaacacctggtcgtgtctttgacatgttgcgtagacaatctctccgcgctgatgccatgaagatgtttgttcttgatgaagccgatgagatgctctctcgtggtttcaaggatcagatttacgacatcttccagcttcttccttctaaggttcaggtcggtgtcttctccgccacgatgccgcctgaagctctcgagatcacaaggaagttcatgaacaaaccggtgaggatccttgtgaagcgtgacgagctgactcttgaaggtatcaagcagttttacgtcaacgttgacaaggaagagtggaagctggagacgctttgtgatctctacgagacgctagccatcacgcagagtgtcatctttgtgaacacaaggcgtaaggttgattggttgactgataaaatgaggagccgtgaccatactgtttcagctacgcacggagacatggaccagaacacgagagacatcatcatgcgtgagttcaggtctggttcttctcgtgttctcataaccactgacctcnnngcacgtggtattgatgtgcagcaagtgtctctggtgattaactttgacctccctacacaacctgagaactaccttcaccgtattggaagaatgggaaaggtttgggaggaagggagtggcgatcaacttcatgacaactgacgatgagaggatgttgtctgatattcagaagttttacaatgtggtcgttgaagagttgccaagccatgttgctga

SEQ ID NO: 4948 - DNA, 1476 bp, Panicum virgatum
agaagccttctgctattcagcagagaggaattgttcctttctgcaagggccttgatgtcattcagcaagcacagtcgggtacaggaaagacagcaactttctgttctggtatcttgcagcagcttgactacggcctggttgaatgccaggccttggtccttgcccccacccgtgagcttgctcagcaaattgagaaggtcatgcgtgcgcttggtgactaccttggtgtgaaagttcatgcttgtgtgggaggaacctctgtccgtgaggaccaaaggattcttgctagtggtgtgcatgttgttgttgggacacccggtcgtgtgtttgacatgttgcgtaggcagtctctccgacctgatcacatcaagatgtttgtcctggatgaagctgatgagatgctttctcgtggtttcaaggatcagatttatgacatcttccagcttctcccagcaaagattcaggtcggagtcttctctgctaccatgccccctgaggctcttgagattacccgcaagttcatgaacaagcctgtgagaatcctcgtcaagagagatgagctcacccttgagggtatcaagcagttctatgtgaatgtggagaaggaagattggaagttggacacactatgtgacctgtacgagaccctggccatcacccagagtgtcatcttcgtgaacacccgccgcaaggtggactggctcactgacaagatgaggagcagggaccatactgtttctgccactcatggtgacatggaccagaacactagggacatcatcatgagggagttccggtctggttcatcccgtgtgctcatcaccaccgacctgcttgcccgtggtattgatgttcagcaggtgtccctggtcatcaactatgatctccccacccagccagagaactacctgcatcgcattggtcgtagtggtcgtttcggtaggaagggtgtggccatcaactttgtcacccgtgacgacgagcggatgctgtttgacatccagaggttctacaacgtggtgattgaggagctgcctgccaatgttgctgaccttctgtgatcaagttgatgaaaaacagcaaaacaaaaaaaattcggtaaggggggacctgataaggcttgtttttgttgaaatattgccacatgtggggagggagggatatggtcggtggggtttctatgttaaagtcgcgtggtcatggacaatttgtgattttttttcttatgccatgttttgggaatttttgtagctgcctaggccttgtggtatgtgctgctgtggggggttcaattagtatggaagagggagacgctgctggtgctggagtctttttcgctttagtgttttgtttaaaactatgtatgaccctgtcatattatttgtcatccttgactcttatattctgccataacgcatgtatcctgcaatcagcctgcagcactggtatttgttccgagtaaaacctgtttactct

SEQ ID NO: 4949 - DNA, 1461 bp, Ostreococcus lucimarinus
cgcgtttgaaacgcacgaccgcaccctaacgcacccacaaaagcacacgaaagaaacgcataaatcatgtctggagaaggcggattcgacgacgcgaactacgatcgcggcatggaggaactcctcaaggatgaccaggatgagaacggagagggtggcatcacggagtggaccgaggtgcacgaaacgttcgatacgatgaacttgcaagagaacttgttgcgcgggatctacgcgtatggtttcgaaaagccgtctgctattcagcaacggggcatcgtgccgttttcgaagggcttcgacgtcattcagcaagcgcaatccggtacgggtaagacggcgactttctgcgctggtatcttgcaaagcttggattactccgttcacgagtgccaagcgctcgttttggcgccgacccgcgagttggcgcagcagattgaaaaggttatgcgcgccttgggcgactaccttcaagtcaagtgccacgcgtgcgtcggtggtacctccgtccgcgaagacacccgcatccttcaagccggtgtgcacgtcatcgtcggtaccccgggtcgggtgtacgatatgcttcgtcgacgcgcgttgaagagcgattctatcaagattttcgctctcgatgaagccgatgaaatgctttcccgcggtttcaaggatcaaatttacgacattttcaccttgctcccgccgaaggtgcaagttggtgttttctccgcgacgctcccgccggaagcgctcgagatcacgcgcaagttcatgaccaagccggtgcgcattttggtcaagcgtgatgagctcacccttgaaggtatcaagcagttctacgtcaacgtcgacaaggaacaatggaagttggacacgttgtgcgacttgtacgagacgctcgcgattacgcagtccgtcatcttcgccaacacccgccgcaaggtcgactggctcacggataacatgcgagcccgcgatttcaccgtctccgccacgcacggtgacatggaccaaaacactcgtgacgtcattatgcgcgagttccgctctggttcttcccgcgtgttgatcaccaccgatttactcgcccgtggtatcgacgtccagcaagtttccttggtcatcaactatgacttgcccacgcaacccgaaaactaccttcaccgtatcggtcgttccggtcgtttcggtcgtaagggtgtttccatcaactttgttaccgccgaagacgaacgtctcctccaagacatccaacgtttctaccaaacggtcatcgaggaacttccctccaacgtcgccgatctcatctaaggtgcaagcctccatagtagagatgaagcttcgcgacagagcggccagttccgctgtcctactgcacgtgcattaaatccaaactcgtgcgctctcgcttttcagagccatccattagcccggttcgcgcacaaagtgaaatatcgagtgtta

SEQ ID NO: 4950 - DNA, 1437 bp, Pseudoroegneria spicata
  misc_feature (5)..(6): n is a, c, g, or t
  misc_feature (8)..(9): n is a, c, g, or t
  misc_feature (1073)..(1073): n is a, c, g, or t
aagcnntnngccatccaacaaaggggaatcgttcctttctgcaaggggcttgatgttatccagcaggcacaatctggaacaggaaagactgctaccttctgctctggaatccttcaacagcttgactatggtttggttgagtgccaggccttggtccttgctcccacccgtgagcttgcacagcaaattgagaaggtcatgcgtgcacttggtgactacttgggtgtgaaggttcatgcatgtgttggaggaacttcagttcgtgaggaccaaaggattcttgcaagtggagtgcatgtcgttgttggtactcctggtcgtgtgtttgacatgctccgtaggcagtctctgcgccctgacaacatcaagatgtttgtcctcgatgaagctgatgagatgctttcccgtggtttcaaggatcagatttatgacatcttccagctgctcccagggaagattcaagttggtgtcttctctgctaccatgccccctgaagcccttgagattacccgcaagttcatgaacaagcctgtgaggatccttgttaagagggatgagctcacccttgagggtatcaagcagttctatgtcaatgtggagaaggaagagtggaagctcgacacactgtgtgacctgtacgagactctcgccatcacccagagtgtcatcttcgtgaacacccgccgcaaggtggactggctcacagacaagatgaggggcagggaccacaccgtttccgctactcacggagacatggaccagaacactagggacatcatcatgagggagttcagatcaggttcttcacgtgtgctcatcaccactgacctgcttgctcgtggtattgatgtccagcaagtgtccctggtcatcaactatgacctcccgacccagccagagaactacctgcatcgcatcggtcgtagtggtcggtttggaaggaagggtgtggccatcaactttgtgacccgtgaagatgagaggatgctgtttgacatccagaagttctacaacgtggtgattgaagagctcccagccaacgttgccgaccttctgtgatcgggcgggctgtngagaacatatggtaaggggggtcctgacagggctttgtttttgttgaaatatcaccagctttcttgtctgtggggaggggttcaagtgataaatggtctggggttctactttaaagtcgtggtcgtggacaatttgggatttattaagccatgttttgggaatttttgtagttgctaggctgtggttctatgtgctgaggagggaggcgccgctgctcatgttgctgttgctggagtcctcactttatttgttaagactatgtaatgaccgaatgatgttatttgtttgtgtcatcctcgactctttacctacagcatgtaatcctgcaatcggtactagtaatgctatcgttattcttgtgca

SEQ ID NO: 4951 - DNA, 1445 bp, Saccharum officinarum
attcagcagagaggaattgttcccttctgcaagggtcttgatgtcattcagcaagcacaatctggtacaggaaagacagcaactttctgttctgggatcttgcagcagctcgactatggcctggttgaatgccaggccttggtcctcgctcccacccgtgagcttgcacagcaaattgagaaagtcatgcgcgcacttggtgactacctgggtgttaaggtccatgcatgtgtgggaggaacatctgtccgtgaggaccaaaggattcttgccagtggtgtgcatgtagttgttggtacacctggtcgtgtttttgacatgctgcgtaggcagtccctccgccctgataacatcaagatgtttgttcttgatgaagctgatgaaatgctttctcgtggtttcaaggatcagatttatgacatcttccagcttctcccagccaagattcaggttggagtcttctctgctaccatgcctccggaggcccttgagattacccggaagttcatgaacaagccagtgagaatccttgtgaagagagatgagctgacccttgagggtatcaagcagttttatgtgaatgtggagaaggaagactggaagctggacacactgtgtgacctctacgagaccctggccatcacccagagtgtcatcttcgtcaacacccgccgcaaggtggactggctcactgacaagatgaggagcagggaccacactgtttctgccactcatggtgacatggaccagaacaccagagacatcatcatgagggagttccgatctggttcttcccgtgtgctcatcaccaccgacctgcttgctcgtggtattgatgttcagcaggtttccctggtcatcaactatgatcttcccacccagccagagaactacctgcatcgcattggtcgtagtggtcgtttcggtaggaagggtgttgccatcaactttgtgacccgcgatgacgagcggatgctgtttgacatccagaggttctacaacgtggtgattgaggagctgcctgccaatgttgctgaccttctgtgatcattttgaagaaaaacaaaactaaaaaaaaggtggtgaggggacatggtaaggcttggttttgtcgaaatatcgtggggaaggagtgatgatgtcggtggggtttctatgttaaagtcgtggtcatggacaagttgcgatttttctttatgccatgttttgggaatttttgtagctgcctaggcgttgtggtatgtgctgctgtgggggtcattagtatgaagaggaagacctgctggcgctggagtctttttctctttattagtattttgtttaaaactatgtatgaccgaatgatggtatttatttgtgtcatccttgactcttattctgctgcaaccagatgtatcatgccatgtgtctgcagcacaggtccttgttcagagtaaaacctgttt

SEQ ID NO: 4952 - DNA, 871 bp, Solanum phureja
ccatacttaagtgtctgcaatagccaaaaagcaagtaaaaactcaaacaagtgttttttaattttgatcaaagatggcacaatacggcaaccaagaccaaatgcgcaagactgatgaatatggaaaccatgtccaagaaactggaactcatcaaggtaccggtatgggaggcatgcaggctggtactggtggtatgatggggggcatgggtactggcggtatgggtggcactcaaggtagcggtaccggtatgggtatgggtactggtacccatcaccatgaggggcaacagcagcttcgtcgatccgacagctctagctcgtcggaggatgatggagaaggtgggaggagaaagaaggggatgaaggagaagataatgcagaagatgccaggaggaggacatggccagcaggaaggacaaacaacaggtgaaggagctggagagaagaaaggaatgatggacaaaatcaaggacaagatccctgggatgcattgagaatacacacacctttgttttcatttccatcttatcttatcaataagtacggtctaaaaattagtgcttgattttatttcatgcactaattactagtaatcgtcatgtgagtaattatctaattacgtacgttgtgtgtttaaagtcgtgtaagggcagtgtgctcacgctatatatatgtgtgtattggcggccatgccctgccccttctgtatttttaaagaagaatattgcttccatatgcttggaaagcaatgatcgatgtccatatgcatcatgttaatgtgtgttgtgatgtcccgtacgtgtttaataatgataatatagtttgagtttaagttgtgttatatatatatatacatttcttttcagttc

SEQ ID NO: 4953 - DNA, 833 bp, Solanum tuberosum
agtgtctgcaatagccaaaaagcaagtaaaaactcaaacaagtgttttttaattttgatcaaagatggcacaatacggcaaccaagaccaaatgcgcaagactgatgaatatggaaaccatgtccaagaaactggaactcatcaaggtaccggtatgggaggcatgcaggctggtactggtggtatgatggggggcatgggtactggcggtatgggtggcactcaaggtagcggtaccggtatgggtatgggtactggtacccatcaccatgaggggcaacagcagcttcgtcgatccgacagctctagctcgtcggaggatgatggagaaggtgggaggagaaagaaggggatgaaggagaagataatgcagaagatgccaggaggaggacatggccagcaggaaggacaaacaacaggtgaaggagctggagagaagaaaggaatgatggacaaaatcaaggacaagatccctgggatgcattgagaatacacacacctttgttttcatttccatcttatcttatcaataagtacggtctaaaaattagtgcttgattttatttcatgcactaattactagtaatcgtcatgtgagtaattatctaattacgtacgttgtgtgtttaaagtcgtgtaagggcagtgtgctcacgctatatatatgtgtgtattggcggccatgccctgccccttctgtatttttaaagaagaatattgcttccatatgcttggaaagcaatgatcgatgtccatatgcatcatgttaatgtgtgttgtgatgtcccgtacgtgtttaataatgataatatagtttgagtttaagttgtgtt

SEQ ID NO: 4954 - DNA, 1570 bp, Pseudoroegneria spicata
cttcctccccctcgccgtccgcgtgtccgtccaacagaggctgggaactttaaagcggaacagggttcatggagggtggaggcgcaagaaatgtttctgcagcggcagcacagacaaagggaagtgcggatgatggctcccacaagccactgcctccttgctgtgtcaaggcacaggctgctgtgccggaatctgaggccaagtgccacgctactgtggtgtctgggtggttcacaggaacccgctcacgctctggtaaaccaagcaaagcgcagtacttcaacaatccaatgtggcctggggaggctcattcgttgaaagtagagaaaattttgtaccaggggaaatcgccataccaagaagttttagtattcgagtcttcaacctatgggaatgtccttgtgcttgatggaattgttcagctgactgacaaggatgaatgtgcataccaggaaatggttactcaccttgcactgtgctcaattccatctcctaaaaatgttttggttgtcggaggtggtgatggtggtgtactacgagaaatagccaagcatgattcagtggagagtatagacatatgtgagattgatcagctagttattgatgtttgtaaagattttttcccacgtctatatgttggatataaagaccctcgtgtcagacttcatgttggtgatgctgtggagttcttgagaaattctccagaaggaaaatacgatgccattattgttgattcatcagatccaattgggccagctcaggaacttgtggagaagccctttttttcagacaattgctagggctttaaagcctggcggtgttctttctaatctagctgaaagtatgtggctgcacacacatctaatccaggatatgctttcgatctgtcgggaggtattcaagggtggtgtgcactacgcctgggcaagtgttccaacatatcctagtggtgtcattggatttttgctatgcgcgaaggaaggtccaccggtggacttcttgactcctgtgaatccaatcgagaaaattgaaggagctactaaagatggacgagagatgagattttacaattcagagattcatagtgctgcttttattctgccaacgtttgtaaagagggagctggaggcatataacagttccactgaaaaggagaaacaggagaagccaacggcaaaaccagtgaagatgaaggtaatgcgggacagcgcaattaccgcttcctagactgcaggcagacacccgtatgctatccatcttccccgacaagacccgccgcgctgtatatccacgttccatgcttgtcctttactaccaagttttatttcagtagttacatgattgtgtggtgctctagcatagttgcgtggcagaactgagagtagaatgtcacttagtgtgtatggtgtgttgcagttggtgaataaaggagcgaacataagggaatgtgtgatgtgtcaccctgatctgtaacatgtatgatgtttcattgctacgtgagctctcgtggtgcatgtaccaggaccggctatgttatgagcttctgacatatcacctttgttccgaatta

SEQ ID NO: 4955 - DNA, 1549 bp, Triticum aestivum
ctcccagcagcggcacgtcgtcatcttcctccccctcgccgtccgcgtgtacgtccaacagaggctgggaactttaaagcggaagagggttcatggagggtggaggcgcaagaaatgtttctgcagcggcagcacagacagagggaagtgcggatgatggctcctgcaagccactgcctccttgctgtgtcaaggcgcaggctgctgtgccggaatctgaggccaagtgccacgcaactgtggtgtccgggtggttcacaggaacccgctcacgctctggtaaaccaagcaaagcgcagtacttcaacaatccaatgtggcctggggaggctcattcgttgaaagtagagaagattttgtaccaggggaaatcgccataccaagaagttttagtattcgagtcttcaacctatgggaatgtccttgtgctcgatggaattgttcagctgactgacaaggatgaatgtgcataccaggaaatggtcactcaccttgcactgtgctcaattccatctcctaaaaatgttttggttgtcgggggtggtgatggtggtgtactacgagaaatagccaagcatgattcagtggagactatagacatatgcgagattgatcagctagttattgatgtttgtaaagattttttcccacgtctgtatgttggatataaagaccctcgtgtccgacttcatgttggtgatgctgtggagttcttgagaaattctccagaaggaaaatacgatgccattattgttgattcatcagatccaattgggccagctcaggagcttgtggagaagcccttctttcagacaattgctagggctttaaagcctggcggtgttctttctaatctagctgaaagtatgtggctgcacacacatctaatccaggatatgctttctatctgtcgggaggtattcaagggtggcgtgcactatgcctgggcgagtgttccgacgtatcctagtggtgtcattggatttttgctatgcgcgaaggacggtccaccggtggacttcctgactcctgtgaacccaatcgagaaaattgaaggagctactaaagatggacgagagatgagattttacaattcagagattcatagggctgcttttattctgccaacgtttgtaaagagggagctggaggcatatagcacttccactgaaaaggagaaaccggagaagccaacggcaaaaccagtgaagatgaaggtaatgcgggacagcgcaattaccgcttcctagaccgcctgtatgctatccatcttcccctacgagacccgccgcgctgtatatccatgttccatgcctgtcctttactaccaggttttatttcagtagttacatgattctgtggtgctctagcatagttgcgtggcagaactgagaacagaatgtcactgggtgtgtatggtgtgttacatttggtgaataaaggagcgaacaaaagtgaatgtttgatgcgttaccctgatctgtaacatgtatgatgtttcattgttacgtggactctcgtggttcaagtacccggacccgctttgtta

SEQ ID NO: 4956 - DNA, 1616 bp, Hordeum vulgare
gcggcacgtcgtcctcttccgccgtccgcgtgtacgtccaacagaggctgggaactttaaaggggaacagggttcatggagggtggaggcgcaagaaatgtttctgcagcggcagtacagacaaaggggactggggatgatggctcccgcaagccattgcctccttgctgtgtcaaggcgcaagctgctgtggcagaatctgaggccaagtgccacgctactgtggtgtccgggtggttcacaggaacccgctcgcgctctggtaaaccaagcaaagcgcagtacttcaacaatccaatgtggcctggggaggctcattcgttgaaagtagagaagattttgtaccagggaaaatcgccataccaagaagttttagtattcgagtcttcaacctatgggaatgtccttgtgcttgatggaattgttcagctgactgacaaggatgaatgtgcataccaggaaatggttactcaccttgcactgtgctcaattccatctcctaaaaatgttttggttgtcggaggtggtgatggtggtgtactaagagaaatagccaagcatgattcagtggagagtatagacatatgtgagattgatcagctagttattgatgtttgtaaagattttttcccacgtctatatgttggatataaagaccctcgtgtcagacttcatgttggcgatgctgtagagttcttgagaaattctccagaaggaaaatacgatgccattattgttgattcatcagatccaattgggccagcccaggaacttgtggagaagcccttttttcaggcaattgctagggctttaaagcctggcggcgttctgtctaatctagctgaaagtatgtggctgcacacacatctaatccaggatatgctttctatctgtcgggaggtattcaagggcggcgtgcactatgcctgggcaagtgttccaacatatcctagtggtgtcatcggatttttgctatgcgcgaaggaaggtccaccggtggacttcttgactcctgtgaatccaatcgagaagattgaaggagctactaaagatggacgagagatgagattttacaattcagagattcatagggctgcttttattctgccaacatttgtaaagagggagctggaggcatataacacttccactgaaaaggagaaactggagaagccaacggcgaaaccagtgaagatgaaggtaatgcgggacagcgctatcaccgcttcctagaccagggacaaacacccctatgttgtccatcttcccccacgagacccgccgcgctgtatatccacgttccacgcctgtcctttattaccaaattttatttcaataggtacatgattgtgtggtgctgcagcgtagttgcgtggcagaaccgagagtagagtgtcactgagtgtgtatggtgtgttgcagctagtgaataaaggagcggacagaagggaatctgtgatgcgttacctgatctgtgccatgtacgtatgatgtttcattgttacgtgagctctagtggtgcaagtaccaggaccggctatgagcttctgaaatatcacctttgttctgaagtataagacgtttgggatatttttaatatatacaacagaatgatc

SEQ ID NO: 4957 - DNA, 1606 bp, Hordeum vulgare
gcacgtcgtcctcttccgccgtccgcgtgtacgtccaacagaggctgggaactttaaaggggaacagggttcatggagggtggaggcgcaagaaatgtttctgcagcggcagtacagacaaaggggactggggatgatggctcccgcaagccattgcctccttgctgtgtcaaggcgcaagctgctgtggcagaatctgaggccaagtgccacgctactgtggtgtccgggtggttcacaggaacccgctcgcgctctggtaaaccaagcaaagcgcagtacttcaacaatccaatgtggcctggggaggctcattcgttgaaagtagagaagattttgtaccagggaaaatcgccataccaagaagttttagtattcgagtcttcaacctatgggaatgtccttgtgcttgatggaattgttcagctgactgacaaggatgaatgtgcataccaggaaatggttactcaccttgcactgtgctcaattccatctcctaaaaatgttttggttgtcggaggtggtgatggtggtgtactaagagaaatagccaagcatgattcagtggagagtatagacatatgtgagattgatcagctagttattgatgtttgtaaagattttttcccacgtctatatgttggatataaagaccctcgtgtcagacttcatgttggcgatgctgtagagttcttgagaaattctccagaaggaaaatacgatgccattattgttgattcatcagatccaattgggccagcccaggaacttgtggagaagcccttttttcaggcaattgctagggctttaaagcctggcggcgttctgtctaatctagctgaaagtatgtggctgcacacacatctaatccaggatatgctttctatctgtcgggaggtattcaagggcggcgtgcactatgcctgggcaagtgttccaacatatcctagtggtgtcatcggatttttgctatgcgcgaaggaaggtccaccggtggacttcttgactcctgtgaatccaatcgagaagattgaaggagctactaaagatggacgagagatgagattttacaattcagagattcatagggctgcttttattctgccaacatttgtaaagagggagctggaggcatataacacttccactgaaaaggagaaactggagaagccaacggcgaaaccagtgaagatgaaggtaatgcgggacagcgctatcaccgcttcctagaccagggacaaacacccctatgttgtccatcttcccccacgagacccgccgcgctgtatatccacgttccacgcctgtcctttattaccaaattttatttcaataggtacatgattgtgtggtgctgcagcgtagttgcgtggcagaaccgagagtagagtgtcactgagtgtgtatggtgtgttgcagctagtgaataaaggagcggacagaagggaatctgtgatgcgttacctgatctgtgccatgtacgtatgatgtttcattgttacgtgagctctagtggtgcaagtaccaggaccggctatgagcttctgaaatatcacctttgttctgaagtataagacgtttgggatatttttaatatatacaacag

SEQ ID NO: 4958 - DNA, 1869 bp, Brachypodium distachyon
atggccgcctatttaaccccgctcctcctcttctcgcccgccgcatccactttctcccagtcccagcagcgaaattattctgttgctgtcggtgctggtgatccaggaacagcgagggtgtgtctttacattatttattcatccgtcaaggggctttgtagaattgggtcacgagcaggtgtttcctgttgcctcttcttcttctccttcttgccttcttcaaaaaataagaactcaaccgcaaccgcaaatcgagcgttacccaatcaaagttgcacccagtccctggcattggcctacactgggagcagagtgactgaggctgggaaccttaaaccagaacaagcttcatggaagatggaggtgcaagaaatgtttctgcagctgcagcacaaacaaagagtggggatgatggcacatccaagccactgcctccttgctgcatcaaggcgaaggctgctgcagcagaatctgaggctaaatgccacgctacagttgtatctgggtggttcacagaaccccgctcacgctttggtaaaacaagcaaagtgcagtacttcaacaatccaatgtggcctggagaggcccattcattgaaagtagagaagattttgttccagggaaaatcaccttaccaagaaattttagttttcgagtcttcaacctatgggaatgtccttgtgcttgatggtattgttcagctgactgacaaggatgaatgtgcataccaggaaatggttactcaccttccactatgctctattccatccccaaaaaatgttttggttgttgggggtggtgatggtggtgtactacgagaaatagcgaagcatgattcagtgcagactatagacatatgtgagattgatcagctggttatcaatgtttgtaaagattacttcccacatttatatgttggatatgaagatcctcgtgtccagcttcatgttggtgatgctgtggatttcttgaggaatgctcctgaagggaaatatgatgccattattgttgattcgtcagatccaattgggccagctcaggaacttgtggagaagccctttttccaaacaattgctagagctttaaagccaggtggtgttctttgtaatctagccgagagtatgtggctgcacacacatctaatccaggatatgctctctatctgtcgtgagacattcaagggtgccatccactatgcctggacaagcgttccaacatatcctagtggtgtcattgggttcctgctatgcgcaaaggaaggtccaccagtgaacttcttgactcctgtgaatccaattgagaaactggtaggagatacaatagctggaaaggaaatgagattttacaactcagagattcatagggctgcttttattctgccaacatttgtgaggaaggaactggaggcacatagcatttctaccaaaaaggagaaaccagagaagccagccatgaaaccagtccagatgaatataatgccagacagcgccatcctgagctcctgagtgcttcctacccccggggacagcggcatattctattatcatcttcctcgacgaaccacgccgtatatatccatgttgtcatctggccaatagaaaattatcacagaaatgatatgatattgtggcgctgtagcataagcaaaccacgccgtatatatccatgttgtcatctggccaatagaaaattatcacagaaatgatatgatattgtggcgctgtagcataagcatagttgtatcacagtactgagtgtagaatgtcatcgagtatatatatggtatgttgtggttgagtgaataaagtgggagcaaaacggatgtgtgatcaaataatgtattccccaaagctgaaatccctgcttgtg

SEQ ID NO: 4959 - DNA, 1611 bp, Oryza sativa
agctccctccctatttcttggtctcgtctcgtctcgtcgtcttctccctgctgctggtactgtgcgtgggccggagggcgagagtgaagcttgagccgtctcgccgcgggcgctgctgctgctgctgctgctcgcgtccgattccgacgagaggctgggaacttcaaagctgaaaaggactaatggagggtggaggcgcaaaagatggttctgcagcggcagcgcaaacaagggggagtggggatgatggttcccacaagccgctgccgccttgctgtctcaaggcgaaggctgcggcagcagagtctgaggcaaaatgccatgccacagtggtgtcagggtggttcacggaaccccgctcgcactctggtaaaacaagcaaagtgcagtacttcaacaatccaatgtggcctggagaagctcattctctgaaagtagagaatattctgtatcaagggaaatcaccataccaagaaatcttagtttttgagtcctcaacctatgggaatgttctggtgcttgatggtattgtgcagctgaccgaaaaggatgaatgtgcataccaggaaatggttactcaccttccactgtgctcgattccatcccccaaaagtgttttggttgtcggaggtggtgatggtggtgtgctacgagaaatagccagacatgcctcagtggagaacatcgatatatgtgaaatagaccagctagttattgatgtctgtaaagatttcttcccacaactatctgttggattcaaagatccccgtgttcaacttcatgttggtgacgctgtggatttcttgagaaatgcccctgaagggaaatatgatgctatcattgttgattcatctgacccaattgggccagctcaggagcttgtggagaagcccttttttcagacaattgctagagctctaaagcctggtggagttctatgcaatcaagctgagagtatgtggctgcacacacatctaattcaagatatgctttctatctgtcgtgaaacattcaagggagctgtgcattatgcctggacaagcgttcctacctatcctagtggtgtcattggttttttgctatgtgcgaaagaaggtccagcagtgaacttcctttctcctgtgaatccaattgagaaactggaaggagctatggaagctggaagggaaatcagattttacaattcagaggttcatcgggctgcttttgttctgccaacatttgtaaggagagaactggaatcacacaatacttgtgctgaaaaggataaatcagaaaccaagccagtcgcgaaaccaaagaagatgaaaataatgccgaatagtgccattccgactgcttcctagattcgggcggccatatgcgacaaccatgttcgacgtccttagctacagtatatgccaactataagaggagaatgtcgctgtaactcttctgtcttaagtatggtatgttatgcctgactgaataaaagggaggaacagatgagatgtgaaccaaaataatgttcttcctgatccgtgagcactgttgtagtgttgcctgttgtacaaatgtatattgtcacagcactgatgtgtttattatatggatgtggagtgaatcgcatgg

SEQ ID NO: 4960 - DNA, 1635 bp, Panicum virgatum
gtcctctcttgactcttcgtcttcctccccgcgggcggtaggggaagaaaagaaaccgcctctgctcgtgccatcgtgggctgttcccccgttcgaatccccacgaggttagaggcggagttccgggagaacccccgattgcctggttcctgcatccattggcggtttcttgctgatcgacgagactgggaccttcaaagagcaataggactcatggaggctggagacgcaggaaacggttctgcagcagtggcacagataaagggaagtggggatgatgcctactgcaaaccgctgcctccttgctgcgtcaaggccaaggcaggcgtgcctgaatctgaggccaagtgccatgatactgtggtttctggctggttcaccgaaccccggtcacgctttggtaaaacaagcaaagtgcagtactacaacaaccctatgtggcctggagaggctcattcactgaaagtggagaagattttgtaccaagggaaatcgccttaccaagagattttagttttcgagtcttcaacctatggaaacgttcttgtgcttgatggtatagttcagttgactgacaaggatgaatgcgcataccaggaaatggttactcaccttccactgtgctcaattccatcaccgaaaaatgttttggttgttggaggtggtgatggtggtgtactgcgggaaatagccagacatgattcagtggagactattgatatatgtgagattgatcagcttgttattgatgtttgcaaagaattctttccaaacttatccatggggtttaaagatccccgtgtccgacttcatgtcggtgatgctgttgatttcttgagggattctcctgaagggaaatatgatgctattattgttgattcatcagatccaattgggccagctcaggcacttgtggagaaaccatttattcagacaattgctagagctttaaaggccggtggtgttctttgtaatcttgctgagagcatgtggctgcacacacatctaatccaggatatgctctctatatgtcgtcagacattcaagggtggtgtgcactatgcctggacaagcgttccaacataccccagtggtgtcattggatttttgctatgtgctaaagaaggtccaccagtgaacttcttaactcctgtgaacccaattgagaaaatacaaggagctacaaaagctggaaaggaactcagattttacaattcagagattcatagggctgcttttgttctgccaacatttgtaagaagagaactggaatcatatactacttgtagtacttctactgaaaaggagaaaccaaaagaatcagtttcaaaatcgcagaagataaagattttgctgaacaatgccattcttacagcttcctaagcttgaatcatactcgatctacctctgagttctgacagaaaaaaccagttgctgagatgttagtgacgtgcgccaggagcattagtatatactgggtttgtgagtgatgactgattgaataatggggtaattgaactgctgtgatgcctaccggaataatgtgtttcccctttgtttcttgtgtttggtgtgcataatttcccaacttggaacttgtaagacctgttgatgtaatatagtccttgtttgcat

SEQ ID NO: 4961 - DNA, 1172 bp, Brachypodium distachyon
cccagtcccagcagcggtagcaggctgagcagaggatcctccttccgtcgccattcgcagaggctgggaaccttaaaccagaacaagcttcatggaagatggaggtgcaagaaatgtttctgcagctgcagcacaaacaaagagtggggatgatggcacatccaagccactgcctccttgctgcatcaaggcgaaggctgctgcagcagaatctgaggctaaatgccacgctacagttgtatctgggtggttcacagaaccccgctcacgctttggtaaaacaagcaaagtgcagtacttcaacaatccaatgtggcctggagaggcccattcattgaaagtagagaagattttgttccagggaaaatcaccttaccaagaaattttagttttcgagtcttcaacctatgggaatgtccttgtgcttgatggtattgttcagctgactgacaaggatgaatgtgcataccaggaaatggttactcaccttccactatgctctattccatccccaaaaaatgttttggttgttgggggtggtgatggtggtgtactacgagaaatagcgaagcatgattcagtgcagactatagacatatgtgagattgatcagctggttatcaatgtttgtaaagattacttcccacatttatatgttggatatgaagatcctcgtgtccagcttcatgttggtgatgctgtggatttcttgaggaatgctcctgaagggaaatatgatgccattattgttgattcgtcagatccaattgggccagctcaggaacttgtggagaagccctttttccaaacaattgctagagctttaaagccaggtggtgttctttgtaatctagccgagagtatgtggctgcacacacatctaatccaggatatgctctctatctgtcgtgagacattcaagggtgccatccactatgcctggacaagcgttccaacatatcctagtggtgtcattgggttcctgctatgcgcaaaggaaggtccaccagtgaacttcttgactcctgtgaatccaattgagaaactggtaggagatacaatagctggaaaggaaatgagattttacaactcagagattcatagggctgcttttattctgccaacatttgtgaggaaggaactggaggcacatagcatttctaccaaaaagg

SEQ ID NO: 4962 - DNA, 1572 bp, Panicum virgatum
ggcccctccgctccatttccgatccaccgcgctgggccgcttgtcatcgttgccctcgccgccgtcgtgcccagagactgggaccttcaaagagcaacaggactcatggaggctggagacgcaggaaacggttctgcagcagcggcacagataaagggaagtggggatgatgcctcctgcaaaccgctgcctccttgctgcgtcaaggccaaggcaggcgtgcctgaagctgaggccaagtgccatgataccgttgtttcaggctggttcactgaaccccagtcgcgcttcggtaaaacaagcaaagtgcagtactacaacaaccctatgtggcctggagaggctcattcactgaaagtggagaagattttgtaccaagggaaatcaccttaccaagagattttagtttttgagtcttcaacctatggaaacgttcttgtgcttgatggtatagttcagttgactgacaaggatgaatgcgcataccaggaaatggttactcaccttccactgtgctcaattccatcaccgaaaaatgttttggttgttggaggtggtgatggtggtgtactgcgggaaatagccagacatgattcagtggagactattgatatatgtgagattgatcagcttgttattgatgtttgcaaagaattctttccaaacttatccatggggtttaaagatcctcgtgtccgacttcatgtcggtgatgctgttgatttcttgagggattctcctgaagggaaatatgatgctattattgttgattcatcagatccaattgggccagctcaggcacttgtggagaaaccatttattcagacaattgctagagctttaaagcctggtggtgttctttgtaatcttgctgagagcatgtggctgcacacacatctaatccaggatatgctctctatatgttgtcagacattcaagggtggtgtgcactatgcctggacaagcgttccaacataccccagtggtgtcattggatttttgctatgtgctaaagaaggtcgaccagtgaacttcttagctcctgtgaacccaattgagaaaatacaaggagctacaaaagctggaaaggagctcagattttacaattcagagattcatagggctgcttttgttctgccaacatttgtaagaagagaactggaatcatatactgctactaagacttctactgaaaaggagaaaccaaaagaatcagtttcaaaatcgcagaagataaagattttgccgaacaatgccattcttacagcttcctaggcttgaatcatactcgatctacctctgagttctgatgtatccaagccggagtcgtgtatagttgtattcttacagagaaaaaccagttgctgagatgttagtgacgtggcgccaggagcataagtatatactgggtttgtgagtgatgactgattgaataatgggggaattgaattgctgtgatgcctaccggaataatgtgttcccctctgtttctgttgtttggtgtgcataatttcccaacttggaacttgtaagacctgttgatgtaatatagtccttgtttgcatctgtcct

SEQ ID NO: 4963 - DNA, 1683 bp, Panicum virgatum
cagattcctagagacccccacaaaaaggaaagaggggaagagagaggggcgacgcaggcgttccagagaaaagagaatacacccccacccccaccgtccaccggcgtggcgcggcgcccgccactcctgctccccttcctctatttcttccgcccccgcgccgccgcctccccgctcctctccccatccccgtcccgccccgccattcgcgccccagaggctgggaactccaaagaggaacagggtccatggagggtggaggcgcaggaaatggtttcactgggacggcgcagacaaaggggactgggggtgatggctccgccaagccgctgcccccttgctgcgtcaaggccagggccgcggcggctgagtctgaggccaagtgtcatgctacagtggtgtcgggatggttcaccgaaccacggtcacgatgcggtaaagcaagcaaagttcaatactacaataacccgatgtggccaggagaggcccactccttgaaagtggagaagatcttgtaccaggggaagtcaccataccaagaagtcttagtttttgagtcgtcaacctatggtaaagtccttgtgcttgatggcattgttcagttgactgataaggatgaatgcgcgtaccaagaaatgattactcacctcccactttgttccatttcatcccctaaaaaagttttagttattggtggtggtgatggtggtgtactccgagagatttccagacatagttctgtggagtctattgacatatgtgaaattgatcagctggttattgatgtttgcaaagatttcttcccacaactgtctgttggatttgaagatcctcgtgttcaacttcatgttggtgatgctgtggagttcttgagaaatgctcctgaaggtacatatgacgctattattgttgattcatcagacccaatagggcctgctcaggaacttgtggagaagcctttttttgatacaattgctagagccttgaggcctggtggagttctttgtaatcaagctgagagtatgtggttgcatacacatctgattcaggatatgctttcaatttgccatgagactttcaagggttctgtgcactatgcatggactagtgtcccaacatacccgagtggagtgattgggtttttgctatgtgccaaagaaggcccaccggtcaacttcctgactcctataaatccaattgaaaaacttgagggagctacaaaagctggaagggagatcagattttataattcagagatgcatagggcagcatttgttcttccgacctttgtgaaaaaagagctagaagcgtattgcgtttccaccggaagggaagagccagaggaaacagctgcaacagcaccgaagattactgttacttcgaagagcgaaattctcactgcatcctagaccagggctcacgacccatcatgcgatatcaagaaatagttccttcccggccctcttgggtatccagtggataaactcagcaatgtaccatcccatattgtaaccatctgttaataattcatgctctgaatgatgagatgagattagcatgttctgaagagaaaagacgagctggcagtgcaatgtatgatttgagcgatgaacatttcaaattgcatgccccctacttttttgccgagcggtgtgctgtactggtatttggtggccatttctc

SEQ ID NO: 4964 - DNA, 1628 bp, Sorghum bicolor
actccactccgttccggtgcatcgtcttcgccgatcgttccaagagactgggaccttcaaagagcaataggactcatggaggttggagacgcaagaaacggttctgcagcagcggcacagacaaagggaagtgcggatgatgccgcccgcaaaccgctccctccttgctgcgtcaaggccaaggcaggcgtgcctgaatccgaagccaagtgccatgatactgtggtctcagggtggttcactgaacccagatcgcgttttggcaaaacaagcaaagtgcagtacttcaacaacccgatgtggcctggagaggctcattcactgaaagtggagaagattttgtttcaagggaaatcgccttaccaagaaattttagtttttgagtcttcaacctatggaaatgttcttgtgcttgatggtatagttcagttgactgacaaggatgaatgcgcataccaggaaatggttactcaccttccactgtgctcaattccagcaccgaagaatgttttggttgttggaggtggtgatggtggtgtactgcgggaaatagccagacatgattcagtggatactattgatatatgtgagattgatcaattggttattgatgtttgcaaagaattctttccaaacatatccattggatataaagatcctcgtgtccgacttcatgttggtgatgctgttgacttcctgaggaattctcctgaaggaaaatatgatgctattattgtcgattcatcagatccaattgggccagcacaggcactcgtggagaaaccatttattcagacaattgctagagctttgaagcctggtggtgttctttgtaatcttgctgagagcatgtggctgcacacacatctaatccaggatatgcttgctatctgtcgacagacattcaagggtgccgtgcactatgcctggacaagtgttccaacatatcccagtggtgtcattggatttttgctatgtgcgaaagaaggtcgtgaagtgaacttcttaagtcctgtgaatccaattgagaaaataggagctggaaaagctggaagggagctcagattttacaattcagagattcatagggctgcttttgttctgccaacatttgtaagaagagaactggaatcatatgccactcctagtacttatgctgaaaacgagaaaccgaaagaatcagtgtcagaaccgcagaagataaagatattgtcaaacaatgccattcttacagcttcctaggcctgagccatgctctatcttgctcggtatagttgtattctcacagaataaatcagtcactggattttgttgacaccgcacgagcagctttggtatagtgacttgagtgatgatcgattgaataaggggtggatattgaactaatgcaatgcctgccggaacaattaatatgttccctatcttgttagctagcctgctgtttgttgtgcacaatttcacctgtaagttatgacttgtatgacccgttgatgtataatagaccttgcaaactgtgaaaaaattgtcaactgatgtgaatgatgtacaaaaaaaaaagatggccaataatggaggtgctatctgctgttcactttgcccctaagactacatgctttgaaattaggatt

SEQ ID NO: 4965 - DNA, 1596 bp, Sorghum bicolor
attctgctcttgcctgacttgtatacgttatttgtcgactgtcgagccagagactgggaccttcaaagagcaataggactcatggaggttggagacgcaagaaacggttctgcagcagcggcacagacaaagggaagtgcggatgatgccgcccgcaaaccgctccctccttgctgcgtcaaggccaaggcaggcgtgcctgaatccgaagccaagtgccatgatactgtggtctcagggtggttcactgaacccagatcgcgttttggcaaaacaagcaaagtgcagtacttcaacaacccgatgtggcctggagaggctcattcactgaaagtggagaagattttgtttcaagggaaatcgccttaccaagaaattttagtttttgagtcttcaacctatggaaatgttcttgtgcttgatggtatagttcagttgactgacaaggatgaatgcgcataccaggaaatggttactcaccttccactgtgctcaattccagcaccgaagaatgttttggttgttggaggtggtgatggtggtgtactgcgggaaatagccagacatgattcagtggatactattgatatatgtgagattgatcaattggttattgatgtttgcaaagaattctttccaaacatatccattggatataaagatcctcgtgtccgacttcatgttggtgatgctgttgacttcctgaggaattctcctgaaggaaaatatgatgctattattgtcgattcatcagatccaattgggccagcacaggcactcgtggagaaaccatttattcagacaattgctagagctttgaagcctggtggtgttctttgtaatcttgctgagagcatgtggctgcacacacatctaatccaggatatgcttgctatctgtcgacagacattcaagggtgccgtgcactatgcctggacaagtgttccaacatatcccagtggtgtcattggatttttgctatgtgcgaaagaaggtcgtgaagtgaacttcttaagtcctgtgaatccaattgagaaaataggagctggaaaagctggaagggagctcagattttacaattcagagattcatagggctgcttttgttctgccaacatttgtaagaagagaactggaatcatatgccactcctagtacttatgctgaaaacgagaaaccgaaagaatcagtgtcagaaccgcagaagataaagatattgtcaaacaatgccattcttacagcttcctaggcctgagccatgctctatcttgctcggtatagttgtattctcacagaataaatcagtcactggattttgttgacaccgcacgagcagctttggtatagtgacttgagtgatgatcgattgaataaggggtggatattgaactaatgcaatgcctgccggaacaattaatatgttccctatcttgttagctagcctgctgtttgttgtgcacaatttcacctgtaagttatgacttgtatgacccgttgatgtataatagaccttgcaaactgtgaaaaaattgtcaactgatgtgaatgatgtacaaaaaaaaaagatggccaataatggaggtgctatctgctgttc

SEQ ID NO: 4966 - DNA, 1396 bp, Zea mays
atcacccactacctctattccggtgcgccatcgctctcgtcctcgccgatcgatccaagagactgggaccttcaaagagcaataggactcatggaggttggagacgcaagaaacggttctgcagcagcggcactgacaaagggaggtgcggatgatgccgcccgcaaaccgctccctccttgctgcgtcaaggccaaggcgcgggtgcctgaaaccgaggccaactgccatgatactgtggtttcagggtggttcacggaacccagatcgcgttttggtaaaacaagcaaagtgcagtacttcaataacccgatgtggcctggagaggcccattcattgaaagtggagaagatcttgtttcaagggaaatcgccttaccaagaaattttagtttttgagtcttcaacctatggaaatgttcttgtgcttgatggtatagttcagttgactgacaaggatgaatgcgcataccaggaaatggttactcaccttccactgtgctcaattcctgcaccgaagaatgttttggttgttggaggtggtgatggtggtgtactgcgcgaaatagccagacatgattcagtggaaactattgatatatgtgagattgatcaactagttattgatgtttccaaagaattctttccaaacttatccattggattcaaagatcctcgtgtccgacttcatgttggtgatgctgttgatttcctgaggaattctcccgaaggaaaatatgatgctattattgtagattcatcagatccaattgggccagcacaggcactcgtggagaaaccgtttattcagacaattgctagagctttgaagcctggtggtgttctttgtaatcttgctgagagcatgtggctgcacacacatctaatccaggatatgcttgctatctgtcgacagacattcaaaggtgctgtgcactatgcctggacaagtgttccaacatatcccagtggtgtcattggatttttgctatgtgcaaaagaaggtcgtgcagtgaacttcttgactcctgcgaatccaattgagaaaatagaaggagcagcaaaagctggaagggaactcagattttacaattccgagatccatagggctgcttttgttctgccaacatttgtaagaagagaactggaagcatataccactcctattagttctgctgaaaacgagaaaccgaaagaatcagtgtcagaaccgcagaagataaagatattgtcaaacaacgccattcttacagcttcctagccctgagccgtactcaatcttgctcggtatagttgtattctcacagaataaatcagtcactggcttttgctgacaccgcacgagcagctttagtatagaatgatgatcgattgaataagagggtggatattgaact

SEQ ID NO: 4967 - DNA, 1686 bp, Sorghum bicolor
agattccaaagagggaaaagggggaaaaaaaggaaaaagacggggaggagtcgcaagttgcagagaatcccaccgccaccaccgagcaacgcgcgccggcgccccctctatttcttgagccctcgcgccgccgctctcctcctcctccacacctcgccctgcttcgccctcgcgcacctgccacctgaggctgggaactccaaagaggaacagggtccatggaggctggaggcgcaggaaatggtttgaatggggcggtgcagacaaaggggagtgggggtgatggctctgccaagccgctgcccccttgctgtgtcaaggcgagagccgccgcgcccgagtctgaggccaagtgccatgctactgtcgtttcaggatggttcactgaaccgcgatcacgatgtggtaaagccagcaaagttcaatattacaataacccgatgtggccaggagaggcccattctttgaaggtggagaagatcttgtaccaggggaaatctccataccaagaagtcctagtttttgagtcgtcaacctatgggaaagtccttgtgcttgatggtattgttcagttgactgacaaggatgaatgtgcataccaggaaatgattactcacctaccactctgttcaattccatcccctaaaaaagttttggttattggtggtggtgatggaggtgtacttcgagagatatccagacatagttcagtggagtctattgacatatgtgagattgatcagctagttattgatgtttgcaaagatcttttcccacacttgtctgttggatttgaagatcctcgtgttcaacttcatgttggtgatgctgtggaattcttgagaaatgctcctgaagggacatatgatgccatcattgttgattcatcagacccaatagggcctgctcaggaacttgtggagaagcctttttttgagacaattgctagagctttgaggcctggtggcgttctttgtaatcaagctgagagtatgtggttacatacacatttgattcaggatatgctttcaatttgtcgtgaaactttcaagggttctgtacgctatgcatggactagtgtcccaacttacccgagtggggtgattgggtttttactatgtgccaaagaaggtccatcggtcaactttctgactcctataaatccaattgaaaaggtggaaggagctacaaaagctggaagggagatcagattttataattcggagatgcatagggcagcatttgttcttccagcctttgcaaagagagagctagaagcatattttgcttccactgaaacagagcaggcagaggaaacagcggcgacacgactgaagttaactcttgcatcgaagagtgaaattctcactgcgtcctagaccgggactcagtgagctaccacaagatatcaagaatccattccttcctggcaccctacctccagtatcgccattggatagtcttgtagtatcacatgttataagcatcagcattgagggtgtggcatcgcgatttgacgcattatgaggcatcatgtgtcaataatttattcaccagacagtgacatgaggttggcatgctaaggaaaagacgagctgacaggaatgtatgatatgagtgtgtgacgtgatgagcattccacgtgcatttaacttttagaattttggtggtgtgttgcgccggtat

SEQ ID NO: 4968 - DNA, 1591 bp, Sorghum bicolor
cccaccgccaccaccgagcaacgcgcgccggcgccccctctatttcttgagccctcgcgccgccgctctcctcctcctccacacctcgccctgcttcgccctcgcgcacctgccacctgaggctgggaactccaaagaggaacagggtccatggaggctggaggcgcaggaaatggtttgaatggggcggtgcagacaaaggggagtgggggtgatggctctgccaagccgctgcccccttgctgtgtcaaggcgagagccgccgcgcccgagtctgaggccaagtgccatgctactgtcgtttcaggatggttcactgaaccgcgatcacgatgtggtaaagccagcaaagttcaatattacaataacccgatgtggccaggagaggcccattctttgaaggtggagaagatcttgtaccaggggaaatctccataccaagaagtcctagtttttgagtcgtcaacctatgggaaagtccttgtgcttgatggtattgttcagttgactgacaaggatgaatgtgcataccaggaaatgattactcacctaccactctgttcaattccatcccctaaaaaagttttggttattggtggtggtgatggaggtgtacttcgagagatatccagacatagttcagtggagtctattgacatatgtgagattgatcagctagttattgatgtttgcaaagatcttttcccacacttgtctgttggatttgaagatcctcgtgttcaacttcatgttggtgatgctgtggaattcttgagaaatgctcctgaagggacatatgatgccatcattgttgattcatcagacccaatagggcctgctcaggaacttgtggagaagcctttttttgagacaattgctagagctttgaggcctggtggcgttctttgtaatcaagctgagagtatgtggttacatacacatttgattcaggatatgctttcaatttgtcgtgaaactttcaagggttctgtacgctatgcatggactagtgtcccaacttacccgagtggggtgattgggtttttactatgtgccaaagaaggtccatcggtcaactttctgactcctataaatccaattgaaaaggtggaaggagctacaaaagctggaagggagatcagattttataattcggagatgcatagggcagcatttgttcttccagcctttgcaaagagagagctagaagcatattttgcttccactgaaacagagcaggcagaggaaacagcggcgacacgactgaagttaactcttgcatcgaagagtgaaattctcactgcgtcctagaccgggactcagtgagctaccacaagatatcaagaatccattccttcctggcaccctacctccagtatcgccattggatagtcttgtagtatcacatgttataagcatcagcattgagggtgtggcatcgcgatttgacgcattatgaggcatcatgtgtcaataatttattcaccagacagtgacatgaggttggcatgctaaggaaaagacgagctgacaggaatgtatgatatgagtgtgtgacgtgatgagcattccacgtgcatttaacttttag

SEQ ID NO: 4969 - DNA, 1738 bp, Sorghum bicolor
ctcccatccgcccctgcgcgcgcgcgctctctcccccctttctcgcgcggcaaccgggccgccgccgccgccgccgccctacctcaggtgcccaggtcttcttcgttcgctccaccagccgccaggtcttcgtaggcccattcccccgctcttcgtcggctccttcaatccgccggcgacgagcacccatcagaggctgggaactccaaagaggaacagggtccatggaggctggaggcgcaggaaatggttcgaatggggcggcgcagacaaaggggagtgggggtgatggctccaccaagacgccgccgccacttcccccttgctgtgtcaaggcgagagccgcggcacctgagtctgaggccaagtgccatgccaccgtggtttcgggatggttcaccgagccacgatcacactgcggtaaagccagcaaggttcagtattacaataatccaatgtggccaggagaggcccattccttgaaagtggagaagatattgtaccaggggaaatcaccataccaggaagtcctagtctttgagtcgtcaacctatgggaaagtccttgtgcttgatggtattgttcaattgaccgataaggatgaatgtgcataccaggaaatgattactcacctccctctttgttcaattccatcccctaaaaaggttttggttattggtggtggtgatggaggtgtacttcgagagatttccagacatagttcagtggagtccattgacatatgtgaaattgatcagctggttattgatatttgcaaagatttcttcccacatttgtctgttggatttgaagatcctcgtgttcaacttcatgttggtgacgccgtggagttcttgagaaatgctcctgaagggacatatgatgctatcattgttgattcatcagacccaatagggcctgctcaggaacttgtggagaagcctttttttgagaccatcgctagagctttgaggcctggtggtgttctttgtaatcaagctgagagtatgtggttgcatacacatttgattcaggacatgctttcaatttgccgtgagactttcaagggttctgtccgctatgcatggactagtgtcccaacatacccaagtggggtgattgggtttctgctatgtgccaaagaaggaccaccggtcaactttctgactcctataaatccaattgaaaaagtggaaggagctactaaagcaggaagggagatcagattttataactcagagatgcatagggcagcgtttgttcttccgacctttgcgaagagagagctagaagcatattgtgcttctacgtaaacagagcaggcagaggaggaaatagcgacaccaccaccaaagctaactgtggctccagagagtggaattctcagtgcatcctagcttagaccggcgtgactcagaaccgagacacgtctagaaaccgtcccttcacggcattccctagtatcgccaattggatacgctcttgctctatcacgtattgtaagcatggacatatggagtgtgtgtggggtgcattggaatttgacgcgtaatgaggcgctcatgtgttaataataatctatgctcctgtgttatggcaccaacaatgagatgacaaatggcatggtaaggaaaagacgaacagtgtgatgagtctgacgtgatgagcaaattccacattgcactttacccatcctttttcgcattttgttggtgacgttgtgtgttgggctattatt

SEQ ID NO: 4970 - DNA, 1691 bp, Sorghum bicolor
ctcccatccgcccctgcgcgcgcgcgctctctcccccctttctcgcgcggcaaccgggccgccgccgccgccgccgccctacctcaggtgcccaggtcttcttcgttcgctccaccagccgccaggtcttcgtaggcccattcccccgctcttcgtcggctccttcaatccgccggcgacgagcacccatcagaggctgggaactccaaagaggaacagggtccatggaggctggaggcgcaggaaatggttcgaatggggcggcgcagacaaaggggagtgggggtgatggctccaccaagacgccgccgccacttcccccttgctgtgtcaaggcgagagccgcggcacctgagtctgaggccaagtgccatgccaccgtggtttcgggatggttcaccgagccacgatcacactgcggtaaagccagcaaggttcagtattacaataatccaatgtggccaggagaggcccattccttgaaagtggagaagatattgtaccaggggaaatcaccataccaggaagtcctagtctttgagtcgtcaacctatgggaaagtccttgtgcttgatggtattgttcaattgaccgataaggatgaatgtgcataccaggaaatgattactcacctccctctttgttcaattccatcccctaaaaaggttttggttattggtggtggtgatggaggtgtacttcgagagatttccagacatagttcagtggagtccattgacatatgtgaaattgatcagctggttattgatatttgcaaagatttcttcccacatttgtctgttggatttgaagatcctcgtgttcaacttcatgttggtgacgccgtggagttcttgagaaatgctcctgaagggacatatgatgctatcattgttgattcatcagacccaatagggcctgctcaggaacttgtggagaagcctttttttgagaccatcgctagagctttgaggcctggtggtgttctttgtaatcaagctgagagtatgtggttgcatacacatttgattcaggacatgctttcaatttgccgtgagactttcaagggttctgtccgctatgcatggactagtgtcccaacatacccaagtggggtgattgggtttctgctatgtgccaaagaaggaccaccggtcaactttctgactcctataaatccaattgaaaaagtggaaggagctactaaagcaggaagggagatcagattttataactcagagatgcatagggcagcgtttgttcttccgacctttgcgaagagagagctagaagcatattgtgcttctacgtaaacagagcaggcagaggaggaaatagcgacaccaccaccaaagctaactgtggctccagagagtggaattctcagtgcatcctagcttagaccggcgtgactcagaaccgagacacgtctagaaaccgtcccttcacggcattccctagtatcgccaattggatacgctcttgctctatcacgtattgtaagcatggacatatggagtgtgtgtggggtgcattggaatttgacgcgtaatgaggcgctcatgtgttaataataatctatgctcctgtgttatggcaccaacaatgagatgacaaatggcatggtaaggaaaagacgaacagtgtgatgagtctgacgtgatgagcaaattccacattgcactttaccc

SEQ ID NO: 4971 - DNA, 563 bp, Triticum aestivum
cccaagcagtgaaagagaggaagccggagctacctcaagagccttcttttccagcgagtgtgctgtgtacgtagcagagcgaagagttagagcaatggctggggtggtcggcgtctggttcgctaagttcggccgggaggcggcgccggcggcagaggccgaggccgaggtcgtcggccggcgacaccagggcgacggcctgctcgaggtggaggccgtgaagacggtgcagatccaggagaggaggaggaggaacagcgccgtcctcgccaactccgaggacacggtgtgcatgctcatggaccgcttcgccccggcctgatgcgccggtgaaccggcggtgtccgtccgtacgtgtaaattccagggcacgtacgtaggggcgcgggcacaagggaggagtctatgccttgtgctgtggttgtgtgggttcctcttgtacataagctctttttcatcgctaatcgagtgatcgtagtagtagtgctcatgcctttcgttaaaaaaaggataataaataaattatgcggccagttgaatcaactgtatcatatcatgtactc

SEQ ID NO: 4972 - DNA, 657 bp, Hordeum vulgare
gtgactgaaagagaagaagctaatagagctcgacagccttcttttccatcgagtgtgtgcgtagcagaccgaagagctagagaagccaagagtgtgtggaccgagcgatggccggggttgtcggcgtttggttcgccaagttgggccgggaggcggcgccggcggcagaggccgaggtcgtcggccggcgaaaccagggcgacggcctgctcgaggcggaggccgcgaagacggtgcagatccaggagaggaggaggaggaacagcagcgtcctctccaactccgaggacacggtgtgcatgctcatggaccgcttcgccccggcctgatatacgccggtgaaccggtgttcattccggcgcatgggagcctataccttgtgctgtgattccgctggttcctcttgtacataagctcttttttcatcgctaatcgagtgatagtagctcatgccttccgtttgaaaagaaaagatgaataaattatgcggctagatgaatcaactgtatcatattcatatcacatacttttttgtaattcttgtcgtggttttagttaattatactgatacgaaacaaaagagtagtatgtatatatatatgactgtatatgctttgaatggattgtctggttatctcgcaaaaaaaaaaaaaaaat

SEQ ID NO: 4973 - DNA, 958 bp, Hordeum vulgare
cggcacgagggtgactgaaagagaagaagctaatagagctcgacagccttcttttccatcgagtgtgtgcgtagcagaccgaagagctagagaagccaagagtgtgtggaccgagcgatggccggggttgtcggcgtttggttcgccaagttgggccgggaggcggcgccggcggcagaggccgaggtcgtcggccggcgaaaccagggcgacggcctgctcgaggcggaggccgcgaagacggtgcagatccaggagaggaggaggaggaacagcagcgtcctctccaactccgaggacacggtgtgcatgctcatggaccgcttcgccccggcctgatatacgccggtgaaccggtgttcattccggcgcatgggagcctataccttgtgctgtgattccgctggttcctcttgtacataagctcttttttcatcgctaatcgagtgatagtagctcatgccttccgtttgaaaagaaaagatgaataaattatgcggctagatgaatcaactgtatcatattcatatcacatacttttttgtaattcttgtcgtggttttagttaattatactgatacgaaacaaaagagtagtatgtatatatatatgactgtatatgctttgaatggattgtgcggttatctcgggtgtaagagtaaagtggtgagaaggaaaggatggataatagaaacctggggggcgggccggtacccatcggccttatgggagtgggttacaatacttgggcgtggtgaaacagagagggctggagaaacccggaggtgccacacttatggcttgaggtcatgccgtttaggggggggtggtaagaaagagcccgacgctgcctcgcaacaatggccgcggaggggtgggatatcggtcggatttgttaaaaagggatttaggaaacccgtttaacaaggcgagtgggatcttaaagaaaataccgggg

SEQ ID NO: 4974 - DNA, 448 bp, Hordeum vulgare
gagcaatggctggggcggtcggcgtctggttcgccaagttgggcagggaggctgcgccggcggcagaggccgaggtcgtcggccggcgaaaccagggcgacggcctgctcgaggcggaggccgcgaagacggtgcagatccaggagaggaggaggaggaacagcagcgtcctctccaactccgaggacacggtgtgcatgctcatggaccgcttttccccggcctgatgcgccggtgaaccggcggtgttcgcaggcacatgggaaatctataccgtgtgctgtgattgcgttggttcctcttgtacataagctccaatccagtgatagtagtgctcatgccttccgttcgaaaaaaattataaataaattatgcggctagttgaatcaactgtattatatcatgtgtacgactgtatcctttgaatggattgtttggtttctatggc

SEQ ID NO: 4975 - DNA, 568 bp, Hordeum vulgare
cacccaacaccagcacccaagcaggcagtgaaagagaggaagccggagctacctcaagagccttcttttccagtccagcgagtgtgtgtacgtagcagaccgaagagttagagcaatggctggggcggtcggcgtctggttcgccaagttgggcagggaggctgcgccggcggcagaggccgaggtcgtcggccggcgaaaccagggcgacggcctgctcgaggcggaggccgcgaagacggtgcagatccaggagaggaggaggaggaacagcagcgtcctctccaactccgaggacacggtgtgcatgctcatggaccgcttttccccggcctgatgcgccggtgaaccggcggtgttcgcaggcacatgggaaatctataccgtgtgctgtgattgcgttggttcctcttgtacataagctccaatccagtgatagtagtgctcatgccttccgttcgaaaaaaattataaataaattatgcggctagttgaatcaactgtattatatcatgtgtacgactgtatcctttgaatggattgtttggtttctatggcaaaaaaaaaa

SEQ ID NO: 4976 - DNA, 810 bp, Triticum aestivum
gggcaggtagcaactggaaacctacgccagctcaagtctatagggtgagtcagtgaggagagcagtagccaaatcttcgaagtacctagttagctctccatccttcagctagccaaatcccaggcatggacggaaagaagaagcccactgctgcgactgggagctccatcgtcgacgacctcttcggccccaaggacggcgccgcctcctcctccgccggctacttcagcaccgtcttcccaactccatccggggcgacggggaaagatgcgtcactccgggcagcagcagcagctgggaataaatcatcgtcggcagggcatcagcagcaaggaaagcagcacggggggtcacctgagtcgccttacttcggctcctcttccgtccactatggcggccgggacttctacgccggcgccgaatctcagcggcaatattcggccgccgctgccgcaccggcacccaagcacaaggacgacggcgacacgtcggcagccacccggggtgaatggtggcaaggttccctctactactagcactagcaggaaaaagagactggtgtgagatgagcgagatataaataaaatgtacagctagctacctcataatagcatgcttcatcatcgttatttcactgggtggagaagatggtcggtccagcgatcatcagcttaactaattagtattaagctactgttatgttagagcttgtgtgtgtctacctagttgggacatgggtcctctcatgtgtgtactactgtgctcttgtaatatgccttcttcacactaatatatggtcgtgcgcttgta

SEQ ID NO: 4977 - DNA, 1018 bp, Triticum aestivum
gaaaccgacgccagctcaagtctatagggtgagtcactacagagcagtagccaaatcttctacctagttagctctctctctagtagctacatccttcagctagccaaatcccaggcatggacggaaagaagaagcccactgctgcggctgggagctccatcgtcgacgacctcttcggccccaaggacggcgccgccgcctcctccgccggctacttcagcaccgtcttcccaactccatccggggcgacggggaaagatgcgtcactccgggcagcagcagccgctgggaataaatcatcgtcggcagggcatcagcagcaaggaaagcagcacgggggttcacccgagtcgccttacttcggctcctcttccgtccactatggcggccgggacttctacgccggcgccgaatctcagcggcagtatccggccgccgctgccgcaccggcacccaagcacaaggaagacggcgacacatcggcagccacccggggtgagtggtggcaaggttccctctactactagcactagcaggaaagagagactggtgtgagatgagatataaataaaatgtacagctagctacctcataatagcatgcttcatcatcgttatttcactgggtggagaagatggtcagtccagcgatcatcagcttaactaattattaagctactgttatgttagagcttgtgtgtgtctacctagttgggacatgggtcctctcatgtgtgtactactgtgctcttgtaatatgccttctcacactaatatatggtcgtgcgcttgtatgtgtgtgctatggttttgcctctccatcatcaaattagtcaggcttactgaaaaaatcgagcacactgaattcgcgtctccttaatggcattatattgtagagaaaagtgtgcatggcaccccagctttgtcgaaagtcataaatagattgtcttatgtatctctacgggagttggtgtttgtaggttatcaaatgtggtttcgtcccccctgttgtgaatatc

SEQ ID NO: 4978 - DNA, 825 bp, Hordeum vulgare
gcacagcaccgcagctagcaactgaaaccgacgccagctcaagtgtatagggggcagagcagtagcccaaatcttccaatccatctacctagctagctctctagctccatccttcagctagccaaatctcaggcatggacggaaagaagaagcctgctgctgcgactgggagctccatcgtcgacgacctcttcggccccaagaacggcgccgcctctccttcctccgccggctacttcagcaccgtcttcccaactccatccgcggccacggggaaagatgcgtcacgtcgggcagcagcggccgctgggaataaatcatcgtcggcagggcatcagcagcaaggaaagcagcatggggggtcacctgagtcaccttacttcggctcttcctccgtccactatggcggccgggacttctacgccggcgccgaatctcagcggcaatatccgcccgccgctgccgcaccggcacccaagcacaaggacgacggcgacacatcggcagccacccggggtgactggtggcaaggttccctctactactagcactggcaggaaagagagactgatgtgagatgagatataaataaaatgtacagctagctacctcataatagcatgcttcatcatcgttatttcactgggtggagaagatggtcggtccagcgatcatcagcttattactaattaagctatatatgttgttatgttagagcttgtgtttgtctacctagctgggacatgggtcctctcatgtgtgtactactatgctgttgtaatatgccttctcacactaatatatagtcgtgcgcttgtatcaaaa

SEQ ID NO: 4979 - DNA, 831 bp, Hordeum vulgare
gcacagcaccgcagctagcaactgaaaccgacgccagctcaagtgtatagggggcagagcagtagcccaaatcttccaatccatctacctagctagctctctagctccatccttcagctagccaaatctcaggcatggacggaaagaagaagcctgctgctgcgactgggagctccatcgtcgacgacctcttcggccccaagaacggcgccgcctctccttcctccgccggctacttcagcaccgtcttcccaactccatccgcggccacggggaaagatgcgtcacgtcgggcagcagcggccgctgggaataaatcatcgtcggcagggcatcagcagcaaggaaagcagcatggggggtcacctgagtcaccttacttcggctcttcctccgtccactatggcggccgggacttctacgccggcgccgaatctcagcggcaatatccgcccgccgctgccgcaccggcacccaagcacaaggacgacggcgacacatcggcagccacccggggtgactggtggcaaggttccctctactactagcactggcaggaaagagagactgatgtgagatgagatataaataaaatgtacagctagctacctcataatagcatgcttcatcatcgttatttcactgggtggagaagatggtcggtccagcgatcatcagcttattactaattaagctatatatgttgttatgttagagcttgtgtttgtctacctagctgggacatgggtcctctcatgtgtgtactactatgctgttgtaatatgccttctcacactaatatatagtcgtgcgcttgtatctgtgtgctca

SEQ ID NO: 4980 - DNA, 870 bp, Pseudoroegneria spicata
  misc_feature (268)..(268): n is a, c, g, or t
  misc_feature (455)..(455): n is a, c, g, or t
  misc_feature (794)..(794): n is a, c, g, or t
ccgttgctgtcgccgacgccagctacaggatatagggtgagtaactgagcagagcagtagccaaatcctctaatccatttacctagttagctctagctccagcgttcagctagccaaatcccaggcatggacggaaagaagaagcctgctgctgcggctgggagctccatcgtcgacgacctcttcggccccaaggacggcgccgcctctccctcctccgccggctacttcagcaccgtcttcccaactccatccgcggcgacggggnaagatgcggcacgtcgggcagcagcagcagccgctgggaataaatcatcgtcggcagggcatcagcagcaaggaaagcagcacggggggtcacctgagtcgccttacttcggctcctcctccgtccactatggcggccgggacttctacgccggcgccgaatctcagcggcagtatccggccgccgntgccacaccggcacccaagcacaaggacgacggcgacacatcggcggccacccgtggtgactggtggcaaggttccctctactactagcactagcaggaaagagagtctgatgtgagatgagatataaataaaatgtacagctggctacctcataatatcatgcttcatcatcgttatttcactgggtggagaagatggtcggtccagcgatcatcagcttaactaattaagctattgttatgttagagcttgtgtgtgtctacctagttgggacatgggtcctctcatgtgtgtactactgtgctcttgtacgtccttctcacactaatatatagtcntgcgcctgtatgtttgtgctatggttttgcctctccaacatcaaattagtcaggcttactgaaataatcgagcaga

SEQ ID NO: 4981 - DNA, 1457 bp, Triticum aestivum
  misc_feature (11)..(11): n is a, c, g, or t
ccacgcgtccncactcgcccacaatctcgaacaacggccgtcggatccatcatcatcggcagcggagcgattccatcgaccagctttctacagacggacatggggatgccggccgtgaggaggagggagagggacgcggaggcggagctcaacctgccccccggcttccgcttccaccccaccgacgacgagctcgtcgagcactacctctgccgcaaggcggcggggcagcgcctcccggtccccatcatcgccgaggtcgacctctaccgcttcgacccctgggcgctccctgaccgcgccctcttcggcacccgcgagtggtacttcttcaccccccgcgaccgcaagtaccccaacggctcccgacccaaccgcgccgccggcaacggctactggaaggccaccggcgccgacaagcccgtcgcgccccgcggcgggcggaccatggggatcaagaaggccctcgtgttttacgcgggcaaggcgcctaagggggtcaagaccgactggatcatgcatgagtatcgcctcgccgacgccggccgcgccgccgccagcaagaagggctcgctcaggctggacgactgggtgctctgccggctctacaacaagaagaacgagtgggagaagatgcagctgcagcagcaaggggaagaggagacgatgatggagcccaaggcggagaacacggcctccgacatggtggtcacctcgcactcccactcgcagtcccagtcgcactcgcactcgtggggcgaggcgcgcacgccggagtcggagatcgtcgacaacgacccgtcgctgttccagcaggcgacggcggcggcgttccaggcccagagccccgcggccgccgcggcgcaccaggagatgatggccacgctgatggtgcccaagaaggaggcggcggacgaggccggcaggaacgacctcttcgtcgacctcagctacgacgacatccagagcatgtacaacggcctcgacatgatgccgcccggggacgacctgctctactcctccctcttcgcctccccccgtgtccgcgggagccagcccggcgccggcggcatgccggccccgttctaagcagagcaaagacagagaccgtcagagaccccgagatcgacagaagtggaatggacgacttcttggccgcgagcgagcgagaccgcggtgcagtgtaaatacagcataggaaacgggagggagggaggtggcgtcgtgtcgagagaagccggcgtcgtgccggggcgtgccgttgtacatggagagcccggcgccggggcctggccggctgggttgattcttttgttcttactaccttgtactctcaatgcggatgtagctctttcttctcactcctcactagtagaatcgaccgaccgaatacatatgtagctctgttctttccttctcttcagtagaaatcaaccaaattttgctgttatgctgct

SEQ ID NO: 4982 - DNA, 1460 bp, Pseudoroegneria spicata
acaccacaccacacaactcactctcatcacatctcaaacaacagcccgaggatttcatcaacagcagcaacatcaccggagcggccgatttcagccaggccagccagcgactctcttgcagacatggggatgccggccgtgaggaggagggagagggacgcggaggcggagctgaacctgcccccgggattccgcttccaccccaccgacgacgagctcgtcgagcactacctgtgccgcaaggcggccgggcagcgcctgcccgtgcccatcatcgccgaggtcgacctctaccgcttcgacccgtgggcgctccccgaccgcgccctcttcggcacccgcgagtggtacttcttcaccccgcgcgaccgcaagtaccccaacggctcccgccccaaccgcgccgccggcaacggctactggaaggccaccggcgccgacaagcccgtcgcgccccgcggcggccggaccatggggatcaagaaggccttggtgttttacgccggcaaggcgcctaagggggttaagaccgactggatcatgcacgagtaccgcctcgccgacgccggccgcgccgccgccagcaagaagggctcgctcaggctggacgactgggtgctgtgccgtctgtacaacaaaaagaacgagtgggagaagatgcagctccatcaggagcaggacggggagatgatggtggagcccaaggcggagaacacggcgtcggacatggtggtgacctcgcactcccactcgcagtcccagtcgcactcgcactcgtggggcgaggcgcgcacgcccgagtcggagatcgtggacaacgacccgtcgctgttccagaaggcggcggcgttccagacccagagccccgcggcggcgcaccaggagatgatggcgacgctgatggtgcccaagaaggaggcggccgatgagggcaggaacgacctgttcgtggacctcagctacgacgacatccagagcatgtacaacggcttcgacatgatgccgcccggggacgacctcctctattcgaccctcttcccctcccccagggtccgggggagccagcccggcgccggcggcatgccggccccgttctaagcagagcacaggctcaagacgagactgtcagaccgagatcgacagaagtggaatggtgactccttcgccgcgagcgagatcgcggtgcagtgtaaatacagcataggaaacgggagggaggtggcgtcgtgtcgagagagccggcgtggcgtgggcgccggcgccggggcgtgccgttgtacatggagagcccggtgccggggcctggccggctgggttgattcttttgttcttactttgtactctcaatgcggatgtagctctttcttctcactcctcagtagtagaatcgaccaaatacatatgtagctctgtttctttcttatcgtcagtagaatcaactaacaaattttgcagctcta

SEQ ID NO: 4983 - DNA, 1519 bp, Hordeum vulgare
ctggaccatcaccacacaacccaactcctctcactccccaacaatctcaaacaacagctcgaggaatcaacagcagcgactactctgttcgttgaaccaacaatcaacagacggacatggggatgccggcggcgaggaggagggagagggacgcggaggcggagctgaacctgcccccgggattccgcttccaccccaccgacgacgagctggtggagcactacctgtgccgcaaggcggcggggcagcgcctgcccgtgcccatcatcgccgaggtcgacctctaccgcttcgacccgtgggcgctccccgaccgcgccctcttcggcacccgcgagtggtacttcttcacgccccgcgaccgcaagtaccccaacggatcccgccccaaccgcgccgccggcaacggctactggaaggccaccggcgccgacaagcccgtcgcgccccgcgggggtcgcaccatggggatcaagaaggccctcgtgttctacgccggcaaggcgcccaagggggtcaagacggactggatcatgcatgagtaccgcctcgccgacgccggacgcgccgccgccagcaagaagggctccctcaggctggacgactgggtgctctgccggctgtacaacaagaagaacgagtgggagaagatgcagctgcagcagcagcagggggaaggggagaccatgatggagcccaaggcggaggagaacacggcgtccgacatggtcgtcacctcgcactcccactcccagtcccagtcgcactcgcactcgtggggcgaggcgcgcacgcccgagtcggagatcgtcgacaacgacccgtcgctgttccaccaggcgcaggcgacggcgttccagacgcagagccccgcggccgccgcggcgcaccaggagatgatggccacgctgatggtgcccaagaaggaggcggccgatgagggcaggaacgacctgttcgtggacctcagctacgacgacatccagagcatgtacaacggcctcgacatgatgccgcccggggacgacctgctctactcctccttcttcgcctcccccagggtccggggcagccagcccggctccggcggcatgccagccccgttctaagcacacagcaaagacagaccatcagaccgtcagactccgatcgacagaagcggaatggatgacttcttcgccgcgggcgagcgagcgagatcgcggtgcagtgtaaatacagcataggaaacgggagggaggtggccgtcctgtctgagagaagccggcgtggtgagggcggcggcgccggggcgtgttgctgtacatggagagcccggcgccggggcctggccggctgggttgattctttcgttcttactttgtactctcaatgcggatgtagctctcttctcttctcactcctcagtagtagaatgagaatcgaccgaccaaatacatatgtagctctgtttcttccttctcttcagtagaaatcaaccaaattttgctgtttatgctgctcaaaaaaaaaaaaaaaa

SEQ ID NO: 4984 - DNA, 1660 bp, Hordeum vulgare
ctggaccatcaccacacaacccaactcctctcactccccaacaatctcaaacaacagctcgaggaatcaacagcagcgactactctgttcgttgaaccaacaatcaacagacggacatggggatgccggcggcgaggaggagggagagggacgcggaggcggagctgaacctgcccccgggattccgcttccaccccaccgacgacgagctggtggagcactacctgtgccgcaaggcggcggggcagcgcctgcccgtgcccatcatcgccgaggtcgacctctaccgcttcgacccgtgggcgctccccgaccgcgccctcttcggcacccgcgagtggtacttcttcacgccccgcgaccgcaagtaccccaacggatcccgccccaaccgcgccgccggcaacggctactggaaggccaccggcgccgacaagcccgtcgcgccccgcgggggtcgcaccatggggatcaagaaggccctcgtgttctacgccggcaaggcgcccaagggggtcaagacggactggatcatgcatgagtaccgcctcgccgacgccggacgcgccgccgccagcaagaagggctccctcaggctggacgactgggtgctctgccggctgtacaacaagaagaacgagtgggagaagatgcagctgcagcagcagcagggggaaggggagaccatgatggagcccaaggcggaggagaacacggcgtccgacatggtcgtcacctcgcactcccactcccagtcccagtcgcactcgcactcgtggggcgaggcgcgcacgcccgagtcggagatcgtcgacaacgacccgtcgctgttccaccaggcgcaggcgacggcgttccagacgcagagccccgcggccgccgcggcgcaccaggagatgatggccacgctgatggtgcccaagaaggaggcggccgatgagggcaggaacgacctgttcgtggacctcagctacgacgacatccagagcatgtacaacggcctcgacatgatgccgcccggggacgacctgctctactcctccttcttcgcctcccccagggtccggggcagccagcccggctccggcggcatgccagccccgttctaagcacacagcaaagacagaccatcagaccgtcagactccgatcgacagaagcggaatggatgacttcttcgccgcgggcgagcgagcgagatcgcggtgcagtgtaaatacagcataggaaacgggagggaggtggccgtcctgtctgagagaagccggcgtggtgagggcggcggcgccggggcgtgttgctgtacatggagagcccggcgccggggcctggccggctgggttgattctttcgttcttactttgtactctcaatgcggatgtagctctcttctcttctcactcctcagtagtagaatgagaatcgaccgaccaaatacatatgtagctctgtttcttccttctcttcagtagaaatcaaccaaattttgctgtttatgctgctctgctgttttggtgtcgggcaggatgaattttgcctcattcttagattgtctgatgttgtgtttgcctgcctgcttggatttactagcacagactaatgtggatagcttatgtcatactccaaaatgttgattagaaatctgaaaatgttggttacat

SEQ ID NO: 4985 - DNA, 1425 bp, Avena sativa
tcacaacaccacagagggaatcatcatcatcatcaacagcaggagctcagagtagtgatccaaagcaaaggagcaagctttcagacagacagacagagagagaggatcgctcgcttactacagacgacgcacatggggatggccgtgcgcaggcgcgagagggacgcggaggcggagctgaacctgccccccgggttccggttccaccccacggacgacgagctcgtggagcactacctgtgccgcaaggccgccgggcagcgcctccccgtgcccatcatcgccgaggtcgacctctaccgcttcgacccctgggcgctccccgaccgcgccctcttcggcacccgcgagtggtacttcttcacgccccgcgaccgcaagtacccaaacggctcccgacccaaccgcgccgccgggaacgggtactggaaggccacgggggcggacaagcccgtcgcgcctcgcggcgggcgcaccatggggatcaagaaggcgctggtgttttatgccgggaaggcgcccaaaggggtgaagacggactggatcatgcacgagtacaggctcgccgatgccgggcgggccagcgccagtgccaagaaggggtccctcaggttggacgactgggtgctgtgccgtctgtacaacaagaagaacgagtgggagaagatgcagcagcaaggagagcagaaggtggagcccaaggcggaggaggcgtctgcggcgtcggacatggtgacctcgcagtcccactcgcactcgtggggcgaggcgcgcacgccggagtcggagatcgtggacaccgacccggcgctgttccagcagcaggcggcagccgcggggttccagagccccgtggcggcggcggcgcaccaggagatgatggcgacgctgatggtgcccaagaaggaggccgcggacgagggcaggaacgacctgttcgtggacctcagctacgacgacatccagagcatgtacagcggcctcgacgtgatgccgcccggggacgacctgctctactcgtccctcttcgcgtcgcccaggctccgcgggagccagccaggcgccgccggcggcatgccgggccccttctgagctgaaccaggatggatcagcatcagcccgagacgagagagaagtggaacaacgacttctgcaccgcgagctcgcggacggatcatcagtgtacatacaggatagggaaacgggagaagaggccgcgcgcgtggtgtcgagagatcgagccgtggcgttgtgtgcggcgccggcgccggggcgtgctgtatatcgagagcctggtgctggggctgggtcattctttcgtttttacttggttgttactcagagagtactcacatacatatgtactagtagctcctttccccttgttctcttacagtggaacccaacaaattttgctgttcttca

SEQ ID NO: 4986 - DNA, 2441 bp, Brachypodium distachyon
ccggccgcgatgccgtcgatcgtcggcggcggaggttggcgcctcttctccgcggaccggggtatgacctcgctacgccgccgccagagcccgctcttctcgtccctcgccggcggcggaggcgacgcgccgcatctgcctgtggtcatcgtcggggccggccccgtcgggctcgtcctctccttcctcctcaccaaattcggcatcaaatgcacggttatagagaagagcatggagttcactcggcacccccgagcgcatttcattaacaaccgcactatggagattttccgcaaatttgacggcttggctggggacatcgagaaggctcagccgccagtggatttgtggagaaagttcgtgtattgcacttcactctctgggtctgttctcggttcagttgatcacatgaagcaggaagattttgacaaggtcattagtcctatatcggttgcacacttctcacagtacaagttagtggatttgctgctcaataaattggaaggcattggcttccatacatgctttcctgatgatattggcggcaggttgactcgagatttagtgttggagaacaagatactgatgggacatgagtgtagttccattcaactaactgatgagggcattttgcttggagcatcatttaacaatgggggaactatgcaagagagaaagcttcactgtggccttcttctagcggcagatggtgctaaaagcacagtgcgtgaactggctggtatatctatggaaggtgcaagggacttgcagaaattggtcagcgtgcattttctgagccgaaatcttggaaagtatttatctagtgaaaggcctgggatgctgttctttatcttcaaccctgatgcaattggtgtgctggtggcacatgacctagagcatggggaatttgtattgcagattccattttatcctcctcaacagatgtttgatgatttcagcataaaggtgtgtgagcaaattattgtcaaattggtaggatgggagccagcagatgttcaggttttagacataaaaccatgggtgatgcatgctgaagttgcagagaagtacactggctgcaataatcgtgtgatccttgttggtgatgctgctcaccggtttccccctgctggtggttttggaatgaatactggtgttcaggatgcacataatttggcctggaaattgggtttactgctaaatggtgttgctggaccctcaattttacaaacctatgaatcagagcgcaaacctgttagattcttcttgcatgccgtctgcttcctcaatgtagccatttctaacacaaaacttagtgtgcaaaacttcaaagcagcaatgtctgttcctgctacccttggtcttgatccaactgttgcgaactcagtgcatcaagtaatcaacagcagcttagggtcagtcattccaagaaatttacagaagacggttttggaagggttgttctccattggtcgggcacaagtctcggactacattttgaatgagaaaaaccccattgggtccttgagactggcaagattgagaagtattcttgatgaaggaaaaagtctacagttacagttcccggcagaagatcttggcttccgctatgaaaaaggagccctagttgctgaagattgtgctgaaactgctcagcaagcagaaaaactgaagcatattaataggtcatctggagagtacatcccatctgctaaggttggttcacggctaccacacatgctggtgaaaacattatcttcttcgagtgagggtgtgctctcaacaatggacctagtaagtggggataaagtccagtttgttctcattgtcgcaccactgaaaaagtcgtatgagcttgcctgtgctatgctgaagatagcagaagagctcacgttatcagccaaagtatgtgttatgtggccacaaggttcagttgatgcaaaagtgagagggagcagatctgaattggcaccctggacaaactatgtcgatgtcgaggaaatacctagggcatctgataactcatggtgggagacatgtcaggtaagtaagaacaaagtaattttggttaggcctgatgagcacatagcatggataaaagaatctgacatggtgagagatgctgattcagaagttaggagagtcttttctcaaattttgtgtttaaataggcagcaggtgtaagaatgcccagatttccgttcagtaactgagatgtgccattagcgtggcatgctgcattacttgcaggggcaaaaggcatgcgcatgatagtcagttagtttgttgaattttgtatataaaaggaggataacccctggcctcctcctatctaaatactctgggaggaggattcagtgaagttaccgcagtacttcatacattcgagctgaactacccagagattttacatcagtgtgaataaaatttatctttctatt

SEQ ID NO: 4987 - DNA, 849 bp, Lolium multiflorum
tcggccattacggccgggggaacgagccattgtagtgggagctgcggtgcacgaggggcggtgaggatgtcgtcggcggtggaagtggccatctcttgctccaagaacgtcgacatcgcgccggaggaggtgaaggagcgcgcggtggtgctggagcacggcaacggcgactgcgccgccgccgcgacgaacgggaagaagtgcgccgaggcggcgtcgcattgccgcaaggctgatgaggaggaggacgacgaggacggcgagaaggtccccgagcacatcgacctcggccccatcctcagcatcaaggaccagctcgagaaggacaaggacgacgagagcttgaggaggtggaaggagcagctcctcggcagcgtggatttgaactccgtcggagagacgctggagcctgacgtgaagatcatgagcctgtccatccagtccccggggcggccggacatcgtgctaccgctgccggtggagcccaacgccaagggggtttggttcacgctcaaggagggctccatgtacaagctcaagttcaccttctccgtcagcaacaacatcgtctccggcctccgctacaccaaccgcgtctggaagaccggcatcaaagtggatagcaccaaggagatgctgggcacgttcagcccccagccagaggagtacacgtacgtgacgccggaggagaccacgccgtcggggatgtttgcccggggatcctactctgccaggactaagttcctcgacgacgaccggaaatgctacctgcagatcgactacacattcgacatacgccgggactggccgtcgtcgagctgatcctttccgtgagccagctcgtggccg

SEQ ID NO: 4988 - DNA, 1308 bp, Hordeum vulgare
cggcacgaggcttttgttgcccccgagcgaccgagcgagctctcggtgcccgtgccgccttcctccaccgcccgcttccgccttttcgccacgcccccctctttctgtccccgcctcttcttggctagccgttgaggagttgaggaaggagcggccattgcggtggtgtgtgtgagctgcgaggtgaggtgaggatgtcgtccgcggtggaagccatctcctgctccaaggtcgccgcggccgcggccgggcctgaggaggccaaggagtgcgcggcggtggcggagcacggcagcggcaacggcaacggcgggggtgacgccgcgccgcattgcggcaagggcgtggaggaggaggacgaggaggacggcgagaaggtccccgagcacatcgacctcggccccatcctcagcatcaaggaccagctggagaaggacaaggacgacgagagcctgcggaggtggaaggagcagctcctcggcagcgtggacttgaactctgtcggagagacgctggagccggacgtgaagatcatgagcctgtccatccagtccccggggcggccggacatcttcctgccgctgccggcggagccgagcggcaagggggtgtggttcaccctcaaggaaggctccccgtacaagctcaagttcaccttctccgtcagcaacaacatcgtctccggcctccgctacaccaacaccgtctggaagaccggcatcaaagtggacagcgccaaggagatgctgggcacattcagcccgcagccggagccgtacgcgtacgtgacgccggaggagaccacgccgtccgggatgtttgcccggggatcctactctgccaagaccaagttcctggacgacgaccggaagtgctacctgcagatcaactacaccttcgacatacgcagggagtggccgtcgtcaggctgagcccgatttgtccggtggctgccgaagtgcctgcctgcctgcctgggttactgctgttaccgttgccgttgaagcagatcggtctttgtttcgtttgcagttttactattcctgcctgtttttcgtggttgccgttgccttagggctcttgtctcctgtggtgcgtgcgtgcgtgcgtgcgtgtaaattggttcggttgtttatgtgtaaaatgtcagtgcgtccgtctgtgtgtgagagagcgctttgccaattgtcagggtctgttttaaggaacgaactgtaatattgacttcatgtaatgcaccagagcgacgcagctgcacgcacttcgtgtaatgctcgagaaagaaagaatatttgccactcacttttc

SEQ ID NO: 4989 - DNA, 1308 bp, Hordeum vulgare
cggcacgaggcttttgttgcccccgagcgaccgagcgagctctcggtgcccgtgccgccttcctccaccgcccgcttccgccttttcgccacgcccccctctttctgtccccgcctcttcttggctagccgttgaggagttgaggaaggagcggccattgcggtggtgtgtgtgagctgcgaggtgaggtgaggatgtcgtccgcggtggaagccatctcctgctccaaggtcgccgcggccgcggccgggcctgaggaggccaaggagtgcgcggcggtggcggagcacggcagcggcaacggcaacggcgggggtgacgccgcgccgcattgcggcaagggcgtggaggaggaggacgaggaggacggcgagaaggtccccgagcacatcgacctcggccccatcctcagcatcaaggaccagctggagaaggacaaggacgacgagagcctgcggaggtggaaggagcagctcctcggcagcgtggacttgaactccgtcggagagacgctggagccggacgtgaagatcatgagcctgtccatccagtccccggggcggccggacatcttcctgccgctgccggcggagctgagcggcaagggggtgtggttcaccctcaaggaaggctcgccgtacaagctcaagttcacttctccgtcagcaacaacatagtgtccggcgtccgctacaccaacaccgtctggaagaccggcatcaaagtggacagcgccaaggagatgctgggcacattcagcccgcagccggagccgtacgcgtacgtgacgccggaggagaccacgccgtccgggatgtttgcccggggatcctactctgccaagaccaagttcctggacgacgaccggaagtgctacctgcagatcaactacaccttcgacatacgcagggagtggccgtcgtcaggctgagcccgatttgtccggtggctgccgaagtgcctgcctgcctgcctgggttactgctgttaccgttgccgttgaagcagatcggtctttgtttcgtttgcagttttactattcctgcctgtttttcgtggttgccgttgccttagggctcttgtctcctgtggtgcgtgcgtgcgtgcgtgcgtgtaaattggttcggttgtttatgtgtaaaatgtcagtgcgtccgtctgtgtgtgagagagcgctttgccaattgtcagggtctgttttaaggaacgaactgtaatattgacttcatgtaatgcaccagagcgacgcagctgcacgcacttcgtgtaatgctcgagaaagaaagaatatttgcccgaaaaagaaaa

SEQ ID NO: 4990 - DNA, 1174 bp, Brassica rapa
  misc_feature (6)..(6): n is a, c, g, or t
  misc_feature (11)..(12): n is a, c, g, or t
  misc_feature (16)..(16): n is a, c, g, or t
  misc_feature (21)..(22): n is a, c, g, or t
  misc_feature (24)..(24): n is a, c, g, or t
  misc_feature (27)..(27): n is a, c, g, or t
  misc_feature (29)..(30): n is a, c, g, or t
  misc_feature (45)..(45): n is a, c, g, or t
  misc_feature (85)..(85): n is a, c, g, or t
  misc_feature (88)..(88): n is a, c, g, or t
  misc_feature (787)..(787): n is a, c, g, or t
  misc_feature (824)..(825): n is a, c, g, or t
  misc_feature (871)..(871): n is a, c, g, or t
  misc_feature (1104)..(1104): n is a, c, g, or t
gggcgngtgannttcncgatnncnctnannattctctctctctcncctataactcggatcaccacatgactctatctcctcctcnttnccgttatcacaaaccaaactcccctaaaggttcggtcttttctccttctctctccgaatagatcccaaaaaaaaacacatttcggaaacaaacttctcaaggcttttgaaggggaggagggggaagacgagtttgatctgattttgattgatgtctggagctgtatctggttccagggacatgggtttcgtcgacaacaacaacaacaagaaagatggagacgacggtaacacttccaaaacggcgtcgtctcatcaacacgagggcaccgacgacgagggcgctggatccttggggaggcaaatgagcgaagcctctcttagcgcagctgaggaggaagaagacgatgactccaaattacaattgggtcctcagtacactatcaaggaacatctcgagaaggataaggatgatgagagtctgaggaagtggaaagaacagctccttggaagtgttgatgtcaccaacattggagagactcttgaccctgaagtgaagatcattagcctggtgatcttatcgccaggaagaccagatattgttctaatggttccggagaatgggaacccaaaggggatgtggtttactttgaaagaagggagcaggtactgtttgaaattcacgtttcaggttaaaaacaacattgtctctggtcttaggtacaccaatactgtttggaagaccggtgttaaagtgganagaggaaaggaaatgcttggaacctttagtcctcagnnggagccatacaaccacgtgatgcctgaagagaccactccttctggnatgtttgctcgaggatcttattctgctagaactaagtttcttgatgatgataacaagtgctacttggagatcaactacagtttcgacatccgtaaagaatggcctgctgtttgaaaactcaggaataagtctcatgagatgaagtgttgtcagtagaagttgtgtttgttttttcactccctatctcctttttcttgtcgttgacatattattgtgatcgttttttttccggnctcattgtagaacaagagcgacatttatttcctctggtcttgattttaagaaagaagatgattgttctcc

SEQ ID NO: 4991 - DNA, 1161 bp, Brassica napus
ctcatttccgttaaacgcagaaccaaactcccctaaaggttcggtcttttctccttctctctccgaatagatcccaaaaaaaaaacacatttcggaaacaaacttctcaaggcccttgagggggaaggagggggagagacgagtttgatctgatttgattgatgtctggagctgtatctggttccagggacatgggtttcgtcgacaacaacaacaagaaagatggagacgacggaaacacttccaaaacggcgtcgtctcaccaacacgagggcaccgacgacgagggtgctggatccttggggaggcaaatgagcgaagcctctcttagcgctgctgaggaggaagaagaagatgattccaaattacaattgggtcctcagtacactatcaaggaacatctcgagaaggataaggatgatgagagtctgaggaagtggaaagaacagcttcttggaagtgttgatgttaccaacattggagagactcttgaccctgaagtgaagatcattagcctggcgatcttatcccctggaagaccagatattgttctaatggttccggagaatgggaacccaaaggggatgtggtttactttgaaagaagggagcaagtactgtttgaagttcacgtttcaggttaaaaacaacattgtctctggtcttaggtacaccaataccgtttggaagaccggtgttaaagtggacagaggaaaggaaatgcttggaacctttagtcctcagtcggagccatacaaccacgtgatgcctgaagagaccactccttctggcatgtttgctcgaggatcttattctgctagaactaagtttcttgatgatgataacaagtgctacttggagatcaactacagcttcgacatccgtaaagaatggcctgctgtttaagactcaagaacaagactcctgagatgaagtgttcgtcagtagaagttgtgtttgttttttcactccctatctcttttttctcgtcgttggacatattatcgtgaatcgtttttttttttttcggtcattattgtagaacaagagcgacatttatttcctctttggtcttgattttaagaaagacgatgtttgttctccaagtctatttctccttcagcctcttaacatgtgtttgatggatatgattgattgtgtc

SEQ ID NO: 4992 - DNA, 1280 bp, Raphanus sativus
ggagtgaccctcacgatctctctctctctctctctcttataacacggatcaccacatgactcaatctcctcctccttcccgttaaaacacagaaccaaactccctaaaggttcggttcttttttttcttcttttctccttctctctccgatacattttggaaacaaacttctcaaggcttttttgagaagggaggagggggaggaagacgagttgatctgatctgattttgatttgatgtctggagctgtatctggttccagggacatggggttcgacgacgaaaacacttccaaaacgtctcatcaacacgatggcaccgacgacgagggtgctgctggatccttggggaggcaaatgagcgaagcctctcttagcgctgccgaggaagaagaagacgatgattccaaattacaattgggtcctcagtacactatcaaggaacatctcgagaaggataaggatgatgagagtctgaggaagtggaaagaacagcttcttggaagtgttgatgtcaccaacattggagagactcttgaccctgaagtgaagatcattagcctggccatcttatcccctggaagacctgatatcgttcttatggttccggagaatgggaatccaaaggggatgtggtttactttgaaagaagggagcaagtacaacttgaagttcacgtttcaggttaataacaacattgtctctggtcttaggtacaccaatactgtttggaagaccggtgttaaagtggacagaggaaaggaaatgcttggaacctttagtcctcagtcggagccatacaaccacgtgatgcctgaagagaccactccttctggcatgtttgctcgaggatcatattctgctagaactaagtttcttgatgatgataacaagtgctacttggagatcaactacagcttcgacatccgtaaagaatgggctgcggtttgaaactcgagaacaaagtctcctgagatgaagtgtttgtcagtagaagttgtgtgtttgttatttcactccctatctccttttttctcatcgttgaacatattattgtgaatcgttttttttcctcttccggttattatcgtagaacaagagcgacatttatttcctctttggtcttgattttttttgtcgagtaagaaagacagtgattgttctcaagtcaatctttagcttcataaaatgtgtttgatggatatgattgtgttaagaccctgagatgtataaatgattaattgtcagagtcaaaagctaaagagatgaaagttaaaaaga

SEQ ID NO: 4993 - DNA, 1195 bp, Raphanus sativus
ggacatgactcgatcatctcctcctccttcttcccgttaaacacaaaccaaaaaatcccgaaactttgttcccattctcttctctcttttgattagatcgatccccaattagaagatttcttaaaggcttgagggaggaagcgagttgaatttgattaatgtctttggtatctggagctgtatctggttccagggacatggacaacaagaagaatgaaggcacagacgacgagggcgttggatccgtggggagacagatgagcgagtcttctcttagcgctgccgaggaagaagaagacgacgattccaaattacatttgggccctcagtacactatcaaggagcatctcgagaaggacaaagatgatgagagtctgaggaaatggaaggaacagcttcttggaagtgttgacgtcaccaacattggagagacacttgaccctgaagtgaggatcattagcctggccatcttatcccctggaagaccagacattgttcttatggtacctgagaatgggaatccaaaggggatgtggtttactttgaaagaagggagcaagtactgtttgaaattcacatttcaggttaacaacaacattgtctctggtcttaggtacaccaatactgtttggaagactggtgttaaagtggacagaggaaaggaaatgcttggaacctttagtcctcagctggagccatacaaccacgtgatgcctgaagagaccactccttccggcatgtttgctagaggatcatattctgcaagaactaagtttcttgatgatgataacaagtgctacttggagatcaactacagcttcgacatccgtaaagaatggcctgcggtttgaaatgaaactcaaaagaacaaattctcctgagatgaagtgttgtcagtagaaagttgtgtttgtttcactcccccatctctctcttttttttttttgcctttcacgtgaaacattttattgtgaatcgcgtagaacaagaacgacagatagttccttcctctttgatcttgattttagtaatgccgtttggtgggaatcagtatgtgtggtttgttctcaaagtatgtttctccctatgcttcttaacaagtgtttgattgatgactatatgattgtgttggatcctgagatgtataatgattaattgtctcagtcaaaagctgaagagatgagagttttgaata

SEQ ID NO: 4994 - DNA, 1166 bp, Brassica napus
  misc_feature (791)..(791): n is a, c, g, or t
  misc_feature (803)..(803): n is a, c, g, or t
  misc_feature (989)..(989): n is a, c, g, or t
  misc_feature (1011)..(1011): n is a, c, g, or t
  misc_feature (1015)..(1015): n is a, c, g, or t
  misc_feature (1079)..(1080): n is a, c, g, or t
ggtggctcgaggctcgtctcctctgcgcgtggaacaagtacaatcatacttttgtcggaattctcggtagtgactctccacgatctctctctctctctcctgtaactcggatcatcacatgactccatcttctcctcctccttcctttccgttaacacagaaccaatctccctaaagaatctcccccaactcgtcattgtctcctctctcttccgctagatcccccaaaaaaggcaaaggctttgagggattgattgattgattaattaatgtctttggtatcgagttccagagacatgggaggagacgacgaaagcacgtcgagaacgcatcgtcacgacggcacagacgacgaaggcgttgagtccttggggaggcagatgagcgagtcttctatctacgctacagaggaagaagaagaagacgatgattccaaattgcatttgggtcctcagtacactatcaaggagcatctcgagaaggataaagatgatgagagtctgaggaagtggaaggaacagcttcttggaagtgttgatgtcaccaacattggagagactcttgaccctgaagtgaagatcattagcctggccatcttatcacctggaagacctgacattgtgcttatggtacccgagaatgggaatccaaagggaatgtggtttactttgaaagaagggagcaagtactgtttgaaattcacgtttcatgttaacaacaacattgtctctggtcttaggtacaccaatactgtttggaagacaggtgttaaagtggacagaacaaagganatgcttggaacntttagtcctcagttggagccatacaaccacgtgatgcctgaagagaccactccttctggcttgtttgctcgaggatcatattctgcaagaactaagtttcttgatgatgataataagtgctacttggagatcaactacagcttcgacatccgtaaagaatggcctgcggtttgaaactcaagaacntgagatgatgtgttgtcacttntcantagaagttgtgtttgtttcactcttttttcaccgttgaacatattattgttttttttttttttnnaaatcatcatggtagaacaagagcgacatttacttcctctttgatcttgattttttgtccagtaatctcgtttggtgtttgttctc

SEQ ID NO: 4995 - DNA, 1030 bp, Brassica napus
gctcctccttccttcccgttaacacagaaccaatctccctaaagaatctcccccaactcctcattctctcttctctcttcgtctagatcccccgaaaaaggcaaaggctttgagggattgattgattgattaatgtctttggtatcgagttccagagacatgggaggagacgacgaaagcacgtccagaacgcatcgtcacgacggcacagacgacgagggcgttgagtccttggggaggcagatgagcgagtcttctatctgcgctacagaggaagaagaggaagacgaagattcaaaattgcatctgggtcctcagtacactatcaaggagcatctcgagaaggataaagatgatgagagcttaaggaagtggaaggaacagcttcttggaagtgttgatgtcaccaacattggagagactcttgaccctgaagtgaagatcattagcctggcgatcttatcacctggaagaccagacattgttcttatggtacccgagaatgggaatccaaagggaatgtggtttactttgaaagaagggagcaagtactgtttgaaattcacatttcatgttaacaacaacattgtctctggtcttaggtacaccaatactgtgtggaagaccggcgttaaagtggatagaacaaaggaaatgcttggaacctttagtcctcagctggagccatacaaccacgtgatgcctgaagagaccactccttctggcttgtttgctcgaggctcatattctgcaagaactaagtttcttgatgatgataataagtgctacttggagatcaactacagcttcgacatccgtaaagaatggcctgcggtttgaaactcaagaacctgagatgatgtgttgtcacttttcagtagaagttgtgtttgtttcactcttttttcaccgttgaacatattattgttttttttttctttctaaatcatcatggtagaacaagagcgacatttacttcctctttgatcttgattttttgtccagtaatctcgtttggtgtttgttctca

SEQ ID NO: 4996 - DNA, 1150 bp, Brassica napus
tcttaacattctctctctctcgcctataactcggatcaccacatgactctttcatctcctcctctttcccgttatcacaaaccaaaaaatccgtaaactttgttcccattctcttctctcctctttgattagatcgatacccattgtaaatattctctacgctttgaagcgagatcctgtctttggtatctggagctgtatctggttccagagacatggacaacaacaacaacaagaacaatgaagagaacggaaacacgtccaaaacggcgtcggacgacgagggtgttggatccgtggggagacagatgagcgagtcttctctttgcgtcacggaggaagaagaagaagacgattccaaattacatttgggtcctcagtacactatcaaggagcatcttgagaaggacaaagatgatgagagtctgaggaagtggaaagaacagcttcttggaagtgttgatgtcaccaacattggagagacacttgaccctgaagtgaggatcattagcctggtcatcttatcccctggaagaccagacattgttcttatggtacctgagaatggaaacccaaaggggatgtggtttactttgaaagaagggagcaggtactgtttgaaattcacatttcaggttaacaacaacattgtctctggtcttaggtacaccaataccgtttggaagaccggtgttaaagtggacagaggaaaggaaatgcttggaacctttagtcctcagctggagccatacaaccacgtgatgcctgaagagaccactccttctggaatgtttgctcgaggatcttattctgctagaactaagtttcttgatgatgataacaagtgctacttggagatcaactacagctttgacatccgtaaagaatggcctgctgtttgaaatgaaactcaagaacaaattctcctgagttgaagtgttgccagtagaagttgtgttttgtttcactccccatctccttttttatatctttgagcatgttattgtgaatcgtttacgatcatcgtagaacaagaacgacagatattttctttcctctttgatcttgatttttagtaatgccgttggaaaatcagtatgtgtgtttgttctcaaatctatttctccttccacttcttaacatgtgtttg

SEQ ID NO: 4997 - DNA, 889 bp, Brassica napus
  misc_feature (10)..(10): n is a, c, g, or t
ccgggctgangattcggacgagggatcccatatgactctttcatctcctcctctttcccgttatcacaaaccaaaaaatccgtaaactttgttcccattctcttctctcctctttgattagatcgatacccattgtaaatattctctacgctttgaagcgagatcctgtctttggtatctggagctgtatctggttccagagacatggacaacaacaacaacaagaacaatgaagagaacggaaacacgtccaaaacggcgtcggacgacgagggtgttggatccgtggggagacagatgagcgagtcttctctttgcgtcacggaggaagaagaagaagacgattccaaattacatttgggtcctcagtacactatcaaggagcatcttgagaaggacaaagatgatgagagtctgaggaagtggaaagaacagcttcttggaagtgttgatgtcaccaacattggagagacacttgaccctgaagtgaggatcattagcctggtcatcttatcccctggaagaccagacattgttcttatggtacctgagaatggaaacccaaaggggatgtggtttactttgaaagaagggagcaggtactgtttgaaattcacatttcaggttaacaacaacattgtctctggtcttaggtacaccaataccgtttggaagaccggtgttaaagtggacagaggaaaggaaatgcttggaacctttagtcctcagctggagccatacaaccacgtgatgcctgaagagaccactccttctggaatgtttgctcgaggatcttattctgctagaactaagtttcttgatgatgataacaagtgctacttggagatcaactacagctttgacatccgtaaagaatggcctgctgttt

SEQ ID NO: 4998 - DNA, 1006 bp, Raphanus sativus
ctcctcctcctccttcctttccgttaacacagaaccaatctccccaactcctcattgtctctcatctcttcgtttagatcccaaaaaaaaaggcaaagactttgattaattaattgattgatgtctttggtatctggagctgtatcgagttccagagacatgggaggagacgacgaaagcacgtcgagaactcatcatcacaacgatggcacagacgacgagggtgttgaatccttggggaggcagatgagcgagtcttctatctgcgctacagaggacgaagaagaagacgacgattccaaattgcatttgggtcctcagtacactatcaaagagcatctcgagaaggataaagatgatgagagcttgaggaagtggaaggaacagcttcttggaagtgttgatgtcaccaacattggagagacgcttgaccctgaagtgaagatcattagcctggccatcttatcccctggaagaccagatattgtacttatggttccggagaatgggaatccaaagggaatgtggttcactttgaaagaagggagcaagtactgtttgaaattcacgtttcacgttaacaacaacattgtctctggtcttaggtacaccaatactgtttggaagaccggtgttaaagtggatagaacaaaggaaatgcttggaacctttagtcctcagttggagccatacaaccacgtgatgccggaagagaccactccttctggcttgtttgctcgaggatcatattctgcaagaactaagtttcttgatgatgataataagtgctacttggagatcaactacagcttcgacatccgtaaagaatggcctgcggtttgaaaactcgagaacaagttatcctgagatgatgtgttttcagtagaagtttcgtttgtttcactccttttcatcgttgaacatattattgtgttttttttttttaatttcctaatcatcatggtagaacaagagcgacatttacttcctctttgatcttgatttt

SEQ ID NO: 4999 - DNA, 1124 bp, Brassica napus
ggtggctcgaggctcgtctcctctgcgcgtggaacaagtacaatcatacttttgtcggaattctcggtagtgactctccacgatctctctctctctctcctgtaactcggatcatcacatgactccatcttctcctcctccttcctttccgttaacacagaaccaatctccctaaagaatctcccccaactcgtcattgtctcctctctcttccgctagatcccccaaaaaaggcaaaggctttgagggattgattgattgattaattaatgtctttggtatcgagttccagagacatgggaggagacgacgaaagcacgtcgagaacgcatcgtcacgacggcacagacgacgaaggcgttgagtccttggggaggcagatgagcgagtcttctatctacgctacagaggaagaagaagaagacgatgattccaaattgcatttgggtcctcagtacactatcaaggagcatctcgagaaggataaagatgatgagagtctgaggaagtggaaggaacagcttcttggaagtgttgatgtcaccaacattggagagactcttgaccctgaagtgaagatcattagcctggccatcttatcacctggaagacctgacattgtgcttatggtacccgagaatgggaatccaaagggaatgtggtttactttgaaagaagggagcaagtactgtttgaattcacgtttcatgttaacaacaacattgtctctggtcttaggtacaccaatactgtttggaagacaggtgttaaagtggacagaacaaaggagatgcttggaacttttagtcctcagttggagccatacaaccacgtgatgcctgaagagaccactccttctggcttgtttgctcgaggatcatattctgcaagaactaagtttcttgatgatgataataagtgctacttggagatcaactacagcttcgacatccgtaaagaatggcctgcggtttgaaactcaagaacttgagatgatgtgttgtcacttgtcactagaagttgtgtttgtttcactcttttttcaccgttgaacatattattgtttttttttttcctttccaaatcatcatggtagaacaagagcgacatttacttcctctttg

SEQ ID NO: 5000 - DNA, 1256 bp, Arabidopsis thaliana
ttgtcgtggctcgaggctatcgtctctcctatgcgcgtggaagaaatagcaattatgctttcttttgtatttgattattatccgttagtgaccctcacgatctctttctctctcatataactcggatcaccacatgacttgatcttcttgccgttaccaaaaccaaaatccctaaatttgccctcatttccctctgattagatcccttaccccgacaaagacaccaaaattcttgagggcgagagagctgattgatgtctttggtatctggagccagggacatggggttcgacgacaacaacaacaacaagaacaacaaggatggagatgatgagaactcctcctccagaacaagagccgacgacgatgctcttagtcgacagatgagcgaatcttctctttgtgctaccgaggaggaagaagacgacgattccaaattgcaattgggtcctcagtacactatcaaagaacatctcgagaaggacaaggatgatgagagtctgaggaaatggaaggaacagcttctcggaagtgttgatgtcaccaacattggagagactcttgatccggaagtgaggattgatagcctcgccatcatatctcctggaagacccgacattgttctcttggttcctgagaatggaaatccaaagggcatgtggtttactttgaaagaagggagcaagtacaacttgaaattcacttttcatgttaacaacaacattgtctctggtcttaggtacaccaatacagtttggaagaccggtgtcaaagtggacagagctaaggaaatgcttggaacctttagtcctcagttggagccatacaaccacgtgatgccagaagagaccactccttctggcatgtttgctcgaggatcatattctgcaagaactaagtttcttgatgatgataataagtgctacttggagatcaactacagctttgacatccgtaaagaatggcctgcgctttgaaactcggagaatgcgagagttgtctcctgagagaggatgttgtcggtagaagaaagttgtgtttgtttcactccatatctccgtttatttcgttgaacatataattgtgaatcgttttctgatcatcttagaacaagaacgacatttacttcctacatccttgatcttgatttttccagtaatgtcgttggaaatcagtatgtctgtgtttgttctcaactctgtttctccttccacgttaacatgtgtttgatgatatgattgtgtcagattctgaca

SEQ ID NO: 5001 - DNA, 995 bp, Raphanus sativus
  misc_feature (64)..(64): n is a, c, g, or t
  misc_feature (259)..(259): n is a, c, g, or t
  misc_feature (265)..(265): n is a, c, g, or t
  misc_feature (326)..(326): n is a, c, g, or t
gggactctccacgatctgttcactttctctctcctataactcggatcaccacatgactccatcncctcctcctccttcctttccgttaacacagaaccaatctccccaactcctcattgtctctcatctcttcgtttagatcccccccaaaaaaaggcaaagactttgagggatttaattgattgatgtctttggtatctggagctgtatcgagttccagagacatgggaggagacgacgaaagcacgtcgagaacgcntcatcncaacgatggcacagacgacgagggtgttgaatccttggggaggcagatgagcgagtcttcnatctgcgctacagaggatgaagaagaagacgacgattccaaattgcatttgggtcctcagtacactatcaaagagcatctcgagaaggataaagatgatgagagcttaaggaagtggaaggaacagctccttggaagtgttgatgtcaccaacattggagagactcttgaccctgaagtgaagatcattagcctggcgatcgtatcccctggaagaccagatattgtactcatggttccggagaatgggaatccaaagggaatgtggttcactttgaaagaagggagcaagtactgtttgaaattcacatttcacgttaacaacaacattgtctctggtcttaggtacactaatactgtttggaagaccggtgttaaagtggatagaacaaaggaaatgcttggaacctttagtcctcagttggagccatacaaccacgtgatgccggaagagaccactccttttggcttgtttgctcgaggatcatattttgcaagaactaagtttcttgatgatgataataagtgctacttggagatcaactacagcttcgacatccgtaaagaatggcctgcggtttgaaaactcgagaacaagttatcctgagatgatgtgttgtcagtagaagttgcgtttgtttcactccttttcatcgttgaacatattatt

SEQ ID NO: 5002 - DNA, 1141 bp, Arabidopsis lyrata
ctcctataactcggatcaccacatgacttgatctccttgccgttaccaaaaccaaaatccctaaatttgccctcatttccctctgattagatcccttaccccgacaaagacaccaaaattcttgagggcgagcgaggctgattgatgtctttggtatctggagccagggacatggggttcgacgacaacaacaacaacaacaacaaggacggagatgatgagaactcctcctccagaaccagaaccagaaccgacgacgatgctctcgctagacagatgagcgaatcttctctttgtgctaccgaggaagaagaagacgacgattccaaattgcaattgggtcctcagtacactatcaaagaacatctcgagaaggacaaggatgatgagagtctgaggaaatggaaggaacagcttctgggaagtgttgatgtcaccaacattggagagactcttgatccggaagtgaggattcttagcctcgccatcttatctcctggaagacccgatattgttctgttggttccggagaatggaaatccaaagggcatgtggtttactttgaaagaagggagcaagtacaacttgaaattcacctttcaagttaacaacaacattgtctctggtcttaggtacaccaatactgtttggaagaccggtgttaaagtggacagagcaaaggaaatgcttggaacctttagtcctcaattggagccatacaaccacgtgatgccagaagagaccactccttctggcatgtttgctcgaggatcatattctgcaagaactaagtttcttgatgatgataataagtgctacttggagatcaactacagctttgacatccgtaaagaatggcctgcggtttgaaactcgagaatgcgagtttgtctcctgagatgtgttgtcggtagaagaaagttgtgtttgtttcactccctatctccgttttttttcgttgaacatataattgtgaatcgtttttctgatcatggtagaacaagaaggacatttacttcatctttgatcttgattttttgtccagtaatgtcgttggaaaaatcaactctgtttgttctcaactctgtttctccttccacttaacatgtgtttgatgatatgattgtgtcagatcctcaca

SEQ ID NO: 5003 - DNA, 862 bp, Raphanus sativus
  misc_feature (275)..(275): n is a, c, g, or t
  misc_feature (539)..(539): n is a, c, g, or t
  misc_feature (777)..(778): n is a, c, g, or t
  misc_feature (780)..(780): n is a, c, g, or t
  misc_feature (801)..(801): n is a, c, g, or t
tctggagctgtatcgagttccagagacatgggaggagacgacgaaagcacgtcgagaacgcgtcatcacaacgatggcacagacgacgagggtgttgaatccttggggaggcagatgagcgagtcttcaatctgcgctacagaggatgaagaagaagacgacgattccaaattgcatttgggtcctcagtacactatcaaagagcatctcgagaaggataaagatgatgagagcttgaggaagtggaaggagcagctccttggaagtgttgatgncaccaacattggagagacgcttgatcctgaagtgaagatcattagcctggccatcttatcccctggaagaccagatattgtacttatggttccggagaatgggaatccaaagggaatgtggttcactttgaaagaagggagcaagtactgtttgaaattcacatttcacgttaacaacaacattgtctctggtcttaggtacaccaatactgtttggaagaccggtgttaaagtggatagaacaaaggaaatgcttggaacctncagtcctcagttggagccatacaaccacgtgatgccggaagagaccactccttctggcttgttcgctcgaggatcatattctgctagaactaagtttcttgatgatgataataagtgctacttggagatcaactacagcttcgacatccgtaaagaatggcctgcggtttgaaaactcgagaacaagttatcatgagatgatgtgttgtcagtagaagttgcgttcgtttcactcctnntnttattgttttttttttttttnttatttccgatcatcatggtagaacaagagcgacatttacttcctctttgatcttgatttt

SEQ ID NO: 5004 - DNA, 1103 bp, Saccharum officinarum
cagcgtccgcctcccccttccatctagggtttctagggtttgcgaggagggtttttgtgggtgtccggccggcggcgcgaggagagatggcgtcggagagggtgaccgggaccgtgaagtggttcagcgtcgacaagggtttcgggttcatcacccccgacgacggcagcgaggacctcttcgtccaccagtcctccatcaagtccgacggctaccgcagcctcaaggagggcgaggccgtcgagtacaccgtcggcagcggcaacgacggccgcaccaaggcccacgacgtcaccgcgcccggcggcggcaacctcgccggcggggaacgtcccgacggcggcaacggcggtgggcgctacggcggcggcgggggcggctacgggggaggaggcggcgaccgcggctatggcggcggaggcgaccgcggctacgggggaggaggcgaccgcggctacggcggaggaggcgaccgcggctacggtggaggaggcgaccgcggctacggcggcggcggcgaccgtggctacggcggcggaggcggctacggtggtggtggcggcggcggcggcggtcgcggctgctacaagtgcggcgaggagggccacatggcaagggactgctcccagggcggcggcggctacggaggtggcggtggtggctacggcggcggcggtggcggtggtcgcgagtgctacaactgccaccaggagggccacatctcccgcgactgccccgagaagaggcgctaggcacggcgcccccgtcgcgccggatccggcggagtcccatgtcgtctctcgcccgcttccctacccgctcaaggtattgctcggctgactctggatgaagtcgtcggagccagctatctatcagtagtagtagtatcagtgtcgtgtttcgttctggtcgatccctatcgtaggcggtggtagcaagaaaagcatgccgtatggagaagtactagtttggatctgtctcggagcagtatcagtgtctttgtgttggaatgagttgtaaggcagccatgatcatgggtggctctgcccgatctatcagttatgaactatctataatatatgaatgcaatcgagtcgttggcc

SEQ ID NO: 5005 - DNA, 1105 bp, Saccharum officinarum
  misc_feature (508)..(508): n is a, c, g, or t
  misc_feature (812)..(812): n is a, c, g, or t
  misc_feature (959)..(959): n is a, c, g, or t
  misc_feature (978)..(978): n is a, c, g, or t
  misc_feature (983)..(983): n is a, c, g, or t
  misc_feature (1058)..(1059): n is a, c, g, or t
  misc_feature (1064)..(1064): n is a, c, g, or t
agcgtccgcctccaccttccatctagggtttgcgaggagggttcttgtgggtgtgcggccggcggcgggaggagagatggcgtcggagagggtgaccgggaccgtcaagtggttcagcgtcgacaaggggttcgggttcatcacccccgacgacggcagcgaggacctcttcgtccaccagtcctccatcaaggccgacggctaccgcagcctcaaggagggcgaggccgtcgagtacaccgtcggcagcggcaacgacggccgcaccaaggcccacgacgtcaccgcgcccggcggcggcaacctcgccggcggggaacgtcccgacggcggcaacggcggtgggcgctacggcggcggcgggggcggctacgggggaggaggcggcgaccgcggctacggtggaggcgaccgcggctacggcggcggcggcgaccgcggctacggtggaggaggtgaccgcggctacgggggaggaggcgaccgcggctacggcggcggcggcgancgtggctacggcggcggaggcggctacggtggtggtggcggcggcggcggcggtcgcggctgctacaagtgcggcgaggagggccacatggcaagggactgctcccagggcggcggcggctacggaggtggcggtggtggctacgtgcggcggcggtggtggccgcgagtgctacaactgccaccaggagggccacatctcccgcgactgccccgagaagaggcgctaggcgcttggcgcggcgcccccgtcgcgccggatccggcggagtcccatgttgtctttcgcccgcctccctacccgntcaaggaatcgctcggcttactttggatgaagtcgtcggagccagctatctatcagtagtagtaggtatcagtgtcgtgtttcgttctggtcgatccctatcgtaggcggtggtagcaagaaaagcatgccgtatggagaagtactngtttggatctgtctcggancagtntcagtgtctttgtgttggaatcagttgtaaggcagccatgatcatgggtggctctgcccgatctatcagtcatgnnctatntataatatatgaatgcaatcgagtcgttggccattgtgctc

SEQ ID NO: 5006 - DNA, 1100 bp, Sorghum bicolor
ctctcgcagcgtccgcctccccttccatctagggtttctagggtttgagaggagggttctcgtgggtgtccggccggcggcgtgaggagatatggcggaggagagggtgaccgggaccgtgaagtggttcaacgtcgacaaggggttcggcttcatcacccccgacgacgccagcgaggacctcttcgtccaccagtcctccatcaagtgcgacggctaccgcagcctcaaggagggcgaggccgtcgagtacaccgtcggcagcggccaggacggccgcaccaaggccatggacgtcaccgcgcccggcggtggcaacctcgctggcggggaacgtcccgacggaggccacggcggcggtggtcgctacggcggcggcgggggcgaccgcggctacggtggaggcggtgaccgcggctacggcggcggcggcggctatggtggaggcggtgaccgcggctatggcggcggcggcgaccgtgtctacggtggtggaggtgaccgcggctacggccgcggcggcggaggcggctacggtggtggtggcggcggcggtcgcggctgcttcaagtgcggcgaggagggccacatggcaagggactgctcccagggcggcggcggcggcggctacggaggtggcggcggcggtggttacggaggtggcggcggtggccgcgagtgctacaactgccaccaggagggccacatctcccgcgactgccccgagaagatgcgctaggcgcggcgccaccgtcgcgtcggatccggcggagtcccatgtcgtctctcgcccgcttccctacccgctcaaggtatcgctcggctgactctgcctgaagtcgtcggagccagttatctatcagtagtagcagtgtcgtgtttcgttctcgtcgatgctatcgtatcgtaggtggtggtagcaagaaaagcaagccgtatggggctatctttagtagtttggatctgtgttggagcagtatcagtttctttctgttggaatcgtcagttgtatggcagccattttcatggatggctctgcctaatctatcagtcatgaactatctataatatatcaatgcaatcgtgtcggttggccattt

SEQ ID NO: 5007 - DNA, 1120 bp, Sorghum bicolor
ctctcgcagcgtccgcctccccttccatctagggtttctagggtttgagaggagggttctcgtgggtgtccggccggcggcgtgaggagatatggcggaggagagggtgaccgggaccgtgaagtggttcaacgtcgacaaggggttcggcttcatcacccccgacgacgccagcgaggacctcttcgtccaccagtcctccatcaagtgcgacggctaccgcagcctcaaggagggcgaggccgtcgagtacaccgtcggcagcggccaggacggccgcaccaaggccatggacgtcaccgcgcccggcggtggcaacctcgctggcggggaacgtcccgacggaggccacggcggcggtggtcgctacggcggcggcgggggcgaccgcggctacggtggaggcggtgaccgcggctacggcggcggcggcggctatggtggaggcggtgaccgcggctatggcggcggcggcgaccgtgtctacggtggtggaggtgaccgcggctacggccgcggcggcggaggcggctacggtggtggtggcggcggcggtcgcggctgcttcaagtgcggcgaggagggccacatggcaagggactgctcccagggcggcggcggcggcggctacggaggtggcggcggcggtggttacggaggtggcggcggtggccgcgagtgctacaactgccaccaggagggccacatctcccgcgactgccccgagaagatgcgctaggcgcggcgccaccgtcgcgtcggatccggcggagtcccatgtcgtctctcgcccgcttccctacccgctcaaggtatcgctcggctgactctgcctgaagtcgtcggagccagttatctatcagtagtagcagtgtcgtgttccgttctcgtcgatgctatcgtatcgtaggtggtggtagcaagaaaagcaagccgtatggggctatctttagtagtttggatctgtgttggagcagtatcagtttctttctgttggaaccgtcagttgtatggcagccattttcatggatggctctgcctaatctatcagtcatgaactatctataatatatcaatgcaatcgtgtcggttggccatttgatctcggatccaacagtgg

SEQ ID NO: 5008 - DNA, 1232 bp, Saccharum officinarum
  misc_feature (1137)..(1137): n is a, c, g, or t
  misc_feature (1149)..(1149): n is a, c, g, or t
  misc_feature (1156)..(1156): n is a, c, g, or t
  misc_feature (1185)..(1185): n is a, c, g, or t
cagcgtccgcctcccccttccatctagggtttctagggtttgcgaggagggtttttgtgggtgtccggccggcggcgcgaggagagatggcgtcggagagggtgaccgggaccgtgaagtggttcagcgtcgacaagggtttcgggttcatcacccccgacgacggcagcgaggacctcttcgtccaccagtcctccatcaagtccgacggctaccgcagcctcaaggagggcgaggccgtcgagtacaccgtcggcagcggcaacgacggccgcaccaaggcccacgacgtcaccgcgcccggcggcggcaacctcgccggcggggaacgtcccgacggcggcaacggcggtgggcgctacggcggcggcgggggcggctacgggggaggaggcggcgaccgcggctatggcggcggaggcgaccgcggctacgggggaggaggcgaccgcggctacggcggaggaggcgaccgcggctacggtggaggaggcgaccgcggctacggcggcggcggcgaccgtggctacggcggcggaggcggctacggtggtggcggcggccggcggtcgcggctgctacaagtgcggcgaggagggccacatggcaagggactgctcccagggcggcggcggctacagaggcggcggcggcggctacggaggtggcggtggtggctacggcggcggcggtggcggtggccgcgagtgctacaactgccaccaggagggccacatctcccgcgactgccccgagaagaggcgctaggcgctaggcgcggcgcccccgtcgcgccggatccggcggagtcccatgtcgtctcccgcccgcttccctacccgctcaaggtatcgctcggcttactctggatgaagtcgtcggagccagctatctatcagtagttgtggtaccagtgtcgtgtttcgttctcgtcgatccctatcgtaggtggtcgtagcaagaaaagcaagccgtatggagatgtactagtttagatctgtctcggagcagtatcagtgtctttgtgttggaatgagttgtagggcagccatgatcatgggtggctctgcccgatctatcagtcatgaactatctataatatatgaatgttatcgagtcgttggccattgtgctctngaatgcctgtgnttgttgnttctttggttggagttcgttcttgtcgtntgtaatctttgcagcgatcaatctcagcgtatttttggttgggagtt

SEQ ID NO: 5009 - DNA, 2160 bp, Glycine max
agtgtaacaatggctgggaaaactcaaactcactactttcttctcttgtttctcttcttaatctccatcaacgccaaacttgatctctacccttcagactacaaggcactcctaactctgcagaaggacctcggagtcaacggtcaagtctccgcaactctggcttgcgaaacagagggcgtgttctgcgagcggaggaagctctccggcaaggaaacctacgccctccgaatcaccagactcgtcttcaaatccaacaacctcaacggtgttctgtccccttccattggacgcctcacggagctcaaagaactctctctctccgacaacaacctctttggccgactccctccccaaatctttgactgcagaaagctccaaatcctcgacctcgccaacaacctcttctccggcccagtccccccagagctctcctccctcacgcgcctccgcgtgctggacatctccaccaacaggctctccggcaacctcaatttcctcaaatactttcccaatttggaaactctctccgtcgccgacaacctcttcaccggaagagtccctccctccgtccgctccttccgtaacctccgccaattcaacttctccggtaaccgcttcctcgagccctctctacaatcatcctcaccagaaacaattctctccagacgttttctgttagacggcgacggtgatgttcctgctcctgctcctgcacctgcacctaataactcaaacaagaagaaaaaatccaatgcttcttctggtgctgctgctgcaccaggtcccgcaccgaacaaccacaagcacaagaaaagtaggagaaaactcttagggtggattctggggtttgtggcaggggcagtggcgggaatcttagcaggattcgtgttttctctaatgttcaagctggctctggcgttgataaaaggaagaggaaggaaagcggggcctgatatctacagtccattgataaagaaagcagaggatttggccttcttggagaaagaagaaggaatggcatcgttggaaatcatcgggcgaggtggctgcggagaggtttacaaggccgagttaccgggaagcaacgggaaaatgatcgctataaagaaaataattcagcctcccaaagagggtgctgagttagcagaagaggacagcaaggttctgaacaagaaaatgaggcaaattcgatctgagatcactacagtgggacaaatcaggcaccgaaaccttcttcctttgctggcccacgtgtctaggccgggatgccactaccttgtttacgagttcatgaagaatggcagcttgcatgacaccctgagcaaggttgaggtgggcgagttcgagttggattggttgtcaaggcacaagatcgctctcggtgtggccgctggactcgaataccttcacttgaatcacaaccctcggatcattcatagggatctcaagcctgctaacattcttcttgatgatgacatggaggcccgaattgctgatttcggcctcgccaaggccatgcctgattacaagactcacattacaacctccaatgtggctggaactgtgggctatattgctcctgagtatcatcagatactcaagttcactgataagtgtgatatttacagctttggcgtcatacttggggtgttggtcattgggaagcttccttctcatgagttttttcagcacactgaagagatgagtttggtcaagtggatgaggaagattttgagttccgagaatcccaaggaggctattgatacaaagctgctggggaatgggtatgaggaccagatgcttcttgttttgaagattgcatgcttttgcactatggatgatccaaaggaaaggcctaacagtaaggatgtttggtgcatgctgtcacagattaagcactgactctgttggattactaatgtgtaccatatttgtgccaaagtgtgtttgtttaagaatataatcttgcttcataaggtaaattatgaaccgatgcaatattgtttccttcatcataccttgctgaatttccttggaaaatagaaagaaaatttcagcaatgcaatgatctatctataatctagtctgtcacaactagtttgcactttatatgtttatgcattcaccctgcaaataaaatagttttatgttgttacc

SEQ ID NO: 5010 - DNA, 1477 bp, Hordeum vulgare
ccacgcgtccgctccattcccatccacccccaccccccacccccttcccctctctcgctcgaggatcccacgcgccgcgcagagcgagagggatctaattgacgtcgattctgctggctctgctttcctggcgcacgtcgattgttcgttcttggcggctgtgatgttctttcctctgggtttggagaccgagaattgcccggcgcgggacggatttgcggcaatggcgaggcgttcctgagaacctggccgtccttggagcggagcttgggggacaggaggggttggcgtctgtttcgcggcggggaattgcttgctctccgcctctctgtgccgggcatggcgtcgagggacttcttgggcaggttcggcggcgagaagggcgcgtcgtcggacaaggcggggggcggcgccggcgagcccgacgaggtggtcgagctcagcctcggcctgtccctgggcggctgcttcggcgccaactccggccgggatgccaagaagccgcggctggtgcgctcctcctccctcgccgccatgtgcacgctcccgggcgccagcgacgacctcgccgccgccacgcccccgccggcgccgctcatgcgcaccagctcgctccccaccgagacggaggaggagcggtggcgccgccgcgagatgcagagcctcaagcgcctccaggccaagcgcaagcgcctcgagcgccgcacctccatgaactccggcaagtccggcggcagcagcagccgtgacgacgcccaggagccgctctaccccagcgcgttccagctccgccgctccgtcgtcgaccaggggaacacctcctcaagcatgccagaccaaggtagcggtgatggcgctgaggcgaagagcacatcgagcatggagatatcttctgataataataacaatgccagcaaccagaacaaatccctcccgccgcccgcaccatcgcctgccgggaagctgccgaacggcatcgtcaaggagcaaccgccgttgcggaccctccggtcgctgacgatgcgcacgacgagcacgggcgacctgcggaagagcatgatggaggacatgccgatggtctcgtccaaggtggacggccccaacggcaagaagatcgacggcttcctgtacaagtacaggaaaggggaggaggtgaggatagtgtgcgtctgccacggcaacttcctgacgccggccgagttcgtgaagcacgccggcggcggcgacgtcacgaacccgctcaggcacatcgtcgtcaacccctcgccgtcggtcttcttgtaatgccggaatgtacctagggggagagatgttcttttcctctctttccttttttactctgaatttttagctatcattacagtgtattatgtttagcgccctgcctttccattgagtggagaggagtggagggcctgcctgaggtgtttactgtaagttaagggagtgaactaatttgagagaattatcaggtttg

SEQ ID NO: 5011 - DNA, 1608 bp, Hordeum vulgare
gggagcgacacgcacgcagcgcaggcctccttctcctctcctctcctctccattcccatccacccccaccccccacccccctcccctctctcgctcgaggatcccacgcgccgcgcagagcgagagggatctaattgacgtcgattctgctggctctgctttcctggcgcacgtcgattgttcgttcttggcggctgtgatgttctttcctctgggtttggagaccgagaattgcccggcgcgggacggatttgcggcaatggcgaggcgttcctgagaacctggccgtccttggagcggagcttgggggacaggaggggttggcgtctgtttcgcggcggggaattgcttgctctccgcctctctgtgccgggcatggcgtcgagggacttcttgggcaggttcggcggcgagaagggcgcgtcgtcggacaaggcggggggcggcgccggcgagcccgacgaggtggtcgagctcagcctcggcctgtccctgggcggctgcttcggcgccaactccggccgggatgccaagaagccgcggctggtgcgctcctcctccctcgccgccatgtgcacgctcccgggcgccagcgacgacctcgccgccgccacgcccccgccggcgccgctcatgcgcaccagctcgctccccaccgagacggaggaggagcggtggcgccgccgcgagatgcagagcctcaagcgcctccaggccaagcgcaagcgcctcgagcgccgcacctccatgaactccggcaagtccggcggcagcagcagccgtgacgacgcccaggagccgctctaccccagcgcgttccagctccgccgctccgtcgtcgaccaggggaacacctcctcaagcatgccagaccaaggtagcggtgatggcgctgaggcgaagagcacatcgagcatggagatatcttctgataataataacaatgccagcaaccagaacaaatccctcccgccgcccgcaccatcgcctgccgggaagctgccgaacggcatcgtcaaggagcaaccgccgttgcggaccctccggtcgctgacgatgcgcacgacgagcacgggcgacctgcggaagagcatgatggaggacatgccgatggtctcgtccaaggtggacggccccaacggcaagaagatcgacggcttcctgtacaagtacaggaaaggggaggaggtgaggatagtgtgcgtctgccacggcaacttcctgacgccggccgagttcgtgaagcacgccggcggcggcgacgtcacgaacccgctcaggcacatcgtcgtcaacccctcgccgtcggtcttcttgtaatgccggaatgtacctagggggagagatgttcttttcctctctttccttttttactctgaatttttagctatcattacagtgtattatgtttagcgccctgcctttccattgagtggagaggagtggagggcctgcctgaggtgtttactgtaagttaagggagtgaactaatttgagagaattatcaggtttacagtgtccacagtggatatgctggttcagtcgatgcgcgtggcctcgcagtaaatgtaaatgtgtagtaagatttaggagaaaaaaaaaaaaaaa

SEQ ID NO: 5012 - DNA, 1518 bp, Leymus cinereus x Leymus triticoides
aacggagtaacaacgaaggagattagagcgacacgcacgcagcgcaggcctctttctcttctcctctcctctcctctccatccccgtccccctccccctccccctccccctctctatctcgctcgcttgaggatcccacgcgctgcgcacgggggagcgtgggagggatctgattgccctcgattctgcgagctctgctttcctgccgctcgtcgattgttcgttcctgggcgctgtcatgttctttcctctgggtttggagaccaagaattgcccggcgcgggacgaattcgcggcaatggcgagatgttcctgagaatttggcgttcttggactcggagcttggggaagggagagattaccgtttgtttcgcggcggagaattgcttgctccctctctctgccggccatggcgtcgagggacttcttgggcaggttcggcggcgagaagggcgcgtcgtcggacaaggcggggggtggtgccggcgagcccgaggaggtggtcgagctcagcctgggcctgtccctgggcggctgcttcggcgccaactccggccgggacgccaagaagccgcggctggtgcggtcctcctccctcgccgccatgtgctcgctcccgggcaacagcgacgacctcgccgccgcgacgcccccgccggcgccgctgatgcgcaccagctcgctccccaccgagacggaggaggagcggtggcgccggcgcgagatgcagagcctcaagcgcctccaggccaagcgcaagcgcctcgagcggcgcacctccatgaactccggcaagtccggcggcagcagcagccgggacgacgcccaggagccgctgtaccccagcgcgttccagctccggcgctccgtcgtcgaccaggggaacacctcctcaagcatgccggagcaaggtgcaggcagcggtgatggcgctgaggcgaagagcacatcgagtatggagatatcttctgataataataataatgccagcaaccagaacaaatccctcccgccgccgtcaccatcgccggccgggaagctgcccaacggcatcgttaaggagcaaccgccgttgcgaaccctcaggtccctgacgatgcgcacgacgagcaccggcgacctgaggaagagcatgatggaggacatgccgatggtctcgtccaaggtggacggccccaacggcaagaagatcgacggcttcctgtacaagtacaggaaaggggaggaggtgaggatagtgtgcgtctgccacggcaacttcctgacgccggcggagtttgtgaagcacgcgggcggcggcgacgtcacgaacccgctgaggcacatcgtcgtcaacccctcgccgtcggtgttcttgtaatgccggaatgtacctagggggagagatgttcttttcctctctttcttttttactctgaatttttagctatttatgtttgcgccctgcctttccattgagtggaaaggaatgcagggcctgcctgaggtgtttactgtaagttaagggagtgaactaat

SEQ ID NO: 5013 - DNA, 1667 bp, Brachypodium distachyon
ctttaccctcgggtttggtttaatggagtaaggaaggagattagagcgacacgcagacgagcctccagggccttctctcctctcctctcctcccctctcctctcctccggcatcctgtttccttcctcctctccattagagggatccgattgattgctgtcgatttttcgcttgttggcgtgtccttgcgcgattggacggccggcggttgttgttgatggtttctggcgggcgctggatgttcttctccccgctgtctctggaggccgcgaattgtccgccgtggggcgaatccgcagcaatggcgcgttgctcctgaggaggaattgggccgcgttctaggtcgagagcttttggggaggagagaaacagaggctatatacaggaaggctttgttaattcctttgctctggccatggcgtcgagggacttcctgggcaggttcgggggcgagaagggcgcggcgtcggagagggcggggggcggcggcggcggcgaggcagaggaggccgtggagctcagcctgggtctgtccctgggcggctgcttcggcgcgagctcggggcgggacgcgaagaagccgcggctgcagctggcgcggtcctcgtccatcgggtccatgtgctcgctccccgccggcggcggcggcggcgccggaagcgagaacgacgacctcgccgccgcaacgccggcgccggcgccgctgatgcgcaccagctcgctgcccgccgagaccgaggaggagcggtggcgccgccgcgagatgcagagcctcaagcgcctccaggccaagcgcaagcggctcgagcgccgcaactccatgaactccggcaagtccggcggcggcgccggcgacgcacaggagccgctctaccccagcgcgttccagctacgccgctccgtcgtctcgcaggggagcacctcctccggcatcccagaccaaggcggtagtgctgctgctgctgctgctgctgaggcgaggagcacatcgagcatggaaacatcttcagataacaacaacaatggcagcaaccagagcaagtctctcccgcctccggcgccgacgccggccgggaagccgccggcgccgccgccgaacggcacggcaaaggaacagcccccgccgccgccgccgctgcggacgctgcggtcgctgacgatgcgcacgacgagcacgggggacctgcggaagagcatgatggaggacatgcccatggtgtcctccaaggtggacgggcccaacgggaagaagatcgacggattcctctacaagtaccggaaaggggaggaggtccggatcgtgtgcgtctgccatgggaacttcctgacccccgccgagttcgtcaagcacgccggcggcggcgacgtcaccaacccgctcaggcacatcgtcgtcaacccttcgccgtcggtgttcttgtaagccatggctgaggagatgtaatgtacctatgggccggggttgtttgttttttttttactcctgaaatttttcttggtcatcgttagattattatggcttagtgccctgccctttttccattgagtgggaagggaaggaatgcacgggcctgcgatgtttttactgtaagttaagggagtggactaatttgagagaattatggatcagcttgacactgtccagcaatggatgatggttcagttga

SEQ ID NO: 5014 - DNA, 1421 bp, Hordeum vulgare
gcactgcagacagcgcgcggcatcagctcagagcagaaccaaggaggctcagagcacggaggaaccaaggaggccggcgagatcgacgcaacgcaaatgcagatggactcctactacttccacgacgacgcccacttcttcgccggctgcggcgtccccggctcgcccttcgccgacctcattgcgtcgctgtcgacggagccgctgcccgcggcggcggcgagccagagcgcgttccgcgagtaccgcggcgtcgggctggagcttccgggcgcggcgcggggcgggatggccggggtggggagcaagggcaacatccaccggaggatgatgggcgtgctggccaggatgggcccgagcgctgggggaagttactgtgaggaggacgggcaggaggagcggccgcagcagcaggcggccggcgccgtcgagagcagccgcgggttccggcacatgatgcgcgagcgccagcgccgcgagaagctcagccagagctacgccgacctctacgccatggtctcctcccgatccaagggggacaagaactcaatcgtgcagtccgcggccgtctacctccacgagctcaaggtcgccaaggaccagctccagaggaggaacgacgagctcaaggccaagatcctgggccacgacgcgcagcagcagtgcgtcaaggtccagttcgaggtcgacgagccctcctcctccatcgactccatgatcggggccctcaggcgcctcaagagcatgaatgtcaagacaagggggatccactccaccttgtccggccagcggttgacgacggagatgaatgtcgaaaccacgattgcggccggcgaggtagaaaaggcagtggaggaggctctccaggaagtagagaggaatcagctgcatgacagcgaggcctcgtttcccggaagcaggagcggctggccacaaacatcacacgtgcaaaatgtgttctgagatggttctgagcacgagggccatgagacacatttcttcattgttttttctcctctcttttttccgttctccttctgatgatggagcaagtgaagatctccacatgcccatgcccttgccctcgtacctcgtgtgtggtcctagtggtttgttagaggctgtcaagatgtaagtagctcttcagatgtgtaggtagcgaggtcaacttgggatcgaatgggttgaaagaatttgaagagggtcaacttgcacggtttggcttggcgcttatgtatggccgtatagcaagcaagagaaaaaggatatgacaacttgacaaggatacatgtcagccgtttggaacaagagggaccaggaagccttggctgctgggaatgtaaatttgtaactgcccaatgttcgaaatccaatatagatttttctcggaacgggatcattgtgtttcgagcaacgttttc

SEQ ID NO: 5015 - DNA, 1389 bp, Hordeum vulgare
gcactgcagacagcgcgcggcatcagctcagagcagaaccaaggaggctcagagcacggaggaaccaaggaggccggcgagatcgacgcaacgcaaatgcagatggactcctactacttccacgacgacgcccacttcttcgccggctgcggcgtccccggctcgcccttcgccgacctcattgcgtcgctgtcgacggagccgctgcccgcggcggcggcgagccagagcgcgttccgcgagtaccgcggcgtcgggctggagcttccgggcgcggcgcggggcgggatggccggggtggggagcaagggcaacatccaccggaggatgatgggcgtgctggccaggatgggcccgagcgctgggggaagttactgtgaggaggacgggcaggaggagcggccgcagcagcaggcggccggcgccgtcgagagcagccgcgggttccggcacatgatgcgcgagcgccagcgccgcgagaagctcagccagagctacgccgacctctacgccatggtctcctcccgatccaagggggacaagaactcaatcgtgcagtccgcggccgtctacctccacgagctcaaggtcgccaaggaccagctccagaggaggaacgacgagctcaaggccaagatcctgggccacgacgcgcagcagcagtgcgtcaaggtccagttcgaggtcgacgagccctcctcctccatcgactccatgatcggggccctcaggcgcctcaagagcatgaatgtcaagacaagggggatccactccaccttgtccggccagcggttgacgacggagatgaatgtcgaaaccacgattgcggccggcgaggtagaaaaggcagtggaggaggctctccaggaagtagagaggaatcagctgcatgacagcgaggcctcgtttcccggaagcaggagcggctggccacaaacatcacacgtgcaaaatgtgttctgagatggttctgagcacgagggccatgagacacatttcttcattgttttttctcctctcttttttccgttctccttctgatgatggagcaagtgaagatctccacatgcccatgcccttgccctcgtacctcgtgtgtggtcctagtggtttgttagaggctgtcaagatgtaagtagctcttcagatgtgtaggtagcgaggtcaacttgggatcgaatgggttggaagaatttgaagagggtcaacttgcacggtttggcttggcgcttatgtatggccgtatagcaagcaagagaaaaaggatatgacaacttgacaaggatacatgtcagccgtttggaacaagagggaccaggaagccttggctgctgggaatgtaaatttgtaactgcccaatgttcgaaatccaatatagatttttctcgg

SEQ ID NO: 5016 - DNA, 917 bp, Hordeum vulgare
ggccaatcgagggtcactccacaccaccaccaccaccactctcttcccccaatcccccgccccctcctcctcctccccgaaaccctagctgaaatggagcccaaatccaccacccctccgccgccgggccccgtgctgggcgctcccgtcgggtaccctccggccgccgtctaccctcccgcaccgccccccggctacccgcacgcgccggcgctctacgcgccccagccgcccccggccgccgtcgccgccgcgtcgcagcagaccgccgcgcagcagcagcagcagctgcaggtcttctgggcggagcagtaccgcgagatcgaggccaccacggacttcaagaaccacaacctgcccctcgcccgcatcaagaagatcatgaaggccgacgaggacgtccgcatgatcgccgccgaggcgcccgtcgtcttcgcccgcgcctgcgagatgttcatcctcgagctcacccaccgcggctgggcgcacgccgaggagaacaagcgccgcacgctgcagaagtctgacatcgccgccgccatcgcccgcaccgaggtcttcgacttcctggtggacatcgtgccgcgggacgaggccaaggacgccgaggccgccgtcgccgcgggcatgccccaccccgccgccggcatgcctgccgccgacatgggctactactacgtcccgcagcagtaatgtctacactatttttacagcggatttaagttgcatcttaagattgtgctgttgatttagtgctctcctatgtttgtttgtccaccgctgaataatttaagatgttgtcatcatttgaggggcctcctctctgttatgagtgattcgatccaagaagaatcgggctaggttcttctgatcgaggcaggccgaatgatgctcatgcatgtctaactgataagata

SEQ ID NO: 5017 - DNA, 950 bp, Hordeum vulgare
ggccaatcgagggtcactccacaccaccaccaccaccactctcttcccccaatcccccgccccctcctcctcctccccgaaaccctagctgaaatggagcccaaatccaccacccctccgccgccgggccccgtgctgggcgctcccgtcgggtaccctccggccgccgtctaccctcccgcaccgccccccggctacccgcacgcgccggcgctctacgcgccccagccgcccccggccgccgtcgccgccgcgtcgcagcagaccgccgcgcagcagcagcagcagctgcaggtcttctgggcggagcagtaccgcgagatcgaggccaccacggacttcaagaaccacaacctgcccctcgcccgcatcaagaagatcatgaaggccgacgaggacgtccgcatgatcgccgccgaggcgcccgtcgtcttcgcccgcgcctgcgagatgttcatcctcgagctcacccaccgcggctgggcgcacgccgaggagaacaagcgccgcacgctgcagaagtctgacatcgccgccgccatcgcccgcaccgaggtcttcgacttcctggtggacatcgtgccgcgggacgaggccaaggacgccgaggccgccgtcgccgcgggcatgccccaccccgccgccggcatgcctgccgccgacatgggctactactacgtcccgcagcagtaatgtctacactatttttacagcggatttaagttgcatcttaagattgtgctgttgatttagtgctctcctatgtttgtttgtccaccgctgaataatttaagatgttgtcatcatttgaggggcctcctctctgttatgagtgattcgatccaagaagaatcgggctaggttcttctgatcgaggcaggccgaatgatgctcatgcatgtctaactgataagataatttatctcgtgccatttctctgaaaaaaaaaa

SEQ ID NO: 5018 - DNA, 886 bp, Triticum aestivum
  misc_feature (23)..(23): n is a, c, g, or t
  misc_feature (420)..(420): n is a, c, g, or t
  misc_feature (429)..(429): n is a, c, g, or t
  misc_feature (578)..(578): n is a, c, g, or t
  misc_feature (582)..(582): n is a, c, g, or t
  misc_feature (601)..(603): n is a, c, g, or t
  misc_feature (605)..(605): n is a, c, g, or t
  misc_feature (617)..(617): n is a, c, g, or t
  misc_feature (643)..(643): n is a, c, g, or t
  misc_feature (682)..(682): n is a, c, g, or t
  misc_feature (686)..(686): n is a, c, g, or t
  misc_feature (711)..(711): n is a, c, g, or t
  misc_feature (725)..(725): n is a, c, g, or t
  misc_feature (734)..(734): n is a, c, g, or t
tcccaccaaatccagcaccccgncgcgcccgtcggctacccgccggccgccgtctacccggccgccgcgccccccggctacccgcacgcgccggccctctacgccccgcagccgccccccgccgccgtcgccgccgcgtcgcagcagaccgccgcgcagcagcagcagcagctgcaggtgttctgggcggagcagtaccgcgagatcgaggccaccaccgacttcaagaaccacaacctgcccctcgcccgcatcaagaagatcatgaaggccgacgaggacgtccgcatgatcgccgccgaggcgcccgtcgtcttcgcccgggcctgcgagatgttcatcctcgagctcacccaccgcggctgggcgcacgccgaggagaacaagcgccgcacgctgcagaagtccgacatcgccgcngccatcgcncgcaccgaggtcttcgacttcctggtggacatcgtgccgcgggacgaggccaaggacgccgaggcggccgtcgccgccgggatgccccaccccgccgccggcatgcccgccgccgacatggggtactactacgtcccgcagcagtaacncctncagtatgttacagcggatnnnanttgcatctaagnttgtgctgttgatttagtgctctccnatgtttgtttgttcaccgctgaataatttaagatgttgncatnatttgaggggcctcctctatgttanaagtgattcgatcngagaagaanccggctaggttcttctgatcgaggcaggccgtatgatgctcatgcatgtctaactgataagataatttccgtcgcgccatttctccaaatatttttgtgcatcgtaattagcagtggaaaaaaaaaaacagggcggcaggtgtgaggggtct

SEQ ID NO: 5019 - DNA, 975 bp, Oryza sativa
gctccgcatcggcagcaaccgttgcgaccaattcccccaattccattccattcccctcctcccccggagagaaaccctagcaatggagcccaaatccaccacccctcctccgcctcctccgccccccgtgctgggcgcccccgtcccttacccgccggcgggagcctaccccccacccgtcgggccctacgcccacgcgccgccgctctacgccccgcctccccccgccgccgccgccgcctccgccgccgccaccgccgcctcgcagcaggccgccgccgcgcagctccagaacttctgggcggagcagtaccgcgagatcgagcacaccaccgacttcaagaaccacaacctccccctcgcccgcatcaagaagatcatgaaggccgacgaggacgtccgcatgatcgccgccgaggcccccgtcgtgttcgccagggcgtgcgagatgttcatcctcgagctcacccaccgcggctgggcgcacgccgaggagaacaagcgccgcacgctccagaagtccgacatcgccgccgccatcgcccgcaccgaggtcttcgacttcctcgtcgacatcgtgccccgcgacgaggccaaggacgccgaggccgccgccgccgttgccgccgggatcccccaccccgccgccggtttgcccgccaccgaccccatggcctactactatgtccagccgcagtaacattttcctaccgtatagcttcaagtttatttagcgatttttatttatggaatgcttttctgctgttgtcgtagttgttattatgttttgcttgttgttgccgtgtaataactagaagatgtgattatcattgtgaggagcctcctctcggtgtataaacaatccgatttgaggattgggcgagctttgttgcgattgaggaaggctgtatggtggttttgatgcatgtctaacttatatcacaatgaattatttattacccatgttctctctta

SEQ ID NO: 5020 - DNA, 948 bp, Brachypodium distachyon
tccccaatccccttcccgtcctacccacaaccctaactcccctaatccatggatcccaccaaatccagcacccctccgccgcccccagtcctgggcgcccccgttggttatccgccgggggcatactctccccagcccggagctgccgcggccgcctacgccccgcagctctacgcgccacccgctgccgccgccgcccagcaggccgcggcggcgcagcagcacctgcagatgttctgggcagagcagtaccgcgagatcgaggcgaccactgactttaagaatcacaacctcccgctggctcgaatcaagaagatcatgaaggccgacgaggacgtccgcatgatcgccgccgaggccccggtcgtcttcgcccgcgcctgcgagatgttcatcctcgagctcacccaccgcggctgggcgcacgccgaggagaacaagcggcgcacgctccagaaatccgacattgccgccgccatcgcgcgcactgaggtcttcgacttcctcgtagacatcgtgccacgtgatgacgctaaggacgccgacgcggctgccgctgcagctgcggcggctgctgctgctgggataccccgccctgccgccggtgtgcccgccaccgacccgatggcttactactatgtcccccagcagtaatgtatcagcttaaccttacgcatttctaagcggagaatgtgttgtcttgtgactgttcttgttgctgttgttgttgccgcttaataaaatgtgttgatcatttatgggcctcccccgagcttcagaattgagctgtttggttgtagtatcacaggtgagattgttgtagttggggaggccgtatgattgcagttgtagtgcctgtctaactggccggattgggtaatccgataactattatgcggttgtctctaatgattactatgtaatttatgttcttcatttccgctgggt

SEQ ID NO: 5021 - DNA, 1049 bp, Brachypodium distachyon
aaccctaactcccctaatccatggatcccaccaaatccagcacccctccgccgcccccagtcctgggcgcccccgttggttatccgccgggggcatactctccccagcccggagctgccgcggccgcctacgccccgcagctctacgcgccacccgctgccgccgccgcccagcaggccgcggcggcgcagcagcacctgcagatgttctgggcagagcagtaccgcgagatcgaggcgaccactgactttaagaatcacaacctcccgctggctcgaatcaagaagatcatgaaggccgacgaggacgtccgcatgatcgccgccgaggccccggtcgtcttcgcccgcgcctgcgagatgttcatcctcgagctcacccaccgcggctgggcgcacgccgaggagaacaagcggcgcacgctccagaaatccgacattgccgccgccatcgcgcgcactgaggtcttcgacttcctcgtagacatcgtgccacgtgatgacgctaaggacgccgacgcggctgccgctgcagctgcggcggctgctgctgctgggataccccgccctgccgccggtgtgcccgccaccgacccgatggcttactactatgtcccccagcagtaatgtatcagcttaaccttacgcatttctaagcggagaatgtgttgtcttgtgactgttcttgttgctgttgttgttgccgcttaataaaatgtgttgatcatttatgggcctcccccgagcttcagaattgagctgtttggttgtagtatcacaggtgagattgttgtagttggggaggccgtatgattgcagttgtagtgcctgtctaactggccggattgggtaatccgataactattatgcggttgtctctaatgattactatgtaatttatgttcttcatttccgctgggtactaggaatttgttgtcatatgacagtatgtgctgtggtcactgcatattacggagtaggttgcaagcttttcccttgtatgcttttaagcaagatttattgtaattaagtcatcgatgccataacttt

SEQ ID NO: 5022 - DNA, 1247 bp, Sorghum bicolor
accaaaccaacagcctcagaaaaatcaccagctgaaaagcaccatcctcttcctcttcctcctccgcccccaatccccctcctcgtctcgccacaggccacaaccctagctgcccccgaatccatggatcccagcaaatccagcacccctccgccgcctccagtcatgggcgcccccgttgcctaccctccggcggcgtaccctcccggcgcggccgccggcgcggccgcctacgcgccgcagctctacgcgccgcccgcagctgccgcggcccagcaggcggccgccgcgcagcagcagcagctgcagatgttctgggcggagcagtaccgcgagatcgaggccaccaccgacttcaagaaccacaacctcccgctcgcccgcatcaagaagatcatgaaggccgacgaggacgtccgcatgatcgccgccgaggcccccgtcgtgttcgcccgggcctgcgagatgttcatcctcgagctcacccaccgcggctgggcgcacgccgaggagaacaagcgccgcacgcttcagaagtccgacattgccgctgccatcgcccgcaccgaggtgttcgacttcctcgtggacatcgttccgcgcgacgacgcaaaggacgccgacgcggcggccgccgcagctgctgcggctgctgctgccgggatcccgcgtcctgccgcgggagtaccggccaccgaccccctcgcctactactatgtgcctcagcagtaatgtatcatcatcgccctgttatcgtttcgtaagcgcagatttgttgtttgtgactgtcttagttgtggcggctgctgctgctgttgttaccgcgtaataagacttgtgatttatgggcctccctcgagcttaagaattgagcgtttgattctagaatccgggtaagattgttgtaagtggggggcgccctttgattgggctggtggtgtatgcctattgccaaagcctaactcatgtgatgctgtaatgagacaagtattatgcggtcgtctggtaattattgtgcaattactgctcttcatgcttctgtgtaacactctaaccagaatgtggctgtctcatgaaggtgcttgtgtgatgctaacaagcttaaatatctaagtgatttgagctttgaagagtgtcattcgaagttctgtttgttgtactatgccgagtacagtagtttagcatggcatgcaatcggttaatgaactgaatgggtgaatgtatttgattgggcaacgtgtttctcc

SEQ ID NO: 5023 - DNA, 1019 bp, Sorghum bicolor
cctcagaaaaatcaccagctgaaaagcaccatcctcttcctcttcctcctccgcccccaatccccctcctcgtctcgccacaggccacaaccctagctgcccccgaatccatggatcccagcaaatccagcacccctccgccgcctccagtcatgggcgcccccgttgcctaccctccggcggcgtaccctcccggcgcggccgccggcgcggccgcctacgcgccgcagctctacgcgccgcccgcagctgccgcggcccagcaggcggccgccgcgcagcagcagcagctgcagatgttctgggcggagcagtaccgcgagatcgaggccaccaccgacttcaagaaccacaacctcccgctcgcccgcatcaagaagatcatgaaggccgacgaggacgtccgcatgatcgccgccgaggcccccgtcgtgttcgcccgggcctgcgagatgttcatcctcgagctcacccaccgcggctgggcgcacgccgaggagaacaagcgccgcacgcttcagaagtccgacattgccgctgccatcgcccgcaccgaggtgttcgacttcctcgtggacatcgttccgcgcgacgacgcaaaggacgccgacgcggcggccgccgcagctgctgcggctgctgctgccgggatcccgcgtcctgccgcgggagtaccggccaccgaccccctcgcctactactatgtgcctcagcagtaatgtatcatcatcgccctgttatcgtttcgtaagcgcagatttgttgtttgtgactgtcttagttgtggcggctgctgctgctgttgttaccgcgtaataagacttgtgatttatgggcctccctcgagcttaagaattgagcgtttgattctagaatccgggtaagattgttgtaagtggggggcgccctttgattgggctggtggtgtatgcctattgccaaagcctaactcatgtgatgctgtaatgagacaagtattatgcggtcgtctggtaattattgtgcaattactgctcttc

SEQ ID NO: 5024 - DNA, 1532 bp, Hordeum vulgare
aatccccaatccccttccgcctaccacccacaaccctagctcccacgaatccatggatcccaccaaatccagcaccccgccgccgccccccgtcctgggcgcgcccgtcggctacccgcctggggcgtaccctcctccgccgggcgccgccccggccccctaccccccgcagctgtacgcgccgccgggcgccgccgccgcccagcaggccgcggcgcagcagcagcagcagctgcaggtgttctgggcggaacagtaccgcgagatcgaggccacgaccgacttcaagaaccacaacctcccgctggcccggatcaagaagatcatgaaggccgacgaggacgtgcgcatgatcgccgccgaggcccccgtcgtcttcgcccgcgcctgcgagatgttcatcctcgagctcacccaccgcggctgggcgcacgccgaggagaacaagcgccgcacgctccagaagtccgacattgcggccgccatcgcgcgcaccgaggtcttcgacttcctcgtggacatcgtgccccgggacgacgccaaggacgtcgaggcggccgccgccgcggccatggccacggcggcggccggcatcccgcgccctgccgccggcgtgcccgccaccgacccgagcatggcgtactactatgtcccccagcagtaatgtatcatcctaaacttgcgcatttctaagccgagaatgtgttgttctgtgactgtccttgatgctgttgttgtcgcggcataataagaagatttatgggcctcccctgagcttatgaattcagctgtttggttctagcatgtattgcggtaggattgttgtaatgggggaggccgtatgattgctgcggtagtgcatgattaactggccgcctagtgtaatctgatgaccattatgcagtgcctctcatggctactatgtatttatgttcttcattttcgccgtgcactagttttttgttgttctatggcagcgttgtgctgtgattactgcatattaggttgcaaggttctcccaatgctttcaagcaaggcttgttgtaattaagccttggaagcaaaatgtggaaactacagataaactgactgtaatattggactgacgtaggttcttgcttcatattggtgtggtaataagatagtgtggatagcggccgctgccgaaacttgggcatcgtcaagcaccacaccgttccatacactcctcaacagaatggtgtggctgagcgtatgaatagaacaatcatctccagagcttgctgcatgttgtccaatgcttggacgggcaaacgtttttgggctgaagcagtctccaccgcctgctacctcatcaacaggtctccatctattccacttaacaagaaaactcccattgaggtatggtctggtacaatggctgattattcacagttgagagtttttggttacaatgcatatgcacatgttgataacagaaaacttgagactacagctattaagtgtgtattggctggatatggttcacgagtaaaaggatatcgcttatggaa

SEQ ID NO: 5025 - DNA, 1216 bp, Zea mays
acgtacccgttccatctcaagtgaaagagatgacaactgtcctaacaaacaaactagggctcaaaactaacttcaaaaaaatcacccactaaaagcaccttcctcttcctcttcctccgcccccaatccccctcgtctcacaaccctagctgcccccgaatccatggatcctaacaaatccagcaccccgccgccgcctccagtcatgggtgcccccgttgcctaccctccgcctgcgtaccctcccggtgtggccgccggcgccggcgcctacccgccgcagctctacgcaccgccggctgctgccgcggcccagcaggcggcggccgcgcagcagcagcagctgcagatattctgggcggagcagtaccgcgagatcgaggccactaccgacttcaagaatcacaacctcccgctcgcccgcatcaagaagatcatgaaagccgacgaggacgtccgcatgatcgccgccgaggctcccgtggtgttcgcccgggcctgcgagatgttcatcctcgagctcacccatcgcggctgggcgcacgccgaagagaacaagcgccgcacgctccagaaatccgacattgccgctgccatcgcccgcaccgaggtattcgacttccttgtggacatcgttccgcgcgacgacggtaaagacgctgatgcggcggccgccgcagctgccgcggctgccgggatcccgcgccccgccgccggagtaccagccaccgaccctctcgcctactactacgtgcctcagcagtaatgtatcatcatcacgttattgttccgtctatgtgcctgagcaataatgtatcatcattgccttattgttccggggcagttgtgttatttgtgtctgtttagttgctgctgctgttaccgcgtaatagcatatgtgttatctgtgtctgtttagttgctgctgctgttgccgcgtaataaaacttggtcatttacggggctccctcaagattaagaattgagttgtttgatggtagaatcctggtaaggttgttgtaactggggggcgcctttgtttgggctggtagtgtatgcctaggcctcacttatctgatgctgtaatgcgacaagtattatgtggttgtctggtaattattgtgcaattactgctcttcatgtttctgtgtaacactcataagggcttgttggtttcatcccatcaagtggattggatgggattaaagggtattga

SEQ ID NO: 5026 - DNA, 1192 bp, Sorghum bicolor
aacggcgcaaaggtctctcctttcctttctcccctcgctgttcctcccccaacccaatccgatcactgtctccggaacaccctagcaatggagcccaaatccaccacccctcccccgcctccggtcatgggcgcgcccgtcgcgtaccctccgccccccggcgccgcgtaccccgccgggccgtacgcgcacgcgccggcagccgcgctgtaccctcctcccccgccgccgccggctcccccaacctcgcagcagggcgccgcggcggcgcagcagctgcagctcttctgggcggagcagtaccgcgagatcgaggccaccaccgacttcaagaaccacaacctgccgctggcccgcatcaagaagatcatgaaggccgacgaggacgtgcgcatgatcgccgccgaggcgcccgtcgtcttcgcccgcgcctgcgagatgttcatcctcgagctcacccaccgcggctgggcgcacgccgaggagaacaagcgccgcaccctgcagaagtccgacatcgccgccgccgtcgcgcgcaccgaggtcttcgacttcctcgtcgacatcgtgccgcgggacgaggccaaggaagccgactccgccgccgccatgggaccagccgggatcccgcaccccgccgccggcctgcccgccaccgaccccatgggctactactacgtccagccgcagtaacgaatttggcttcgcttccatggagcctctgcggtttttatttagtaaattaatttaattactactgagactgccctgttgttacccatgttctcctgttgccacccaataactctaagatggcgtgatgatgatcatctgatgtgcccccctttgagtaacaagtgattccatttcacatttcatttctgatgatctgagagagatgactgctcgtaattaagagggaggctgtgtgatgctgatggttcatgccatgcttaacagataaggttgcctgtcgtaattattaatcattgtgctagtactgttaccttgtccaaactcccaactgccgtgaaattactcatgttcttgttactttgtcttgaacctatatttgtgtagtgtcatgctttttctttagatttttgtagtaggatagaaaagcaattattttccaattgtaatgcagtgggggctttatgtaatctcaagcttgttagtagcacacatattt

SEQ ID NO: 5027 - DNA, 969 bp, Zea mays
acctctgttcagccaaagccacctccccaaacccaatcccgtcactatctcattcccctgaccgccggaacaccctaggcaatggagcccaaatccaccacccctcccccgccccccgtgatgggcgcgcccatcgcgtatcctcccccgcccggcgccgcgtaccccgccgggccgtacgtgcacgcgccggcggccgcgctctaccctcctcctcccctgccgccggcgcccccctcctcgcagcagggcgccgcggcggcgcaccagcagcagctattctgggcggagcaataccgcgagatcgaggccaccaccgacttcaagaaccacaacctgccgctcgcccgcatcaagaagatcatgaaggccgacgaggacgtgcgcatgatcgccgccgaggcgcccgtcgtcttctcccgcgcctgcgagatgttcatcctcgagctcacccaccgcggctgggcacacgccgaggagaacaagcgccgcacgctgcagaagtccgacatcgccgccgccgtcgcgcgcaccgaggtcttcgacttcctcgtcgacatcgtgccgcgggacgaggccaaggacgccgactccgccgccatgggagcagccgggatcccgcaccccgccgccggcctgcccgccgccgatcccatgggctactactacgtccagccgcagtaacgaatttgcttccttatcatggtttcgcttccatgcagcctttgcgggtttttagtaaactattattattactgagagtgccctgttgttacccatgctctgttgttgccacccaataactcgatgacctgatgatcatctgatgtgcctcccgttccgtaacaagtgattccatttctgattacagagagatggctgctcgtaattaagagtgaggctgtgtgatggttatggtacatgtcatgcttgtcgtgattattaatcattagtgctggtactcttatg

SEQ ID NO: 5028 - DNA, 1137 bp, Sorghum bicolor
aatccgatcactgtctccggaacaccctagcaatggagcccaaatccaccacccctcccccgcctccggtcatgggcgcgcccgtcgcgtaccctccgccccccggcgccgcgtaccccgccgggccgtacgcgcacgcgccggcagccgcgctgtaccctcctcccccgccgccgccggctcccccaacctcgcagcagggcgccgcggcggcgcagcagctgcagctcttctgggcggagcagtaccgcgagatcgaggccaccaccgacttcaagaaccacaacctgccgctggcccgcatcaagaagatcatgaaggccgacgaggacgtgcgcatgatcgccgccgaggcgcccgtcgtcttcgcccgcgcctgcgagatgttcatcctcgagctcacccaccgcggctgggcgcacgccgaggagaacaagcgccgcaccctgcagaagtccgacatcgccgccgccgtcgcgcgcaccgaggtcttcgacttcctcgtcgacatcgtgccgcgggacgaggccaaggaagccgactccgccgccgccatgggaccagccgggatcccgcaccccgccgccggcctgcccgccaccgaccccatgggctactactacgtccagccgcagtaacgaatttggcttcgcttccatggagcctctgcggtttttatttagtaaattaatttaattactactgagactgccctgttgttacccatgttctcctgttgccacccaataactctaagatggcgtgatgatgatcatctgatgtgcccccctttgagtaacaagtgattccatttcacatttcatttctgatgatctgagagagatgactgctcgtaattaagagggaggctgtgtgatgctgatggttcatgccatgcttaacagataaggttgcctgtcgtaattattaatcattgtgctagtactgttaccttgtccaaactcccaactgccgtgaaattactcatgttcttgttactttgtcttgaacctatatttgtgtagtgtcatgctttttctttagatttttgtagtaggatagaaaagcaattattttccaattgtaatgcagtgggggctttatgtaatctcaagcttgttagtagcacacatattt

SEQ ID NO: 5029 - DNA, 755 bp, Brassica oleracea
  misc_feature (607)..(607): n is a, c, g, or t
acgttaagtattcttaatcaccggtttaatgcttgtctgggacataagctaaaaaacacaagtgaataacatcttgtaataaaaaaaagttaaatccacaagaacatccactacaagaaatcgtgtgaagacaatcttgtcttagagtcactgcgaattgtctaaagcccctggccccctaacgaatcccgattccgagtttttaggagtaaaatggcggatacgccttcgagtccagccggagacggcggagaaagcggcggcggatcggttagggagcaggaccggtacctacctatagctaatataagcaggatcatgaagaaggcgttgcctcccaacggcaagatcgggaaagatgcgaaagacactgttcaggaatgcgtctctgagttcatcagcttcatcaccagcgaggcaagtgataagtgccagaaagagaagaggaaaactgtgaatggtgaggatttgctgtgggcaatggcaactttggggtttgaggattaccttgaacccttaaaggtataccttgcgaggtacagggagttggagggggataataaggggtcaggaaagagcggtgatggatctaatagagatgcagctngctggggtgttccgaatgaagatatgccgagctggtgaaagaagttgcaagtgaagtctctagagataaagaacaacgccaaaatgatcagggaatatttagagatcggtgtggtgtttgacataaagttagagagatccggttttag

SEQ ID NO: 5030 - DNA, 626 bp, Thellungiella halophila
  misc_feature (511)..(511): n is a, c, g, or t
  misc_feature (596)..(596): n is a, c, g, or t
gaaccatatcgtcttgacaagcagccgcccaaactctgcgataattttcgtcggtagaaaatttggactttctcctaagccctaaatatcccaagttccactatcggaatctagtaaaatggcggatacgccttcgagcccggccggagatggcggagaaagcggcggctccgttagggagcaggaccgataccttcctattgctaatatcagcaggatcatgaagaaggcgttgcctcccaacggaaagatcggaaaagatgctaaagacaccgtccaagaatgcgtctctgagttcatcagcttcatcaccagcgaggccagtgataagtgccagaaagagaaaaggaaaactgtgaatggtgaggatttgttgtgggcgatggcaacattaggatttgaggattacctggaacccttaaagatatatctagcgaggtacagggagttggagggggataataagggctcaggcaagagtggagatggatctaatagagatgcagctggnggtgcgtctggtgaagatatgccgggctggtgaaaaaaaagtcgcaagtgaactctctagagatcaagaacaacgccaaatgatncagtaattcctctatctatcacaacggcta

SEQ ID NO: 5031 - DNA, 785 bp, Arabidopsis lyrata
gcgtttcgtagaaaaattcgatttctctaaagccctaaaactaaacgactatccccaatttcaacttctagggtttctcccactttctccaatctagtttaatggcggatacgccttcgagcccggccggagatggcggagaaagcggcggctccgttagggagcaggatcgataccttcctatagctaatatcagcaggatcatgaagaaagcgttgcctcctaatggaaagattggtaaagatgctaaggatactgttcaggaatgtgtttctgagttcatcagcttcatcactagcgaggccagtgataagtgtcaaaaagagaaaaggaaaactgtgaatggtgatgatttgttatgggcaatggcaacattaggatttgaggattacctggaacctctaaagatatatctagcgaggtacagggaggtatggtgataataagggatcaggaaagagcggagatggatctaatagagatgcaggtggaggtgtttctggtgaagaaatgccgagctggtgaaagaagtagtgatcaagaacaaggccaaatgatcaagtaattcttctctctaatacacagcctcatgtacacaaatgaagagcatagtctatatgcatgggaaattagagatcagtgagttgtttatagttgagctgatcgacaactatttcgggtttactctcaatttcggttatgttagtttggacttttggttttctatttccggtttagttggttgtatttaaagatttctctgttagatttgagaacactttgaa

SEQ ID NO: 5032 - DNA, 827 bp, Arabidopsis thaliana
tataaacaccagtcgcagcgtttcgtagaaaaattcgatttctctaaagccctaaaactaaaacgactatccccaattccaagttctagggtttccatcttccccaatctagtataaatggcggatacgccttcgagcccagctggagatggcggagaaagcggcggttccgttagggagcaggatcgataccttcctatagctaatatcagcaggatcatgaagaaagcgttgcctcctaatggtaagattggaaaagatgctaaggatacagttcaggaatgcgtctctgagttcatcagcttcatcactagcgaggccagtgataagtgtcaaaaagagaaaaggaaaactgtgaatggtgatgatttgttgtgggcaatggcaacattaggatttgaggattacctggaacctctaaagatatacctagcgaggtacagggaggtatggtgataataagggatcaggaaagagtggagatggatcaaatagagatgctggtggcggtgtttctggtgaagaaatgccgagctggtaaaagaagttgcaagtagtgattaagaacaatcgccaaatgatcaagtaattcttctctctatcacacggcctcatgtacacaaatgaagagcatagtctatatgcatgggaaattagagatcagtgagttgtttatagttgagctgatcgacaactatttcgggtttactctcaatttcggttatgttagtttgaacgtttggtttattgtttccggtttagttggttgtatttaaagatttctctgttagatgttgagaacacttgaatgaaggaaaaatttgtcc

SEQ ID NO: 5033 - DNA, 721 bp, Raphanus sativus
  misc_feature (370)..(370): n is a, c, g, or t
ggattcatgtaaaaatagcagctgcccaaatctctatgtgcgacttgacatctctctaaaagccctaactaactaattccaaggaaaggaaatggcggatacgccatcgagccccggcggcggagaaagcggcggttcggttagggagcaggaccggtacctaccgatagctaacataagcaggatcatgaagagagctttgcctcccaacggaaagatcggtaaagatgctaaagacactgtccaagaatgcgtctctgagttcatcagcttcgtcaccagcgaggccagtgataggtgtcagaaagagaaaaggaaaactgtgaatggtgaggatttgttgtgggcaatgacaacgttaggatttgangattacttggaacccttaaagctataccttgcgaggtacagggagttggagggggataataagggctcaggaaagagcggggagagtaacaatagagatgcagctgggggtgcttccggtgaagatttgccgagctggtgaggcgagaagtttcaagtgaactctttagaaataaagaacaacaccaacatgatcaagggatagcagagatcagtgttgttgtctttacatttgagctcatggtcgaatttcggttatgtgataacttgagaattttggttatctgtttccggtttagttggttgtagttgaagatatgagaagtatttgaaagtagaaaaattttctcca

SEQ ID NO: 5034 - DNA, 731 bp, Cleome gynandra
tagtggtaaatggatacgcccacgagccctgtaggagatggtggagagagcggtggctcggtcagggagcaggatcggttcctgccgattgctaacattagcaggatcatgaagaaggccttgcctccaaacggaaagatcggcaaagatgctaaggatactgttcaggaatgtgtctccgagttcatcagcttcatcaccagcgaggccagtgataaatgccagaaagagaaacggaaaactgtgaatggagatgatttgttgtgggctatggcaacattaggttttgaagattatctcgatcccctaaggatatatttgcaaaggtacagagagttagagggtgataataagggatcagcgaaaggcggagatagttctaatagagatggtgccggggcttttcctggccaagacatgcctggctggtagaagaacttgcaagtctgattttttcgaggtgaagaactatgccaacgaccaagtaatccctctttctatcatacggccataatgaagagcatgttctttatgcatgtaggttttgtgctcgatccttctggaagcctccttttctttaatggcttttctttccttgctttctctatccatccttttcgtggtacgaattgatgatagcacattggaaaataaaattttgatgaagatcaacatgtcagctgagacctagggagcatatgattcggtttatttcatatcatgttttgggt

SEQ ID NO: 5035 - DNA, 971 bp, Populus trichocarpa
aaaataaaattcggcaaatcataaactgctatctccttcatccctcccccttcttctctcttctccatcgtcagatctaaaaaaatttctctctttctgtttctccccccccttccaactctcgcgccaaatacaaaacagctcccccccccctctctttctccagtaagatggccgataatccgaccagtccggcggcggggagccacgagagtggtggtgagcagagcccgcggtcaggggtgagagagcaggatagatacctgcctattgctaatataagtaggatcatgaagaaggcgttgccggctaatggaaaaattgctaaggatgctaaggatactgttcaggaatgtgtttctgagttcattagctttgttaccagcgaggcgagtgataagtgtcagaaggagaagaggaagacgatcaatggggatgatttgttgtgggcaatggcaacgttaggatttgaggattatattgagccacttaaggtgtacctggctaggtaccgggagcaacttggagggtgatgcaaaggggtctgctagaggtggagatggatcttctaaacgggatgcagttggaggtctgcctggtcaaaatgcacagtttgcttttcaaggatcgatgaactatacgagtccacaagtgcagggacagcatatgatccttccttccatgccaggcaacgagtagggtttggctttgctttggtcaattcagtgaattgtaagttgtaacgttggtaaaactttttagttccaacacttgtagaatctaatctctcgcattagttgatctgattggaaccaaagtgccctatatattttggtggctttggtttttggttgtttgttgggggtggtttgaatttggttggtgccttcatcatcagtgcagttttaatagttagattaatttctgtaaatttgttttctcaaatatatatttttccgagcattgcaagt

SEQ ID NO: 5036 - DNA, 1257 bp, Manihot esculenta
  misc_feature (16)..(16): n is a, c, g, or t
  misc_feature (1108)..(1108): n is a, c, g, or t
gggaaaaaaaatcagnaaaataagtttctcttctcctcttctctcagcgatccaagcttcttctccatcgtcagatctcttcacgcaatcaaaacaattccaccaatcccttccctttctctctctttcaactcgcgccaaatacaaactctctaactaaccctctccctctccctcctctctctctctctctctctctctctctctctctctacagggatttcgttgagatggcggataacccaacaagtccggcaggagggagccacgagagtggtggcgagcagagcccccactctggggtgagagagcaggataggtacctgcctattgccaatataagcaggatcatgaagaaggccttgccagcaaatggaaaaattgctaaagatgctaaggataccgtccaggaatgcgtctctgagtttatcagttttattaccagcgaggcaagtgataagtgccagaaggagaagaggaagacaatcaacggggatgatttgttgtgggcaatggcaacattaggctttgaggactatatagaaccgcttaaggtgtacctagctaggtacagggagatggagggtgacactaagggatctgcgaggggtggagatggatcagctaaaagggatgcaattggaggtctgcctgttcaaaaccctcagtttgctatccagggatcaatgaactacattagttcccaggcgcaaggacagcatatgattgttccatccatgcaaggcaatgagtagagagttctagtttcatattaccaatctaatgaaatttagggccagtaaaactgtttaatgtccaacttctatagcatctttgatattggtttatcagatatgaaccaaagtgcattatattcttggggctttggttttggttgttggggtttggattttgtgggttctctctctggcagaacagctttaatagtcacataaatgctgtaaattgttttttttttttttaacattctcctgactatttgaagagactgatctcataaatctctatattgtatctttgtcaattctcatcttttgtgtgtattgttcatcatgttgctctgcaatgaactcttctgtagcagccntattgaaggcatgtaactctccctgcctctctgctgtggggagactctctgtaagtggactgccgttcaaatttctgttggaaacgccagtgaccatcagttttttttttttttttttgtgaaatactatattttccatattctccatt

SEQ ID NO: 5037 - DNA, 973 bp, Ricinus communis
atgggtattgcttgtaatttgaaagaatactggggaattttgattgagatggcggataacccaacaagtccagcaggagggagccacgagagtggtggtgagcagagcccacactccggagtgagggagcaggatagatatcttcctattgctaacataagcaggatcatgaagaaagctttgcctgccaatggaaaaatcgctaaagatgcaaaggatactgtccaagaatgtgtctcggagtttattagctttattacgagcgaggcaagtgataagtgtcagaaggagaaaaggaagacaatcaatggggatgatttgttgtgggcaatggccacattaggctttgaggactatattgaaccgcttaaggtgtacctggctaggtacagggagatggaagggtgacaccaagggatctgctaggggtggggatggatctggtaaaagggatgcaatgggaggtttgcctggtcaaaacccacagtttgctcttcagggatcaatgaactacatcaattcccaggcacaagggcagcatatgattgttccttccatgcaagggaatgagtagagttgtagtctctattatttaatctaatgaagtttagggcagtaaaactgtttagctttcgatgcttatagcatcttttatattggtttatgatcctactgaaatcaaagtgctatatatatatatatatatatatatatatattcttggggctttggtttttggtggtgattggggtttggattttgttggggccctcttcagcagaacagctttaaaagtcacataagtactgtaaatttgatttttttttttttttttatctaatatacaatcttctgactgcttaaagaaactgatttcttatggagcttcagattgtaaaccacataaatttcagtcgttatgtgcatatcatttatcattttgctctccgggacatttggacaggtctctgcc

SEQ ID NO: 5038 - DNA, 1184 bp, Ricinus communis
ggaatctctctctctttctctatcatctcctccttctttataacaatcaaactctcttctccatcgtcagatctcttttttgttctctcaataaaaacaattccaccaattgaatcgcttttctctctcgcgccaaatatacgaacctttctcttcttcttcttcttcttcttcttcactttctctaactacccctctctctctatctcttcctttacagggaattttgattgagatggcggataacccaacaagtccagcaggagggagccacgagagtggtggtgagcagagcccacactccggagtgagggagcaggatagatatcttcctattgctaacataagcaggatcatgaagaaagctttgcctgccaatggaaaaatcgctaaagatgcaaaggatactgtccaagaatgtgtctcggagtttattagctttattacgagcgaggcaagtgataagtgtcagaaggagaaaaggaagacaatcaatggggatgatttgttgtgggcaatggccacattaggctttgaggactatattgaaccgcttaaggtgtacctggctaggtacagggagatggagggtgacaccaagggatctgctaggggtggggatggatctggtaaaagggatgcaatgggaggtttgcctggtcaaaacccacagtttgctcttcagggatcaatgaactacatcaattcccaggcacaagggcagcatatgattgttccttccatgcaagggaatgagtagagttgtagtctctattatttaatctaatgaagtttagggcagtaaaactgtttagctttcgatgcttatagcatcttttatattggtttatgatcctactgaaatcaaagtgctatatatatatatatatatatatatatatattcttggggctttggtttttggtggtgattggggtttggattttgttggggccctcttcagcagaacagctttaaaagtcacataagtactgtaaatttgatttttttttttttttttatctaatatacaatcttctgactgcttaaagaaactgatttcttatggagcttcagattgtaaaccacataaatttcagtcgttatgtgcatatcatttatcattttgctctccgggacatttggacaggtctctgcctttggttttatggagactatttttg

SEQ ID NO: 5039 - DNA, 1256 bp, Citrus sinensis
gatcatcctcccatctctccctccctctcttctccatcgtcagattttctttctccttaaaaaccaaaaaccaaaatcaaatcaaattaaaccaaaaaaaaaaactattaaaaataaacaaatcataattcataaccaatcgccacctccctctccccccttctccaaactcgcgcgccaaatacaaaaactctggggattttattggtcggagatggcggaagcaccgacgagtccggcgggaggtagccacgagagcgggggagagcagagcccgcacgctgggggagtgagagagcaggacaggtatttgccaatagctaacattagcaggatcatgaagaaggctttgcctgctaatggcaagatcgctaaggatgctaaggatactgtacaggaatgtgtctctgagttcatcagcttcattaccagcgaggcgagtgataagtgtcagaaggagaagaggaagacaattaatggggatgatttgctctgggcaatggcaactctgggttttgaagattatattgatcctcttaaggcataccttatgaggtacagggagatggagggtgacaccaaaggatctgctaggggtggggatggatctgctaaaagggacacgattggagctctgcctggccaaaatgcacagtatgctcttcagggtccactcaactatgctaatccccaagcacaggggcagcatatgatcgttccatccatgcagggaaatgaataagtggtttctagcttcactgtcacatattttatgattttagggttgctcaaattgtttagtttcaacacctatagcatctttgatattaacttatctgcttgatctgaagttctatattttttcagatttttttccttttatgtttgttgttgagggtgatggtggttcggatttttttcccttcgctttgtcttctacgtgcccttatcaacaaaacaactgtggtagtccgatgattagtgctgtaaatttgactctttatttaatagatgattgcatgaaacatatgaagaacttatcaatcgccgcctagcgttttagcccctgacccgccgtcccgaaccgatgatgataacgtagacacacgtggtgtatagataacaacttaaggttacaaacccgaagatatgaaaacaagaagctaatatgaggggggggcggcccctctgagcctctccgggggggggcgccccgttctttcccaccctcattttttttcatagctgtgggcctg

SEQ ID NO: 5040 - DNA, 949 bp, Tropaeolum majus
atcgcattcttcatcttctctcctttcctctcttctccatcgtcagatcttcactctttcaataaaacatatttcttgtttcatctctccatcgcgcgccaaatacaaaaactcgtacccgcactcactctctacagctttttggtgagatggcggatgctccgacgagtccaccgggagggagtcacgacagtgggggtgaccatagcccccgctcaggggtgagagagcaagaccgctacctgccgattgccaatataagccggatcatgaaaaaagcattgccgcccaacggcaagatcgccaaggacgcaaaggatactgttcaggaatgcgtttccgagttcatcagcttcatcaccagcgaggctagtgataagtgtcagaaagaaaagaggaagacaattaatggggacgatttgttgtgggcaatggcaacactggggtttgaagagtatattgaacctctcaaggtgtacctgtctaggtacagggagactgagggtgatactaagggatctgctaggggtgaaggatctctgaaaagagatggagttggaggtatacctggccaaaacacacagtttgctcttcagggatctgtgaactacattaataaccaaggacaagggcatcatttgatccatccttccatgcaagggaatgaataggcaagtgtcgcttctgtgtaaccaaattttaaagaatattagggctggtaaagttatttaattttaacacctatagcatgtcacatggatttgaaagtagattctgtatccttatgtttttgttttccttcattgcttggggatgttgctttaccctcatcatcaagcagagatttaatggtgatgatgatgtaagcagagatttaatggtgatgatgtaaattatgtcttccccttcatataacacttacatttcaaaaagactataatctttgtgc

SEQ ID NO: 5041 - DNA, 1078 bp, Gossypium hirsutum
  misc_feature (13)..(13): n is a, c, g, or t
  misc_feature (789)..(790): n is a, c, g, or t
gcctggcagcgtngacactatatggatccaaagaaaactttgcttcaacgacaaagagaaaaaatctctctcaaattttcattttttttctatcattcctttcttctccatcgtcagatctctctttcattccttgcaccaaataaaacaaataatttaaccaatcaaatcctctcgcgccaaataagagagaaatccctttttttttcttctctatttcctttcccttcagttgtgatttaggttttctggggacatggcggatggtatgggaggagggccaacgagtccggcaggagggagccatgagagtggaggagagcacagcagtcctcagtcaactgtgagggaacaagatcgttacctcccaattgctaatataagtagaatcatgaagaaagcattgccttctaatgggaaaattgctaaggatgctaaagatactgttcaagaatgtgtttccgagttcatcagcttcatcactagcgaggctagtgataaatgtcaaaaagagaaaaggaagacaattaatggagatgacttgttgtgggcaatggcaacattaggattcgaagactatatcgagccacttaaaatataccttgccagatacagggagttggagggtgacaccaagggatcagcccgtggtggtgatggatcttttaaaagagacgcagccggagctcttcctgcccaaaatccacaggcacaaggacagcatatgatcattccctccatgcaaggcaacgagtaagtagctgtagcccgatcctagcattcggtacnnagtttacaagggctgattaaattgtgggtttcatcttatttatgaaaagctacatagttctaaggtgatttgggagttataaaaaagtcttttttaagtgctgtcctttgggcacctctgtgccatggtatccgagcagcataggcacctgccggtcttaatgctggagcacctccagagaccacatgccttggtgtggtagcattatatgacagataactagttgaattgtgcatttgagaaaaatattggtttcagatatttgaatgctttatgcttcatttctcc

SEQ ID NO: 5042 - DNA, 918 bp, Glycine max
gattgttttctttatcgaatatatatatatatatatatatatatatatatatatatatatttgcattgtaatttgtagggtttgtgagatgtcggatgcgccaccgagcccgactcatgagagtgggggcgagcagagcccgcgcggttcgtcgtccggcgcgagggagcaggaccggtacctcccgattgccaacatcagccgcattatgaagaaggctctgcctcccaacggcaagattgcaaaggatgccaaagacaccatgcaggaatgcgtttctgagttcatcagcttcattaccagcgaggcgagtgagaaatgccagaaggagaagagaaagacaatcaatggagacgatttgctatgggccatggccactttaggatttgaagactacatagagccgcttaaggtgtacctggctaggtacagagagggtgacactaaaggatctgctagaagtggtgatggatctgctacaccagatcaagttggccttgcaggtcaaaattctcagcttgttcatcagggttcgctgaactatattggtttgcaggtgcaaccacaacatctggttatgccttcaatgcaaagccatgaatagtttagatgcttctacgcatcttatttatttccctttaatgcttgtacgcatggcatgggtggaaacaattgtctggtgatttaatatttaggttctcgtgtagaagggtgtcagaattttgttacggtactaatgtagatttttattaatacatgtcttatttagctttgtaatacctactcaagggagagatgtgtttagggttatgctagtgattcgccatgtagcttgtcagggtgagaagcacttgcttttagagttttctttagattattatataatatataatatttgcagacactgcatttgttact

SEQ ID NO: 5043 - DNA, 984 bp, Medicago truncatula
aacatccaatcaattgtgttctccttgagcgccaaatacacttttctctctcacatactttcaacaaatagggtttatgcgccatggcagatgcaccgaaccaatgcgaagaaagccacgagagtggtggtgaacagagtccacgtggctcttcttctgcttcacgtgaacaagatcgttttttgcctatagctaacattagcagaatcatgaaaaaagctttaccttcaaatgggaaaattgctaaggatgctaaagatacgatgcaagaatgtgtttctgaattcatcagctttattaccagcgaggcaagtgagaaatgccagaaagagaagagaaagaccattaatggagatgatttgttatgggctatggctactttaggatttgaagattatatagaaccacttaaggtgtacctagcaaggtacagagagggtgacagtaaaggatctgttagaaacagtgatggatctggtagacgagatcaagttggcggtcctccaggtcaaaatgctcagtttgttcatcagggttctttgagctatattgattcccaggtgcatccacaacatctggttatgccttcaatgcaaaatcatgaatagattagatgcttctcctcacctgccattttcattgtgttgcacctcttccgccattttcctactaaaaagaccaagaagcttctcctcaaaaaagatgaactgaaacaatggtttggtgattttaaatttaggcgctcgtgtgtagaaactagaaagcatgggtgtcaaaattttgttacggtattcaggtagattttgaatacaattattaaatttagctgccttgcccaccaaagggaagataatatgtgttctgtatgtatgtgattcatcatgcaacttgtcatggtgagaagtgcctgttttgagaactctatttagatcttagtattagcatgtcattacaaactgcatttattatttcatttagtttagg

SEQ ID NO: 5044 - DNA, 729 bp, Secale cereale
caaccttttactgtcgaaaaccggcttgccaagtgtggataatcggagaaggtgccgatgccactcaacagctcagggcaccgaaaggaacacggttcatcccgtactcacagtttccaccaagaatggcacgcaaggactgctgcacatactcgacgactccagcgatgagcgtgcctaaaacactgcagaacgttcattcgtgcgagaactggctgccaaggagggtgatgagcgcgtggcgcgtcgccgggatcgttcatgcgttggagggatgggacgagaatgagtgcggggacaaggtgctcgacatggacaaagtttggtccgccgcacttctgcatgggtttcgccccgttgccgaaacttgatcgtctggttgcaagtcagagtgaataagcgttaggcagataaggatgccatatgctcgctggagccgtgctgaggaacaagaagcagacttactggctagcagcagaagggtagcttataattaagtactgtaccagtttgatctactaccaaggttacttggttagctattactactgcattattcatcttctatgataatgagttaatgactcagtacgacctatttctagcgctatctgcccttgcgtcaacaacaatgcaattcaacaaagaaacaattgtggctgaggccctgtttggttcataagtcctgggacttattttagtcccaacttataagtcataagtccctta

SEQ ID NO: 5045 - DNA, 2163 bp, Pennisetum glaucum
gacggcttcctcctcatcgccttcctccacgccggccccgtcgagttcctctactactggttccaccgcgccctgcaccaccacttcctctacacccgctaccactcccaccaccacgcctccatcgtcaccgagcccatcacctccgtcatccatccatttgctgagctcgtggcttatgaattgttgtttgcaatcccattgatctcatgcgccttgactggatgtgcttccatcgttgcatttgagatctatgtgctctacatcgacttcatgaacaatatgggtcactgcaactttgaattggtgccaaattggctcttcaaatggttccctcccctcaagtacctcatgtacacaccctcgttccattctcttcaccacacaaagttcaggacaaactactccctgttcatgccattctatgactacatatacaacaccatggacaaatcatcagatgcgctgtatgagaaatcactcaagggcaaagaggaaacagtagaagtggttcatcttacccatcttaccagcctgcagtccatctatcatatgagacctgggtttgccgaatacgcttctaagccttacacttccaagtggtacatgcggatgatgtggcctgtatcatggctttccatggttctgacatggacatatggctcttcattcactgttgagaggaatgtcatgaagaaactcaagatgcagtcatgggctattcccagatacagtttccattatggattgacttgggagaaggaagcaatcaataacctgatcgaaaaggcaatatgtgaagctgaaaagaaaggggcaaaagttgtcagcctcggactccttaatcaggcacataacctcaatggcaatggagaactttacctgcaaaagtacccaaagttgggggtacgactcgtggatggcaccagcttagcttctgcagtggttgtgaatagtattccccaaggcacagatcaagttgttcttgcaggaaatatttcaaaggttgctcgtgctgttgctgcagcattgtgcaagaagaatgtcaaggtggtaatgacaaacaagcaggattatcattttcttaagcccaacatgccagaaaacgcagctgataaccttttgttttcaaaaacagctactgcaaaggtgtggttacttggggaaggtctagatgcttctgagcagttcaaggcacagaaaggaacccagtttattccatattcacagtttccaccaaaaatggtacgcaaggacagctgcacctactcaacaactcctgcaatggctgtgcctaaaacactagagaatgtgcactcctgcgagaattggctgccaaggagggtcatgagtgcctggcgcattgctggaatggttcatgcattggaaggatggaacgaccacgagtgcggggatattgtgctagacatggagaaagtatggtctgctgctcttctgcacggtttccgccctgttgctcaagtttgattgtccagttgcagttgcagatgcaaggcaatccaataagttctcgtgaaaattatgctacaggcatattaggatgttgatatatttctcccccctctactccttatctcttaagaccttggctctctgtataattatatagtcaagaagaactcctttagtataaaaccagtatgcgggagctggaaaatgcatttctatattgataagcgggaatgggggcgtagaagtattctgataagctcaaagatcgatgactcagcaccagtgattctccatcccttaatgtgtagttcaacaagaaacaggtggcaatataagatttggtccaaagcttcagcttgatcataatccacagaaattagaggtagcaattttcatgcagcaacttcagcacagttcagtactagtgaccccatattgccccagatgaatacaaataaaccccacaaccgatccatgccgtactgaaaaactgccgtagcataagctcttctgaaacttcaaatgttcaatagtattatcgaatcgaaggcttttgtggtaccatatatcatgcgaaaaacctttgaaatggagaacttacggaactatatattagtgatgtgaagctaaccatattgtaaactgtctgctagtatttgcacctgaggtgataaactttgtttgcagttg

SEQ ID NO: 5046 - DNA, 516 bp, Triticum aestivum
ggagtttatcttatattcacaggttccaccaagaatggcacgcaaggacacctgcacctactctataacgcctgcaatggctgtgcctaaaacactacagaatgtgcactcctgtgagaactggctgccaaggagggtcatgagtgcatggcgcattgctggaatggttcatgcgttggagggatggaacgagcatgagtgtggggacatcgtgctagacatggagaaagtgtggtctggtgctcttctgcatggattccgccctgtggctcaagtttgattctccggttgcaattgcaaggcagcgcaataagttattgaaagttatgtcatatgctcatgagaattatgctacagacatagtagtatgttgatgttctattctccatgctctgcctcttatcactttaagaccttcgctatctaaaatttaagatgaactcctttcgtgtaaaagcattctgtggaagcaggataaaaaaattacatgtctataatgataagcagggatgggat

SEQ ID NO: 5047 - DNA, 628 bp, Festuca arundinacea
ggcacgaggctgaatcaggcccagagcctcaatggaagtggggaactttatctgcaaaagtacccaaagttaggggtgaaactggtggatggcaccagcctagctgccgcagtggttgtcaatagtatccccaaaggcacagatcaagttgttcttgcaggaaatatttcgaaggtggcccgggcagtggctgcagcattgtgcaagaaaaatatcaagatcataatgacaaacaagcaagactatcatttcctcaagcccaaaataccagaagatgcagctgataatcttttattatcaaaaactggcactgcaaatgtgtgggtaattggagaaggtttagatgctgctgaacagttcagagcaccgaaaggaacacggtttatcccatactcacagttcccaccaagaacggtacgcaaggactgttgcgcctactcaacaaccccagcaatgagcgtacctaaaacactgcagaatgttcattcgtgcgagaactggctgccaaggagagtgatgagtgcgtggcgcatcgctggaattgttcatgcattggagggatggaacgagcatgagtgcggagacatggtgctagacatggacaaagtttggtctgctgcgattctgc

SEQ ID NO: 5048 - DNA, 1220 bp, Triticum aestivum
ccgtgattgtatacactccctatgggcgattggcccgactttgaattgtcccgcccccatgccgcgaattattctatgtcccggccaaggtgtatggttcttggttcactcttgagaggaatttcatggggaaacttactatccagtcatgggccattccaagatacaatttccattatggattgaacttggagaaggaagcaattaatagcctggttgtaaaggccatatgtgaagctgacaagaaaggagccaaagttgttagtcttggactcctgaatcagggccagaacctcaatggaagtgggcaactttatctgcaaaagtacccaaagttgggggtaaaactggtggatggcaccagcctagctgctgccgtcattgctaatagtatcccccaaggcacatatcaagttgtgcttgcaggagatatttcgaaggtcgcacgtgctgtggctcaagcattgtgcaggaaaaatattaaggtcacaatgacaaacacgcaagattatcatttccttaaggcgaaaataccagaagatgcagctggcaacctttcattgttatcaaaaactggcactgcaaaggtgtggttaatcggagaaggtttagatgctgacgaacagttgagggcaccgaaaggaacacggtttattccatactcacagttcccaccaagaaagctacatgaggagtgctacacctactcaatgactccggcaatgtgtgttccaaaaacactacagaacgttcattcatgcgagaattggctgccaaggagggtgatgagtgcgtggcgtattgctgggattgttcatgcattggagggatggaacgagcatgagtgcggagacacagtcctagacatggacaaagtttggtctgctgcaatttcgcatggtttccgccccgttgctacagattgatggtgtagctgcacgtcaacggaataagagttgtgttgatatcgatgtaatatatactcgtttttatccttcccaaggaagaagacgtacacatcggcaagcagaagacgtagcctgcaattaagtacctcgggcgggaacacgctaatcccgggggattggcggcgggaacaatgaaaattcgggccaattcggcttataggaagtgtattaaaaatcactggccggccgtttaaaacgttcggtattggaaaaccctggggtttcaaatttaacgcttgaaaaaaccccttt

SEQ ID NO: 5049 - DNA, 1995 bp, Carica papaya
aagcgtttttgggggggttaagaaaccgaaatcaaaggaacccgagagaacaaaaaaaaaaaaaaaaaaggagccagagagaatctctgtccacctagaaagtgagagttttcagagagacggagcagccttatatcaagctttgcttaagtgaaaagcttgccatttttgttacgccgggaagaacttgaatcttccacgcaggatcagtacatgggttcgttgccggaatcggaacctcagagttctcatggcaagccgccgggaatccggttcatagagtacatcaagcagtccaagctctcatacaaaacccaccaagtcattgtcttgattgttacatttttagcatacaccagctaccatgctgcaagaaaaaccaccagcgtagttaagagtacccttgatccccaatcatccccatcagaactgggcttgaaattcttctcttggagagtaatttacagagatgaaacagcgataggaggaggactttcatggaagcttggagatggttggtttccatttaatagaccagatggaacgtccttgcttggtgaactcgatgtcgcttttctatcggtatatgccctgggaatgtacttctctggacacttgggtgatagaatgaatttgaggatatttctaacagttggaatgattggtactggtgttttcacttcactttttggtgtcggatactgggcaaacgtccataacttctactactacttgatagcgcaaatgcttgctggtttatttcaatcaactgggtggccttcagttgttgcagtggttgggaactggtgtggaaagaaaaagagagggctaatcatgggtatatggaatgctcatacatcagttggaaacatcacaggctctttggttgctgctgcgctattgagatatggatggggttggtcctttgttgcacctggtctcttgattgctttcattggcatagtggttttccttttattgccagttagtcctgaatctgttggagctgataaaaatgaggacgaaatgtcttctccgaggaaacctggagaggaaacaagagagcctctcttaaattcagggacagaactgaaggaggaagctgtgggctttttagaagcatggaaaattcctggagttgcatcttttgccctctgcctcttcttcgccaaattagttgcttatacttttctatattggcttcctttctatattagccacacagccattgaaggaaagtatttatctagtgagaccgctggaaacttgtcaacgttgtttgatgttggaggtgtggtcggagggatacttgccggccacatttctgatcgtctcgatgccagagctataacggctgcaagtttcatgtactgtgcaattcctgctctcttcttctaccgcagctatggccaactctccttaactatgaacattgctcttatgttcatcaccggcatgttcgtgaatggcccttatgctcttataaccacagctgtttcggctgacctgggaacacacagttcactaaaagggaactcaagagcattagcaactgttacagcaattatagatggaaccggctccgttggagctgcaatcgggccattactgactggttacatatcttccaaaagctggagtgcagttttcacaatgttaatgggagcagctctgattgcaggactgctgcttacccagcttgtcgtggcagaggtggctgctaagatttcggaatcgagatcacaagaaagactcacaacgagatcttcagaactaaatgtataagccctataagaatatagatagagggataaagaaggtagagataaaatatttttcttccttttctccacgatcatggaggaaaattttaaaggacaggacagatggaggagagatagaatctctattcttgtccatatatatgtacaatttttttgtaatatacgatatgaattcaagaatgggatcgtcaaccaggatttgctcactcaa

SEQ ID NO: 5050 - DNA, 2115 bp, Citrus sinensis
  misc_feature (308)..(308): n is a, c, g, or t
  misc_feature (427)..(427): n is a, c, g, or t
  misc_feature (476)..(476): n is a, c, g, or t
  misc_feature (790)..(790): n is a, c, g, or t
  misc_feature (802)..(802): n is a, c, g, or t
  misc_feature (865)..(865): n is a, c, g, or t
  misc_feature (2114)..(2114): n is a, c, g, or t
aagcatatttttgttcgttaagcaactgcaaagcaaaaacgccagagcttggagattctagagagagaaattaaaaacggtggtcaatttagagagagaaatcgaagtttcaaccaaaatcaactcaactaagccagcgactgcttgctgttgttgatattataggaggaagttgagaagttgcttcttccataatattcctttttttctggagtcaatatcaaacatgggttcattatcagaaccggcaccgcagagaagtagcaggaagccccttggaattcgattcttagagtgcataaagggangaaatctttccttcaagaaccatcaagccattgtcctaattgtaactttcttcgcttacactagctatcatgctgcaagaaaaaccactagcattgtcaagagcacccttgatccccantctccagatacgagcttgaagtccttgccttggaggataagttacctanaagaacctgcagaaagtaggaagttgtcatggaagcttggagatggatgggccccatttaatggatcagatgggacagccttgttgggtgagcttgatctagctttcctctccatctatgctggaggaatgttcttttctggacacttgggtgatagactggatttaaggatctttctaaccgtgggaatggttggaaccggtttgtttacttcactctatggcataggatattggggaaatgtccacagtttctactactacttagtagtgcaaatgctggccggtttgtttcaatcaactggctggccttcngttgttgcagtngtaggcaactggtttggaaagagtaagagagggttgattatgggtatatggaatgctcatacntctattgggaacattacgggttctttggttgcatctgctttattgacctatggttggggttggtcctttgttgtgcctggtcttataattgcttttgttggcttgatcgtttttctcttcctccctgttaatcctcaatctgttggcactgatacaaatgaagaagatgaatcactttctcctaagaagatcggggaaggagtaacagagcccttattgagacgagaaaccgagattgaggagaaagcagttgggttcatagaggcttggaaaataccaggagttgctccatttgctctttgcctcttctttgccaaattggttgcttatacatttctgtattggcttcctttctatgttagtcatacagctgtagacgggaagtatttgtccagtgagatggctggaaacctgtcaacattttttgatgttggaggtgtgcttggagggatcctagctggccacatttccgatcgcctagatgccagggcaataacagcagcaagttttatgtattgtgcaatcccagctctcttcttctaccggagctatggacacctctccttggccttaaacattgctcttatgttcatcactggcatgtttgtaaatggcccctatgctctgataacaactgctgtctcagctgacttgggaacccacagttcgttgaaaggtaattcacgggcactggcaactgtgacagcaatcatagatggaactggctctgttggggctgccattggaccattgttaacgggttatatttctgctacgagctggactgccgttttcacaatgctgatggcagcagctctaatctctgggctgcttctgactaggcttgttgtggctgaggtggcagcaaagtttgttgaatcaaggtcacaatcagggaaccaatcaaggtctcaagccggggttctggatgtataatgtatattacacaggggtgatctgagagttctacttgtgttgtatattttgtgatgctcaccgtcttatgaacaccgatgatcataagatgaagagaggaaaatcctctggttattgtagaaaaattggagaagatggtatttgattcttttccagatcttagtccctcgtatggaggatagaaattgggagaaaggaagtaagggaattgtgtttcatggttcttgtctgtctgtatatacaattttttgtatcctatatgtcaatttctgcatagcattgttgtgaaagggtgtttctgttgttgggtttna

SEQ ID NO: 5051 - DNA, 1845 bp, Ricinus communis
atggagtttttaactgttactgattcccaatgttgtatttgtcagcttcacagcttgcagcttcttgctaaggaaactgaagcctctgcatcttctttattcattgcagagttttcttacatgggttcgttatcggaaccagcagctgaggggaataaaaataagccctatggaattcaattcttagaatgcataaagaaaaacagactttcatacaaaacctaccaagtcattgtcttaattgtaacatttttcgcatatgctagctaccatgctgctcgaaaaacaacaagtatcgtcaagagtacccttgatccacagtcatctgagatgggtttgaagttgtatccatggaaaataacttacttgagcgaaccagtagaaagaagaagattttcatggacacttggagatggttgggccccatttaatgcatcagatggtacatccttgctcggtgaacttgacttggcatttctctctgtatatgcaataggaatgtatttctctggacacataggtgatagaatgaatctgaggatccttttgacaataggaatggttggaactggtttctttacatcactgtttggtgttggatattgggcaaatgtacataacttttactacttcttgatagcacaaatgcttgcgggtttgttccaatcgacgggatggccttcagtggttgctgtgttaggcaactggtttgggaagagaaagagaggactgatcatgggcatatggaatgctcacacctctatagggaacatttcagggtcgttgattgctgctgcaatgttgagctatggatggggctggtcgtttgttgtgcctggacttgttattgcttttatcggcttggtggttcttctgcttctgcctgttgatcctgagtctgttggagttgagagagatgaagatgatttgcattctcctaagaaagctggagaagaagttacagagcctcttttggaatcagactctgaggtgaaggagacagcagttgggttcattgaagcatggaaaattcctggggtcgctccatttgctctttgccttttctttgccaaattggtggcttacacatttctctattggcttcctttctacatcagccatacagctattgatggaaagtacttatccagcgacacagctgggaatttgtcaacattgtttgatgttggaggagtgattgggggaatcttagccggtcacatttctgaccgtttaaatgcaagagcaattacagcagcaagcttcacgtactgtgcaattcctgctctcttcttttaccgcagctatggacacatttcgttggctatgaatattgctcttatgttcatcaccggcatgtttgtcaatgggccttatgctcttataacaacagctgtctcagctgatttgggaacccacagttcactgaaagggaactcgagggcactggcaacagttacagcaattatagatggaacaggctcagttggggctgcaattggacctttaattacaggatatatttctgctaaaagctggagtgcagttttcacaatgctaatgggggcagctctaattgcaggtctgcttctgactagacttgttgtggctgaagtggctgcaaaaatttctgaatcaaggtctcaagcatctgtagcttcaagaacaacagcaactacacttgatgtatgatataataggaataggagttcaacttgtattgcttttgtttgattatcactattggggctagtgaggtcagatgatcactctgacgaggtgaagaccttcttattatagttgaagatgcgagaggtgcttttagacctcttccatgcttttagt

SEQ ID NO: 5052 - DNA, 1692 bp, Ricinus communis
atggagtttttaactgttactgattcccaatgttgtatttgtcagcttcacagcttgcagcttcttgctaaggaaactgaagcctctgcatcttctttattcattgcagagttttcttacatgggttcgttatcggaaccagcagctgaggggaataaaaataagccctatggaattcaattcttagaatgcataaagaaaaacagactttcatacaaaacctaccaagtcattgtcttaattgtaacatttttcgcatatgctagctaccatgctgctcgaaaaacaacaagtatcgtcaagagtacccttgatccacagtcatctgagatgggtttgaagttgtatccatggaaaataacttacttgagcgaaccagtagaaagaagaagattttcatggacacttggagatggttgggccccatttaatgcatcagatggtacatccttgctcggtgaacttgacttggcatttctctctgtatatgcaataggaatgtatttctctggacacataggtgatagaatgaatctgaggatccttttgacaataggaatggttggaactggtttctttacatcactgtttggtgttggatattgggcaaatgtacataacttttactacttcttgatagcacaaatgcttgcgggtttgttccaatcgacgggatggccttcagtggttgctgtgttaggcaactggtttgggaagagaaagagaggactgatcatgggcatatggaatgctcacacctctatagggaacatttcagggtcgttgattgctgctgcaatgttgagctatggatggggctggtcgtttgttgtgcctggacttgttattgcttttatcggcttggtggttcttctgcttctgcctgttgatcctgagtctgttggagttgagagagatgaagatgatttgcattctcctaagaaagctggagaagaagttacagagcctcttttggaatcagactctgaggtgaaggagacagcagttgggttcattgaagcatggaaaattcctggggtcgctccatttgctctttgccttttctttgccaaattggtggcttacacatttctctattggcttcctttctacatcagccatacagctattgatggaaagtacttatccagcgacacagctgggaatttgtcaacattgtttgatgttggaggagtgattgggggaatcttagccggtcacatttctgaccgtttaaatgcaagagcaattacagcagcaagcttcacgtactgtgcaattcctgctctcttcttttaccgcagctatggacacatttcgttggctatgaatattgctcttatgttcatcaccggcatgtttgtcaatgggccttatgctcttataacaacagctgtctcagctgatttgggaacccacagttcactgaaagggaactcgagggcactggcaacagttacagcaattatagatggaacaggctcagttggggctgcaattggacctttaattacaggatatatttctgctaaaagctggagtgcagttttcacaatgctaatgggggcagctctaattgcaggtctgcttctgactagacttgttgtggctgaagtggctgcaaaaatttctgaatcaaggtctcaagcatctgtagcttcaagaacaacagcaactacacttgatgtatga

SEQ ID NO: 5053 - DNA, 1271 bp, Manihot esculenta
  misc_feature (7)..(9): n is a, c, g, or t
  misc_feature (741)..(741): n is a, c, g, or t
actgcannnccttcagttgttgctgtggtcggagactggttcgggaaaagcaagagaggactaattatgggcatatggaatgctcacacctcaattgggaacatttcaggatctttgattgcttctgcaatgttgagctacggatggggctggtcatttgtcgtgcctggtttccttattgcttttataggcttgatggtttttctagttcttcctgttagtcctgattctgttggaattgacagacgtgaagatgagctgcatgatccaaggaaaattggagaggaagttacagagcctcttttaggatcagactccaaggttaaggggacagcagttgggttcattgaagcatggaaaattccaggtgttgctccatttgctctttgccttttctttgccaaattggtggcttacacgtttctctactggcttcctttctacattagccacacagctatcgacggcaagtacttatcggatggcacagctgggaacttatcaacattgtttgatgttggaggggtaattggagggatcttagctggacacatttctgatcgtctagatgccagagccattacagctgcaagcttcatgtactgcgcaattcctgctctcttcttttaccgaagctatggacatatttccctgggtttaaatattgcccttatgttcatcaccggcttgtttgtgaatgggccttatgctcttataacaacagctgtctcggctgacttnggaacccacagttctttgaaagggaactcaagggcattggcaaccgttacagcaattatagatggcacaggttcagttggggctgcaattggacctttactgacaggttatatttctgctaagagctggagtgcagttttcacaatgctaatggctgcagctttaattgctggtctgcttttgacaagactagttgtggctgaagtggctgcaaaaattgcagaatcgaggtctcaaacatctgcaccatcaagaacaccagcagttcagcttgatgtgtgagttggagacaagatggtagggattgtatttgtgtctgttttgtgtgatactcaaaagtatctatgatctctggtgcttaaaatgatgaggaaaagatcctctgatagcggttgaagatgggagaggatgtttttataccttctccatgctctgtagtttaataggatagatggaaagaaaacgagaaggggttggtcatgtcaatgtgtctgtatgtacatttttacagcaatttaactcattaaacc

SEQ ID NO: 5054 - DNA, 1253 bp, Capsicum annuum
taaagatgaagatgaagtgttctctcctagaaaagaaggcgaggaagtaacagagcctttgttaagatcagatagagaagaggaatcagccgtgggttttattgaagcatggaagattcccggtgtagcaccttttgctctttgccttttctttgcaaagttggtagcgtacacatttttgtattggctgcctttctacattagtcacacagctatagaaggaaagtatttatccaatgaggaggctggaaacttgtcgacattgtttgatgttggaggggtagtaggtggaatcctagcaggttacatatctgaccgcttagatgccagggctataactgctgctagcttcatgtactgtgctatcccggttctctacttctatcgcagctatgggcatgtctccatgactgtaaacatcatcctcatgttgatcactggagtatttgtcaatgggccttatgcattgataacaactgctgtttcggctgacctgggaacacactgctctctgaaaggcaattcacgagcgcttgcaactgtcaccgccattattgatggcactggctcaattggagctgccattgggccacttctaaccggttacatttcagctaatagctggagtgctgtatttacaatgctcatgggatcagctttcgtagctggtttatttctgaccaggcttgttgtagctgaagttggtgcgaagattcaacaattagggtcccaaggatcatcacctagatcaaggtcccctgaccttctagtgtgaaaataataattgtggtattcttttattgctttttgtgaatgcatttgaagccttgattcaaatgttagcctaggatcgcagagatatagagttggacttgctgatcactcccaatatcatgaaatgccatttccacatgtacattcttgtgtgccagaaaaggatcaaatacatcacttagtgtagtgggaacctgggttgttgggcgttttgtacataatctatttttttgattgaataaaaccagttcatcctcccaaaagcttcagatggtgaatttacttgtaattgaaaaattgaagaacaattattgatagttgtatccatctaaagtcatggctatggagggacagcaactcattgaatttcttacatctttcgcatctgttcctgattcaacagctgacaaagtatagcactgtaattctcttattgagtgagaaagtgacatcgagcaatttggattattgaaaaaaaa

SEQ ID NO: 5055 - DNA, 1952 bp, Solanum phureja
gtaaaagaggaaaatatatgtttatcattttatcttgatcaagttccctattagtggagtcacctccagagccaacaatgaagaagaataacaacaagcccttaggaattcaattaatagagaacataaataagtcgagcctatctttcaagacatatcaagtaattgttctaattgtgacatttttcgcatatacaagttaccatgctaatagaaaaactacaagcatcgtaaaacaagcacttgatccccaatcccttggcgttggtccgatttttccatggcaaggaaatagtattcggaaatcatttagagatggttggtttccatttaatggccctgatggaacaacattgctcggtgaccttgatgtggctttcctatttgtgtatgccattggaatgtatttctcagggcacatgggcgataggatggatcttagagtttttttgaccgtgggaatgttgggaactggtttattcacagctctttttggagttggatattgggcaaacattcatagtttctattactatcttatcattcaaatgattgctggattgtttcaatccactggatggccgtcagtcgttgcagtggtcgggaattggtttggaaagaagaagaggggactgataatgggcatttggaatgctcacacctctgttgggaacattacagggtcgttagtcgcctcaatcttattgaaatatggatggggttggtcgatggttgtacctggtatccttattgcttttagtggtgtggtagtgttccttttgttacccgttcatcccgaatctgttgggggtaataaagatgaagatgaggtgttgttatctcccggaaaagaagacgatgaagtgaatgaacaacctctcttgaggtcgagatcagacagagaagaggaatcatgcgctgtaggttttatagaagcatggaagatcccgggggttgcaccctttgctgtttgcctttttttcgcgaaattggtggcttacacatttctctattggctgccttactacattagccacacagcaatagatggacgatacttgtctaacgaggaatctggaaacttatcaacgttgtttgatgtcggaggggtcataggtggaatcctagcaggttacatctcagataagttggatgctagagcaataacagcagctagctttatgtactgtgttatcccagctctgtacctatatcgaagctacggacacatctctatgactataaacatcatcctcatgttgattgctggagtgtttgtgaatggaccttacgcgttgataacaactgctgtttcagcagacttgggaacacatagctctttgaagggtaattcacgagcgcttgcaactgtcactgctattattgatggaactggatcaattggtgctgcagttggaccatttctcacaggttatatttcagctgatagctggaatgcagtttttgtaatgttgatgggatcagctttagttgctggtttgtttttgactaggcttgttgtaactgaggtgaatggaaagattcaagaattgaggtctcaaggatcatctatgtctactaatcttcaagtgtgattgccataatattgtgtgataatccaaatactcaatttggatattatcagccttttagtcagagggataaaaaagtggaaatgctcaaatcaactcaagatgaggatatgaattcttcttcattttagtggcaaagatgaaaaggtggaaatcctcaaatcaacttaagatttgttagatggactctgaaactggttctcttaagatcatcatcacatatacatgtaaattttgtgtgctccatccgatttaatttatatgtctgatttaattacgaagatttagaacataagaaaaacttttgaatcttgtaattttaaactaaagatatgttaaatgtatcaaaatgttatttaa

SEQ ID NO: 5056 - DNA, 1493 bp, Tropaeolum majus
acctagcttttctctccgtatacgcttttgggatgtatttttcgggtcacttgggcgataggacaaatttgagaaagtttttggcagtgggaatgattggaagtgggatatttacttctatgtttggtcttggatactgggcaaatatccacaacttttactatttcttggttgtgcaaatgcttgccgggctgttccagtcaactggatggccttcggttgttgcagttgttggtaactggtttggaaagaagaagagagggctgataatgggtgtatggaatgctcacacttcagttgggaacatcacaggatcactgattgcatctgctttcttaagatatggatggggttggtcgtttgttgtgcctggtcttcttatcgcttttgttggtgtgctgcttttccttttactgccggttagtcccaagtctgtaggtgccgaaaagatgaagatgaattggattgtcctagaaaagttggagaggacattactgagcctttgttgagctcagaggtggatgttaatgaggaagctgttggattcttagaagcatggaaaattcctggagttgcaccttttgctctctgccttttctttgccaaattggttgcctatacatttctttattggctcccattctatgtcagccacacagccatagacgggaagtatttatcgagtgaaacagctggaaacttgtcaacattgttcgacgtaggtggtgttgtaggagggattctagcgggctacatttccgatcgccttgatgctagagccataacagctgcaagttttatgtattgtgccattcctgctctctttctctaccgtagttatgggcacgtatccctaacaacaaacatcattcttatgatcattactggaatgttcgtcaacggaccctacgctcttataacgaccgccgtctcagctgatctgggcacccacagttctttaaaaggaaactccagagctttagctaccgtgacagcaatcatagacggaaccggctcagttggggctgccatcggaccattattgactggttatatttccgccacaagctggagtgcagtttttaccatgctaatgggagcagctttgatagcagggctgctgctcaccaggcttgtagtggctgaggttggtgctaagatatcggcatctgggtcgtcgcaagaaaggttgtcgccaagatctccggtacccgttgtacttgatgtgtaagttattataaatctttcggattgtgtttcttgtgtacgatatttgaacgagtctttgcttcgagtgaagagagggaaatgccctctgataatttaggataaaatttacatttaatttagtgtagcgtgaaagcaaaatcgaggacaacgaagatgctttgttcttgtccatctgcatgtaaatatttttgttaatacaacatttgaagtatgatttatgagaaaacaaacatttattcgtaaaaaaaaaaaaaataaggccg

SEQ ID NO: 5057 - DNA, 1547 bp, Sorghum bicolor
aaacattttttgtttgtttattgcgccaaaaaaactaacagacttgagaaaaaagacagaaaggggctgcacagtaggcgcacatatttggcagccagagcgggcctcgtcgtgccccgtattctcagttgcttcgacgtatttctctctctgtctatacggttcaagggactgaagaaggtagagagagaaactcgaaggggggagaggagggagatacaggttaatttagttgtccgttcatctgatttcttagaagcaaaatgttgtttggagcccagtgtcagtgacaccatcttgtaatgcctgtgcttctacgggaaatggaggatcattctgtccatcccatgtctaagtctaaccatggctccttgtcaggaaatggttatgagatgaaacattcaggcaaaaaagtttgcgataaggattcatcatcagaatctgatcagtctcaccaagaagcatcggcagtgagtgagagcagtccagctgaacacacatcaactcaatcagacaatgatgaagatcatgggaaggataatcagaacacaatgaaaccagtattgtccttggggaaggaagggtctgcctttttggccccaaaattagattacagcccatcttttgcttatattccttatactgctgatgcttgttatggtggggttggggtcttgacaggatatgctccacatgccattgtccatccccagcaaaacgatacaacaaactctccaggtatcttgcctgtggaacccacagaagaagagccaatatatgttaatgcaaaacaataccatgcaatccttaggaggaggcagacacgtgctaaattggaggcccagaataagatggtgaaaggtcggaagccatatcttcatgagtctcgccatcgtcatgccatgaagcgggctcgtggatcaggagggcggttcctcaacacaaagcagctccaggagcagaaccagcagtaccaggcactgagtagttcaatgtgctcaaagatcattggcaacagcttaatctcccaaagtggccccacctgcacgccctcttctgacactgcaggtgcttcaacagccagccaggaccgcagctgcttgccctcggttggctttcgccccatgacaaacttcagtgagcaaggtggaggaggctcgaagctgattgtgaacagcatgcagcagcgtgtttccaccataaggtgaagagaagtgggcacaacaccaatcccaggcgcactgcctgtggcaactcatccttggcttttgaaactatgaatatgcaatggacatgtagtttgagattctcagaataaccaaacgtgcagacatatgcaagtccttttcagcttgctgtagctgaaagaactgtggttatgttatgatgagtttgttcctggagactgatccatacctcgtgctgggtgttgaggtgaagccatggaaacatgttgtggacttgtggttcaataccttgctgcctaaaagtgtctgaaaggctagctccccagtttgcaattttcctggtttccagcttgtcttctc

SEQ ID NO: 5058 - DNA, 903 bp, Sorghum bicolor
atgcctgtgcttctacgggaaatggaggatcattctgtccatcccatgtctaagtctaaccatggctccttgtcaggaaatggttatgagatgaaacattcaggcaaaaaagtttgcgataaggattcatcatcagaatctgatcagtctcaccaagaagcatcggcagtgagtgagagcagtccagctgaacacacatcaactcaatcagacaatgatgaagatcatgggaaggataatcagaacacaatgaaaccagtattgtccttggggaaggaagggtctgcctttttggccccaaaattagattacagcccatcttttgcttatattccttatactgctgatgcttgttatggtggggttggggtcttgacaggatatgctccacatgccattgtccatccccagcaaaacgatacaacaaactctccaggtatcttgcctgtggaacccacagaagaagagccaatatatgttaatgcaaaacaataccatgcaatccttaggaggaggcagacacgtgctaaattggaggcccagaataagatggtgaaaggtcggaagccatatcttcatgagtctcgccatcgtcatgccatgaagcgggctcgtggatcaggagggcggttcctcaacacaaagcagctccaggagcagaaccagcagtaccaggcactgagtagttcaatgtgctcaaagatcattggcaacagcttaatctcccaaagtggccccacctgcacgccctcttctgacactgcaggtgcttcaacagccagccaggaccgcagctgcttgccctcggttggctttcgccccatgacaaacttcagtgagcaaggtggaggaggctcgaagctgattgtgaacagcatgcagcagcgtgtttccaccataagg

SEQ ID NO: 5059 - DNA, 1568 bp, Zea mays
agcggagggggcggtaaaacatttcttgtttgtttattgcgccgaaaaaactaacagacccagaaaaggacagaaagaggctgtacagtaggcgcgtatatttggcagtaggagcggtcttgttgtgccccgtatcactcctcagttgcttcgacgtatttctctctctatctatacgattccgaagaaggtagagagagaaactcgaaggggagaggacagaagagggagatacaggttaatttttaggtaccagatcatctgatttctcagaagcaaaatgttgtttggagctcagtgacaccatcttgtaatgcctgtgattttacgggaaatggaggatcattctgtccatcccatgtctaagtctaaccatggctccttgtcaggaaatggttatgagatgaaacattcaggccataaagtttgcgatagggattcatcatcggagtctgatcggtctcaccaagaagcatcagcagcaagtgaaagcagtccaaatgaacacacatcaactcaatcagacaatgatgaagatcatgggaaagataatcaggacacaatgaagccagtattgtccttggggaaggaaggctctgcctttttggccccaaaattacattacagcccatcttttgcttgtattccttatacttctgatgcttattatagtgcggttggggtcttgacaggatatcctccacatgccattgtccatccccagcaaaatgatacaacgaacactccgggtatgttacctgtggaacctgcagaagaaccaatatatgttaatgcaaaacaataccatgcaatccttaggaggaggcaaacacgtgctaaattggaggcccagaacaagatggtgaaaaatcggaagccatatcttcatgagtcccgacatcgtcatgccatgaaacgggctcgtggatcaggaggacggttcctcaacacaaagcagctccaggagcagaaccagcagtatcaggcatcgagtggttcattgtgctcaaagatcattgccaacagcataatctcccaaagtggccccacctgcacgccctcttctggcactgcaggtgcttcaacagccggccaggaccgcagctgcttgccctcagttggcttccgccccacgacaaacttcagtgaccaaggtcgaggaggcttgaagctggccgtgatcggcatgcagcagcgtgtttccaccataaggtgaagagaagtgggcacaacaccattcccaggcacactgcctgtggcaactcatccttggctcttggaactttgaatatgcaatcgacatgtagcttgagatcctcagaataaaccaaaccttcagttatatgcaagccttttttgaggttgctgttgctgtacctgagaactgtggttaggttatgagtttgttcctcaaaactgacccatacatgacatgctaccttgtgctgagtttctgagacaaagccatcgaaacatgatcttgtggttcagtactttgctgccattagtgtctgataaactagctccccagtttgcagtttctctgaattccagcatgtctagcctca

SEQ ID NO: 5060 - DNA, 2829 bp, Zea mays
ggctcgggcgccaccactagtagcttagcacgcgccatatatctaataagccggcgctgctgtacgtcgcttccgccatctacttgctagcagctatctaataggccggccgggcagcgcgaaacagcagcgggagctcagctcgctcgctcgctcgtctctgccgccccgcccgtcgcggtcgtcgcgcgagaggggtggccatcatccatgggcggcgtccgcggccacagcagcgccgccggcgtctctgaggaggcggcggcggcggcggcttgggtgtgggccgcggcggatgtccccgtgcgcgtggactgggcgggcgcggcggcgcaatgcgcgtccctgtgggcgcacgcgcgggcgctgctggtcgtgccggcggtgcggctcctggtggccctgtcgctggcgatgacggtgatggtgctggccgagaagctgttcgtctgcgccgtgtgcgtcgccgtgcgggcgttccggctcggcccgcaccggcggtaccgctgggagcccatcgccgccgccgccgccgccgtggggtaccccgtggtgctggtgcagatccccatgtacaacgagcgggaggtgtacaagctgtcgatcggggcggcatgtgcgctggagtggccgccggagcgcttcgtgatccaggtgctggacgactccacggaccccgttgtaaaggtacgccggcgacctgatctggtcccctcactcacacactctctctctttctctcgaccgggcaccaccacgacctttttgcgacgaccttcgtggccaggccacagcgagcaaaccaatcaatcattcatatgcatccaatgggcacgtgaatacactcgtctccgtgcccccatgtgtctccatgttgtccaccacccgtgaggacaatgcaatccagagacctgaatctgtctctgtccgccctccccaccgtttccaggacctggtggagacggagtgccagaggtggaagagcaaaggcgtgaacataaagtacgaggtgagggggaaccggaaggggtacaaggccggcgcgctcaaggaaggactgaagcacgactacgtcgcagactgcgaatacatcgccatgttcgacgccgacttccagcctgactctgacttcctcctcaggactatcccgttcctcgtgcacaacccggagatcgccctcgtccaggctcgctggaagtttgttaattctgacgagtgtctgctgacaagattccaagagatgtcgttggactaccatttcaagtatgagcaagaggccggctcctcggtgtattcattctttggcttcaatgggacagctggtgtctggaggatctcagcgatcgatgatgctgggggctggaaggaccggacgacagtggaagatatggacctggctgtccgtgcgatgctgcagggatggaagttcctttacgtcggcgacattaaggtcaagagcgaactgcctagcacattcaaggcgtaccggtttcagcagcacaggtggtcatgtgggccggcgaacctgttcaagaaaatgatggtagagattttagaaaacaagagagtgtcgctgtggagtaaaatccacctatggtacgatttcttcttcgtcgggaaagtcgctgctcatacggtgacattcatctactactgcttcgcgatccctgtgtctgttctgttccctgagatccagatccctctctggggagttgtctatgtcccgacagtcataaccctcttgaaggctcttggcacaccgagttcctttcacctggtgatcctctgggtcctgtttgagaatgtcatgtcgttgcaccggattaaggctgcagtaagtggtcttctggacgctggtgggcgagtcaatgagtgggttgtcactgagaagttgggcgacaccagcaaggcaaagcctggcaccaatggatcagacactgctgtaaaggtgatagatgtgaagctaacagaaccgcttgttccgaagctagtgaagaggcgagcaagattttgggagaggtaccactgctcagaacttttcgttggaacctgcataatcctgtgtggtttctatgacctgctttttgcaaataagggatactacatttttctcttccttcaaggcacggcgttccttgttgttggttttgggtatgtcggcacactacctccttgcactgcataagctgtcatggacaactgatattacctgctcaccagaaactgagcaagcaaagctcctctctcctgcacatatcaaactcttgaattcaatgatagttgagcaatgttcccccatcagtcttggcctgacatgatccaccgccgagaaggttgttcagatatcgccgtcgttctcctgtcagtgttggtcagatttgagccaaaccattctttattgtcagaaggccattcaaatagtgtcaccattgcaaattttataataacggtgtttaccgaagcatcatgaaaagaaaaatgattggtgcagcagcatttcgttcgcattccatagagatgcagttcacatccagtatttttttttggaaatctagtgttattactcagagttcagatccataatggaagattgttggcttcctcagttcataacctgtgtaggcttaaaacttgtagatgtaaattgttattaacactaatattttttattgaatccgggtattattgaaatgcaagtgtagcatgcatttcttttcctgtaagaagccaaagatgacttctgagtaacacgtctaatcagacattttacttgatgtggcacatggaatagtggatctattttaactatgtagcagcaaccatttggtc

SEQ ID NO: 5061 - DNA, 2715 bp, Oryza sativa
accaaccacacacattgccaataactactagacattagctgagattaatcacattctagatcttgactaatgactatatatatatttctccaccattagtggcaagaaaacaatttagctagcttaaccaagctggccaagatgatcaatgtgattatagtaacctcactacaccacatgcatgcagctatagcaaattaagagagtgtaggagtgaaactctcctcttcttccttggagtgtcccaatcatttcttatgctccttgtgtgtgccatgtgcctccattcctacctatataatcctctctcgccattgtactgctcccacctagcttagctcgccagtggcatcgccggcgtggcacactagctagagctagatccaatcggccgacggcgagcgatgtcgtcgtccggcggcggcggggtggcggaggaggtggcgaggctgtggggggagctgccggtgcgggtggtctgggcggcggtggcggcgcaatgggcggcggcggcggcggcggcgagggcggcggtggtggtgcccgccgtgcgggcgctggtcgccgtgtcgctcgccatgacggtgatgatcctcgccgagaagctgttcgtcgccgccgtctgcctcgccgtgcgcgcgttccgcctcaggcccgaccgccgctacaagtggctccccatcggcgccgccgccgccgccgcctccagcgaggacgacgaggagtccggccttgtcgccgccgccgccgcgttccccatggtgctcgtccagatccccatgttcaacgagcgcgaggtgtacaagctgtcgatcggggcggcgtgctcgctggactggccgtccgaccgcgtcgtcatacaggtgctcgacgactccactgacctcgttgtaaaggtttttatcgtgatttattttacggatatctccagtagaattatcagatctactagtagtttggtaattaaagatttggtggagaaggagtgccagaaatggcagggcaaaggcgtgaacatcaagtacgaggtcagagggaacaggaagggttacaaagctggcgcgctcaaggaagggttgaagcacgactatgtgaaagagtgcgagtacattgccatgttcgatgccgacttccagcccgagtctgatttcctccttaggaccgttccattcctcgtgcacaactcggagatcgcccttgttcagactcgctggaaatttgttaacgctaatgagtgcctgttgacaaggttccaagaaatgtcgttggactaccactttaagtacgaacaagaggctgggtcttcggtgtactcttttttcggcttcaatgggactgctggtgtctggagaattgcagcaattgacgatgctgggggctggaaggaccggacaactgtggaggacatggaccttgcggttcgtgcaacattgcagggatggaaattcgtatatgttggtgatgtcaaagtcaagagcgagctaccaagcacattcaaggcataccggtttcagcagcacagatggtcatgtggaccagcaaatctgttcaagaaaatgatggtagagattttagaaaacaagaaagtgtcattttggaacaaaatccacctttggtacgatttcttctttgttgggaagattgctgctcacacagtgacattcatctactactgctttgtgatcccggtgtccgtttggttgcctgaaatcgaaattcctctctggggggttgtctatgttcctacagtcatcaccctctgcaaggctgttggaacacccagttcatttcatcttgtgatcctctgggtcctattcgagaatgtcatgtcattgcaccggataaaggcggcagtaactggtattttggaggctggccgagtcaatgagtgggttgtcaccgagaagttgggagacgccaacaagacaaagccagacaccaatggatcagatgctgtgaaagtgattgatgtggagctaacaacgcctctaataccaaagctcaagaagagacgaacgagattctgggacaagtaccactattcagaaatttttgttggcatctgcataattctgtctggtttctacgatgtgctttatgcaaagaagggatactacatattcctcttcattcaaggcctagctttcctcattgtcggttttgattatatcggcgtgtgccctccttgagcagaataaggtagtcattgatggaactgacatgcagaattacgagaaatcatgtgcaaatgaagctgctctcctgcacatatcaagttcggaacaaaattcaacacggatcattcttctcgtcagtcttggtcagatttgatccaatcattctttgctgccaaaaagggcgtggaaataacaccgtcattctttcaacaatcatagtatttactgaagcatcatgataaaaagtagtgcaaaagcattcgattcagatcctgtaaagaagctggaataacagagttgtaaatgaaatagcgtgctctgccaattactatagactccaaattaattagcctaccaaaatttgccaatgtactgatgtagtttattcaggctgcaatacatggccctcagtctataatctggtgtagtaggctaaaacttgtaaatgaacattgtttctgaactcgaataattctgtcaaaaagtttagacagatcttgaaatgaataaagtacagaatgtaagcattgcctctgaa

SEQ ID NO: 5062 - DNA, 2210 bp, Brachypodium distachyon
ccggccggcctgccactcggtccggatggagggcgccggcgaggagatggcgcggcggctgtgggcggagctcccggtgcgcgtggactgggcggccgtggcggcgcaatgcgcgtacgcgtgggcgcaggccagggcgttcctggtggtgcccgccgtgcggctcctcgtgttcgtctcgctcgccatgaccgtcatgatactgctcgagaagctcttcgtggccgccgtcttcctctccgtgtacaagctgtcgatcggggcggcatgtgcgctggagtggccgtccgaccgcgtcgtgatacaggtgctggacgactccacggaccccgttgtgaaggatgccatagccccagactccccactgatatcgcggctttttctgaaactaaaaataaatggaccgtcggggtcccactgcatacggcagaaggacggcggcgttcgccggcttctaggcatggccgggggtagaatggtggcgattgtgggcgagccggagcgggacttggtggagatagagtgccagagatggaagggcaaaggtgtgaacatcaagtacgaggtcagagggaaccggaaggggtataaagccggtgcgcttaaggaaggattgaagcacgactatgtccaagaatgcgagtacattgccatgttcgatgctgattttcagccagagtctgattttctcatgagaaccgtcccattccttgtgcacaacccggaaatcgccctagttcagactcgctggaaatttgttaattctgatgaatgcttactgacaagattccaagaaatgtcactggactaccatttcaagtttgagcaagaggctgggtctgtagtatactcgtttttcggtttcaacgggacagctggtgtctggaggatctcggccattgacgatgctgggggctggaaggaccggacaactgtcgaggacatggacctggctgttcgcacagcattgcagggctggaaatttgtttacgtcggtgacgtaaaagtcaggagtgagctaccaagcacattcaaggcataccgatttcagcagcacagatggtcttgtggacctgcaaacctgttcaagaaaatgttgatggagatcttagaaaacaagaaagtgtcattttggaacaaaatccacctcttgtatgatttcttctttgtcgggaagattgctgctcatacagtgacattcatgtactattgctttgcgatcccattgtcagttttcttccctgagattcagattcctctttggggggtggtttatgttccatcagttattaccctctgcaaggctcttggatcaccaagttcatttcatctggtgatcctctgggtcctttttgagaatgttatgtcgttgcaccggataaaagcagcagtaactggtcttctagatgctggacgagtcaatgagtgggttgtcactgagaaattgggagacgccagcaagataaagccaaccattgatgtattagatgctgtgaaagtgatagatgtcgagctaacaacgcccctagtacctaagctcaagaaaaggcgaacaagattctgggagaagtacaactgctcagaaatttttgttggaacctgcataattatcagtggttgctatgatatgctttatgcaaagaagggatactacatctaccttttcattcaagggatagcattcctcgttgttggttttgagtatatcggcacgcgccctcctcgcactgaataagctgccacgagctgatatgcatggtcatgataaactgcagcaagtaaagcccctctcctgcacatatcaacctcagaacataatgatatactgagcattcttcccatcagtcttggtcagatttgatccaactattctttacttccgagaaggctattcatgtagcatcgccgtttttctgatagtaacattatttactgaagcaccatgacagaaagattggtgcagcagcattccattcagatcctgtagaaatgcatcccaggcctgcaagaataacagcagctgtaaatgaaataacatgctttgccaattactgtagattctccaaaattagcctacccttccatgcaaatgtactgatatagattgttcagacatgtaatagaggaccattagcacctccagtctatatcctgtgtactaggccaaaacttgtaaatgtacatttttgctgaacaccaataattctgtc

SEQ ID NO: 5063 - DNA, 1218 bp, Brachypodium distachyon
gacttggtggagatagagtgccagagatggaagggcaaaggtgtgaacatcaagtacgaggtcagagggaaccggaaggggtataaagccggtgcgcttaaggaaggattgaagcacgactatgtccaagaatgcgagtacattgccatgttcgatgctgattttcagccagagtctgattttctcatgagaaccgtcccattccttgtgcacaacccggaaatcgccctagttcagactcgctggaaatttgttaattctgatgaatgcttactgacaagattccaagaaatgtcactggactaccatttcaagtttgagcaagaggctgggtctgtagtatactcgtttttcggtttcaacgggacagctggtgtctggaggatctcggccattgacgatgctgggggctggaaggaccggacaactgtcgaggacatggacctggctgttcgcacagcattgcagggctggaaatttgtttacgtcggtgacgtaaaagtcaggagtgagctaccaagcacattcaaggcataccgatttcagcagcacagatggtcttgtggacctgcaaacctgttcaagaaaatgttgatggagatcttagaaaacaagaaagtgtcattttggaacaaaatccacctcttgtatgatttcttctttgtcgggaagattgctgctcatacagtgacattcatgtactattgctttgcgatcccattgtcagttttcttccctgagattcagattcctctttggggggtggtttatgttccatcagttattaccctctgcaaggctcttggatcaccaagttcatttcatctggtgatcctctgggtcctttttgagaatgttatgtcgttgcaccggataaaagcagcagtaactggtcttctagatgctggacgagtcaatgagtgggttgtcactgagaaattgggagacgccagcaagataaagccaaccattgatgtattagatgctgtgaaagtgatagatgtcgagctaacaacgcccctagtacctaagctcaagaaaaggcgaacaagattctgggagaagtacaactgctcagaaatttttgttggaacctgcataattatcagtggttgctatgatatgctttatgcaaagaagggatactacatctaccttttcattcaagggatagcattcctcgttgttggttttgagtatatcggcacgcgccctcct

SEQ ID NO: 5064 - DNA, 1935 bp, Panicum virgatum
  misc_feature (1410)..(1410): n is a, c, g, or t
  misc_feature (1420)..(1420): n is a, c, g, or t
  misc_feature (1506)..(1506): n is a, c, g, or t
  misc_feature (1535)..(1535): n is a, c, g, or t
gcatgactacgtcaaagactgccagtacattgccatgtttgatgccgacttccagcctgagtccgattttctcctccggactattccgttcctcgtgcacaacccggagatcgccctcgtccaggctcgctggaaattcgtcaattctgatgagtgtctgctgacaagattccaagaaatgtcgttggattaccatttcaagtatgagcaagaggcggggtcatcagtgtactcattctttggctttaatgggacagctggtgtttggaggatttcagcaatcaatgatgccgggggctggaaggaccggacaacagtggaggatatggacctggctgtccgcacgatgcttcgggggtggaaattcgtttacgtcggtgacataaaagtcaagagtgagctacctagcacattcaaggcatacaggtttcagcagcacaggtggtcatgtggaccggcaaacctgttcaagaaaatgatggtagagattttagaaaacaagaaagtgtcattgtggagtaaaattcacctgtggtacgatttcttcttcgtcgggaaggttgctgctcatacagtgacattcatctattactgcttcgccatccctgtgtcagttttgttccctgagattcaaatcccgctctggggggttgtctatatcccaacagttatcaccctcttgaaggctcttggcacaccaagttcatttcacctggtgatcctctgggtcctgtttgagaatgtcatgtcgttgcaccggattaaagctgcagtaagtggtcttctggatgctggaggaagagtcaatgagtgggttgtcaccgagaaattgggtgacgccaacaagacaaagcctaccatcaatggatcagattctataaaggtgatagatgtaaacctaacagagcttgatgtgaagctaacagagccccttataccgaagatcgtaaagaggcagacaagattttgggagaggtaccactgctcagaacttttcgttggaatgtgcataattctgtgtggttgctatgacgtgttttacgctaagaagggatactacattttcctcttccttcaaggcacagctttccttgttgctggctttgggtatgtcggcacacgacctccttccactgcataagctgtcctggacaaaattgatataaccgcttgcaaaaaattgagtgcaagcaaagcccctctctcctgcacatatcgactatagaatacaatggtaacggaacatttcttcccatcaatctcggccagatatgatccgaccattcttttttactgccaagaaggtcatagatatagcattggcattcttcccatcagtcattgtcagatttgatccaaccattctttagtgccaagatacagataccgttgtcatccttcaattccctncggactctgntcttgttcagttttgattcaaatattcgttactgccaagaaggccattcagatagtatctgtcattctaattgtataataacagtncttactgaagcaccctgaaaataaaaatnattggtgcagcagcatttggttcagatcctgtagaggtgcatttcagagttggaagaattgcaacagttgtaaatgtaatagcaccagctggcaatttctgtagatctctgaaattgtagttttgtttttggcaatttagtgatatagctttgtcagagttcagattcataagggaagatcgttggcttcctcagttcataacccgtgcaggcttaatacttaaatgtacattgttttttaattgccataattctgtcgaactttggcagatcttgaaatgcattattgcactgcaagtgtagcatgtaaattttgttatgtaagaagctaaagacgacgccttctgaacagacattttacttgctgcgacacatggactagtggatctatttactatcg

SEQ ID NO: 5065 - DNA, 1714 bp, Triticum aestivum
  misc_feature (23)..(23): n is a, c, g, or t
  misc_feature (35)..(35): n is a, c, g, or t
  misc_feature (42)..(42): n is a, c, g, or t
  misc_feature (50)..(50): n is a, c, g, or t
  misc_feature (59)..(59): n is a, c, g, or t
  misc_feature (83)..(83): n is a, c, g, or t
  misc_feature (92)..(92): n is a, c, g, or t
  misc_feature (128)..(128): n is a, c, g, or t
  misc_feature (179)..(179): n is a, c, g, or t
  misc_feature (236)..(236): n is a, c, g, or t
  misc_feature (578)..(578): n is a, c, g, or t
  misc_feature (628)..(628): n is a, c, g, or t
  misc_feature (671)..(671): n is a, c, g, or t
  misc_feature (767)..(767): n is a, c, g, or t
  misc_feature (797)..(797): n is a, c, g, or t
  misc_feature (895)..(895): n is a, c, g, or t
ccgaccccgctgtaaaggacctngtggagatcgantgccagnggtggaanggcaagggngtgaacatcaagtacgaggtgagngggaaccgnaaggggtacaaggccggcgcgctcaaggaggggctnaagcacgactacgtgcaggagtgcgagttcatcgccatgttcgacgccganttccagcccgagtccgacttcctcctgcgcaccgtccccttcctcgtgcacaacccngacatcgccctcgtccagacccgctggaagttcgttaattcggatgagtgtttgctgacaagattccaggaaatgtcactagactaccatttcaagtttgagcaggaggccgggtccatagtctactcgtttttcggcttcaacgggacggccggtgtctggaggatatcggcgatcgacgatgccggtgggtggaaggacaggacgacggtggaggacatggacctggctgttcgcacggcgctgaagggctggaagttcgtgtatgttggcgccgtaaaagtcaggagtgagctgccaagcacattcaaggcgtaccgattccagcagcacaggtggtcntgtggacctgcaaacctgttcaagaaaatgttggtagagattctagagancaagaaagtgtcattttggagcaagctccacctcttgtacganttcttcttcgttgggaagattgctgcccatacggtgacgttcatctactactgcttcgcgatcccgttgtccgttttcttccctgagattcagatncctctctggggcgtggtctacgttccaacngttatcaccctctgcaaggctcttggatcaccaagttcatttcatctggtgatcctctgggtcctctttgagaatgtgatgtcgttgcaccggataanagcggcggtaactggtcttctagacgctggacgagtcaatgagtgggttgtcaccgagaaattgggagatgccaacaagacgaagccagccacggaagtattagatgctgtgaaggtgatagatgtcgagctaacgacgcccctagtgccgaagctcaagaagagaagaataagattatgggacaagtacaactgctcagagatttttgttggaacctgcatagttatatgtggtttctacgatttgttttacgcaaacaaagggtactacatctacctcttcattcaaggcctagcattcctcgtcgtcggttttgagtatatcggcacacgccctcccactcccagcgcctaataggctgccatgccattcatggagctgatacgcatggttacgacaaacctcgtggaagtaaagcccctgtcatgcacatatcgacatcagaacatagcgatatacagagaattttgccttggccacggtcagatttgatccaaccattaattctttattactgccgacaaggcgatcgaaatagcatggtagttcatcagttaataacatgcagtattatttactgaagcatcatgacagaaagatgcattcaacacctggaagaaataacacaagttgtaaattaaataacatgctctgcctattacttactgtagattctccaaattttatatgccaatgtacttactgatgtagcttgctcagaatagaggatgatcagcagcagtttgtgcagttgtgttgtgtagtatgacgaaacatgtaaatgtacattgttgctcaacgccatttaattataactc

SEQ ID NO: 5066 - DNA, 1852 bp, Sorghum bicolor
tttccagctctgcgtccagcgtcctccccgcgacgacgcttcccgagctctctcctctgttccctctcatccccgcgattctcctctgccgctctccgctagggttttgccgccgacctctcgctcgctcgctcccggctccgcgaggcaaccgtccggccggtcgaaatggtggatgtggaggaggtcgggaacaagatgcaatcgcagatgcgcctgcacgccgagccggaggacgacgccgccgccgacctccccctgccggccctcttcgacagggcgtcgcggatccacgccctcgcctccagctccgccctcgaccaggatgggatccgcacgggggttgatctgctgcggcgctgcgacgagatggtcagcaagctcggccttttctcccccaacgagaccaaggaagacgtctccaccgcaaacctcaagtacctactcgttccatattaccttgcggaaatgactgagaagatagcacaagaggatcggatcccggttcttaaggcgtcacaggaccacttgaaggaattcattgctctatgtgaagtactagagcttattccagaggatgagctagaattgtctaggcagaagcagcctgatactatggcaaacaggagagcacagaaggttgcccggttcaaacgtcaaaaggctgcagaaacgaagctccaagagatcagagagagaaaagaaaggcgtggacgctcattgagagcagctgctttatctgccccaattgaagctggagaggaagatgacctggaggatgatggagaggaagaaagagaggcttggttagctaccatctcattggctctctgcaaggcgtttgatcttctcgacatgctaaagaaggaagaagaaatgcttctagctgtaaaggaaaggaaggcaaaggacgggaatgcatttgctcgtgaaatgctcgatgaacgaacaaagaaggctgaagcatggcaccacaatgctgccaaccgtgtggtatattccaaaccagctgatccaatcacttgcgcaacatttgctcaagatgtcattgaaggtagagcaagcgtttcacaagctcacgagcacaaacaccagcccctgatatttggacctgcaagtcttgttggtggtggtctaaccagtgaaagggaaagaatggcagcacaagtttttcagcctagttacaggatgccaacaatgagcatagaagaagctggtttgcgcgagatgaaaataatggagaaatggcaggaaaggaccgccgagataatgaaagaagcaaactccgcgtggcacaaggatggcaccagctcggcccaagaggacgaggacgccgaggaggcgaaagcaagagcgtgggacgactggaaggatgacaacccccgtggcgcaggcaacaagaagctcacgccctgtggctaatttgtgaaacgcgcgctgtatcgataaatacttcacatggaacacgatgctcatgtagatcatacgatgtttgatttgatcaatatttagtctgcgtcttttctagtgatgttcagtgtattatagcctgtttgtgtaagtgctatatgtcctttccagtacgatgcatttttctggagcatgagaaaccgtattcccgtatgcaactgtcatgcagctcggtgctgtctggctgcttctgtactcttttttttcccccgagagaatggattggtctatcataatccatcatcaaaatggtctgtcataactcaaggtcattgtatgtaaacttgtatctagaatgtaatggtctgtcagaatcccatcacctagactgggtttgtcacaaggtcattctataaattctggtaggatgtacacatgatag

SEQ ID NO: 5067 - DNA, 1640 bp, Sorghum bicolor
ctccccgcgacgacgcttcccgagctctctcctctgttccctctcatccccgcgattctcctctgccgctctccgctagggttttgccgccgacctctcgctcgctcgctcccggctccgcgaggcaaccgtccggccggtcgaaatggtggatgtggaggaggtcgggaacaagatgcaatcgcagatgcgcctgcacgccgagccggaggacgacgccgccgccgacctccccctgccggccctcttcgacagggcgtcgcggatccacgccctcgcctccagctccgccctcgaccaggatgggatccgcacgggggttgatctgctgcggcgctgcgacgagatggtcagcaagctcggccttttctcccccaacgagaccaaggaagacgtctccaccgcaaacctcaagtacctactcgttccatattaccttgcggaaatgactgagaagatagcacaagaggatcggatcccggttcttaaggcgtcacaggaccacttgaaggaattcattgctctatgtgaagtactagagcttattccagaggatgagctagaattgtctaggcagaagcagcctgatactatggcaaacaggagagcacagaaggttgcccggttcaaacgtcaaaaggctgcagaaacgaagctccaagagatcagagagagaaaagaaaggcgtggacgctcattgagagcagctgctttatctgccccaattgaagctggagaggaagatgacctggaggatgatggagaggaagaaagagaggcttggttagctaccatctcattggctctctgcaaggcgtttgatcttctcgacatgctaaagaaggaagaagaaatgcttctagctgtaaaggaaaggaaggcaaaggacgggaatgcatttgctcgtgaaatgctcgatgaacgaacaaagaaggctgaagcatggcaccacaatgctgccaaccgtgtggtatattccaaaccagctgatccaatcacttgcgcaacatttgctcaagatgtcattgaaggtagagcaagcgtttcacaagctcacgagcacaaacaccagcccctgatatttggacctgcaagtcttgttggtggtggtctaaccagtgaaagggaaagaatggcagcacaagtttttcagcctagttacaggatgccaacaatgagcatagaagaagctggtttgcgcgagatgaaaataatggagaaatggcaggaaaggaccgccgagataatgaaagaagcaaactccgcgtggcacaaggatggcaccagctcggcccaagaggacgaggacgccgaggaggcgaaagcaagagcgtgggacgactggaaggatgacaacccccgtggcgcaggcaacaagaagctcacgccctgtggctaatttgtgaaacgcgcgctgtatcgataaatacttcacatggaacacgatgctcatgtagatcatacgatgtttgatttgatcaatatttagtctgcgtcttttctagtgatgttcagtgtattatagcctgtttgtgtaagtgctatatgtcctttccagtacgatgcatttttctggagcatgagaaaccgtattcccgtatgcaactgtcatgcagctcggtgctgtctggctgcttctg

SEQ ID NO: 5068 - DNA, 1708 bp, Zea mays
cgcagtgtaacaactaacaaagcttcattaatttttttaataaatcttcccaggcgtccagcgtcctcccggcgacgacgcttcccgagctctctccttcccgcgaccctctcctctgccccgctccgctagggttttgccgcagacctctcgctcgcttccggttccgcgaggcaaccgtccgaccggtcggaatggtggatgtggaggagaccgggaacaagttgcaatcgcagatgcgcctccacgcggagccggaggacgacgccgccgacctccccctcccggccctcttcgatagggcgtcgcggctccacgccctggcctccagctccgccctcgaccaggatgggatccgcacgggggttgacctgctgcggcgctgcgatgacatggtcagcaagctcggcctcttctcccccaacgagaccaaggaggacgtctccacagcaaacctcaagtacctactggtcccatattaccttgcagaaatgaccgaaaagatagcacaggaggatcggatcccggttcttaagacgtcacaggaccatctgaaggagttcattgctctatgtgaagtactagagcttatcccagaggatgagctagaattgtctaggcagaagcagccagatactatgacaaacagaagagcgcagaaggttgcccggttcaaacgtcaaaaggctgcagaaacgaagctccaagagatcagagagagaaaagaaaggcgtggacgctcattgagagcagctgctttgtctgccccaattgaagctggagaggaagatgacctggagaatgatggggaggaagaaagagaggcttggttagctaccatctcattggctctctgcaaggcatttgatcttctcgacatgctaaagaaggaagaagaaatgcttcaagctgtaaaggaaaggaaggcaaaggatgggaatgcatttgctcgtgaaatgctcgatgaacgaacgaagaaggccgaaacatggcaccataatgctgccaaccgtgtggcatattccaaaccagctgatcctatcacttgtgcaacatttgctcaagatgtcattgaaggtagagcaagcgtttcacaagctcacgagcacaaacaccagcccctgatatttggacctgcaagtattgttggtggtggtctaaccagtgaaagggaaagaatgacagcgcaagtttttcagcctagctacaggatgccaacaatgagcattgaagaagctggtttgcgcgagatgaaaatgatggagaaatggcaagaaaggaccgctgagctgatgaaagaatcaacctccgcgtggcacaaggatggcagcagctcggcccaagaggatgaggacgccgaggaggaaaaagcaagagcgtgggacgactggaaggatgacaaccctcgtggcgcaggcaacaagaagctcacgccctgtggttaatttgtgaaacacgctgtgtattgatactccacatggaacatgatgctcatgtagacggtaggatgtttaattttatcattgttgctgtgttttttctgtagtgatgttgagtgtatcgtagcctgtttgtgcaagtgcgatatgtcctccctaatacgacacgtttttctggagccaaggaaatcgtatgcctgtctgcaattgtcatgctgcttggtgccgtttggcttattaataagggaaaaaattggttgtacctgctg

SEQ ID NO: 5069 - DNA, 1670 bp, Saccharum officinarum
ccgcgacgacgcttcccgaactctctcctctgttccctgtcttccccgcgagtccgcgactctcttctctgccccgctccgctagggttttgccaccgacctcacgctcgcacgctcgctcccgtctccgcgaggcaaccgtccgaccggtcgaaatggtggatatggaggaggtcaggaacaagatgcaatcgcagatgcgcctgcacggcgagccggaggacgacgacgccgccgacctccccctgccggcgctcttcgatagggcgtcgcggctccacgccctcgcctccagctccgcccttgaccaggatgggatccacacgggggtcgacctgctgcggcgctgcgacgagatggtcagcaagctcggccttttctcccccaacgagaccaaggaagacgtctccaccgcaaacctcaagtatctactggttccgtattaccttgcggaaatgaccgagaagatagcacaggaggatcggatcccggttcttaaggcgtcacaggaccacttgaaggagttcattgctctatgtgaagtactagagcttattccggaggatgagctagaattgtctaggcagaagcagcctgatacaatggcaaacagaagagcgcagaaggttgcccggttcaaacgtcaaaaggctgcagaaacgaagctccaagagatcagagagagaaaagaaaggcgtggacgctcattgagagcggctgctttatctgccccaattgaagctggagaggaagatgacctggaggatgatggggaggaagaaagagaggcttggttagctaccatctcactggctatctgcaaggcttttgatcttctagacatgctaaagaaggaagaagaaatgcttctagctgtgaaggaaaggaaggcaaaggacgggaatgcatttgctcgtgaaatgcttgatgaacgaacaaagaaggctgaagcatggcaccataatgctgcgaaccgtgtggcatattccaaaccagctgatccaatcacttgtgcaacatttgctcaagatgtcattgaaggtagagcaagcgtttcacaagctcacgagcacaaacaccagcccctgatatttggacctgcaagtcttgttggtggtggtctaaccagtgaaagggagagaatggcagcacaagtttttcagcctagttacaggatgccaacaatgagcatagaagaagctggtttgcgcgagatgaaaatgatggagaaatggcaagaaaggaccgccgagatgatgaaagaagcaaactccgcgtggcacaaggatggcagcagctcggcccaagaggacgaggacgccgaggaggcgaaagcaagagcgtgggacgactggaaggatgacaaccctcgcggcgcaggcaacaagaagctcacgccctgtggctaaatcgtgaaacacacgctgtatcagtaatactccgcatggaacacgatgctcatgtagatcgtacgatgtttgattcgatcaatatttagtttgtgttctttctgctgacgatcagtgtattatagcctgtttgtgtgagtgttatatgtcctctccaatacgatacgtttttctggagcatgagaaatcgattggcccaaataaatatcctattcataataataattaatagtgccgccttttttaagataccagttacat

SEQ ID NO: 5070 - DNA, 1621 bp, Saccharum officinarum
cccaccctgatttccagctctgcgtccagcgtcctccccgcgacgacgcttcccgaactctctcctctgttccctgtcttccccgcgagtccgcgactctcttctctgccccgctccgctagggttttgccaccgacctcacgctcgcacgctcactcccgtctccgcgaggcaaccgtccgaccggtcgaaatggtggatatggaggaggtcaggaacaagatgcaatcgcagatgcgcctgcacggcgagccggaggacgacgacgccgccgacctccccctgccggcgctcttcgatagggcgtcgcggctccacgccctcgcctccagctccgcccttgaccaggatgggatccgcacgggggtcgacctgctgcggcgctgcgacgagatggtcagcaagctcggccttttctcccccaacgagaccaaggaagacgtctccaccgcaaacctcaagtatctactggttccgtattaccttgcggaaatgaccgagaagatagcacaggaggatcggatcccggttcttaaggcgtcacaggaccacttgaaggagttcattgctctatgtgaagtactagagcttattccggaggatgagctagaattgtctaggcagaagcagcctgatacaatggcaaacagaagagcgcagaaggttgcccggttcaaacgtcaaaaggctgcagaaacgaagctccaagagatcagagagagaaaagaaaggcgtggacgctcattgagagcggctgctttatctgccccaattgaagctggagaggaagatgacctggaggatgatggggaggaagaaagagaggcttggttagctaccatctcactggctatctgcaaggcttttgatcttctagacatgctaaagaaggaagaagaaatgcttctagctgtgaaggaaaggaaggcaaaggacgggaatgcatttgctcgtgaaatgcttgatgaacgaacaaagaaggctgaagcatggcaccataatgctgcgaaccgtgtggcatattccaaaccagctgatccaatcacttgtgcaacatttgctcaagatgtcattgaaggtagagcaagcgtttcacaagctcacgagcacaaacaccagcccctgatatttggacctgcaagtcttgttggtggtggtctaaccagtgaaagggagagaatggcagcacaagtttttcagcctagttacaggatgccaacaatgagcatagaagaagctggtttgcgcgagatgaaaatgatggagaaatggcaagaaaggaccgctgagatgatgaaagaagcaaactccgcgtggcacaaggatggcagcagctcggcccaagaggacgaggacgccgaggaggcgaaagcaagagcgtgggacgactggaaggatgacaaccctcgcggcgcaggcaacaagaagctcacgccctgtggctaaatcgtgaaacacacgctgtatcagtaatactccatatggaacacgatgctcatgtaaatcgtacgatgtttgaatcgaccaaaattaagttgggttctttctgctgacgatcatgtattatagccctgttggggtaagtggtatatgtcctctccataccaatacgtttttctgg

SEQ ID NO: 5071 - DNA, 1720 bp, Zea mays
tgaataccagtatccgcagtgtaaaagcttcattttattacaaaaaaaaaatcttcgtcctccccgcgaagacgcttcccgagcttctccttcgttcctcctcttccccgcggctctcctctgccccgcaccggcaccgctagggttttgccgccgacctctcgctcgcttccgggctccgcgaggcaaccgtccggaccggccggtcgaaatggtggatgtggaggaggtcgggaacaagatgcaatcgcagatgcgcctgcacgcggagccggatgacgccgccgccgacctccccctcccggcgctcttcgacagggcgtcgcggcttcacgccctggcctccagctccgccctcgaccaggatgggatccgcaccggggttgagctgctgcggcgctgcgacgagatggtcggcaggctcggtcttttctcccccaacgagaccaaggacgacgtctccaccgcaaacctcaagtacctactcgtcccatattaccttgcggaaatgaccgagaagatggcgcaggaggatcggatcccggttcttaaggcgtcgcaggaccatttgaaggagttcattgctctatgcgaagtactagagcttattccagaggatgagctagaattgtctaggcagaagcagtctgatactatggcaaacagaagagcacagaaggttgcccggttcaaacgtcaaaaggctgcagaaacaaagctccaagagatcagagagagaaaagaaaggcgtggacgctcattgagagcaactgctttgtctgccccagttgaagctggagaggaagatgacctggaggatgacggggaggaagaaagggaggcttggttagctaccatctcattggctatctgcaaggcttttgatcttctcgacatgttaaagaaggaagaagaaatgcttctagctgtaaaggaaaggaaggcaaaggacgggaatgcatttgctcgtgaaatgctcgacgaacggacaaagaaggctgaagcatggcaccacaaagctgccagtcgtgtggcgtattccaaaccagccgatccgatcacctgtgcaacatttgctcaggatgtcattgaagggagagcgagcgtttcacaggcccacgagcacaaacaccagcccctgatatttggacctgcaagccttgttggcggcggtctgaccagtgaaagggaaagaatggcagcgcaagtttttcagcccagttacaggatgccaacaatgagcatagaagaggctggcttgcgcgagatgaagatgatggagaggtggcaagagaggaccgccgagatgatgagagaagcaaactccgcgtggcacaagggcggcgacagcagcagcagctcgatgccgcaaggggagggcggggacgaggatgccgaggaggccaaggcacgagcgtgggacgactggaaggacgacaaccctcgcggcgctggcaacaagaagctcacgccctgtggctagactgcaaatcgaagcacgctcgctgtgtgatcgtacggtgtttgactcgaccagtatttagtttgtatctgacgatcagtgtatttattatataggctgcttctgtaacagtgtgtttatacaccatccactgcagcttcttcacacaggtgtttccgaagttaactgggttagacaaactgtgttgtccaagcaagagtatctaacaaatagctacgtaactacttcatccgtttc

SEQ ID NO: 5072 - DNA, 1548 bp, Panicum virgatum
tccccacgcgagcgctctctcctctgcttcccctcctccccgcgactccgcccggctctagggttttgcccccgatcgatcgaaatggtggaggtggaggaggtcgggaacaagatgcagtcgcagatgcgcctccatccagagccggaggacgaccccgacctcccgctccccgccctcttcgacagggcgtcccggctccacggcctcgcctccagctccgccctcgaccaggaagggatccggaagggggtcgagctgctgcggcgctgcgacgagatggtcagcaagctcggcctcttctccaccaacgagaccaaggaagacgtctccaccgccaacctcaaataccttctcgtcccatactacctaggggaaatgactgagaagattgcacaggaggacaggatcccaattcttaaggcatcacagaaccatttgaaggagtttattgctctatgtgaagcactagagcttattccagaggatgagcttgaattatctagacagaagcagcctgatactatggcaaacagaagagcacagaagattgcccgtttcagacgtcaaaaagctgcagaaacgaagctccaagagattaaagagagaaaagaaaggcgtgggcgctcattgagggcagctgctttatctgctcctgttgaagctggggaggaagatgccttggaggatgatggggaggaagaaagagaggcatggttagctactatctcattggctctctgcaaggcctttgatcttcttgacatgctaaagaaggaagaagaaatgcttctagctgtaaaggaaagacaggaaaaggatgggaatgcatttgctcgtgaaatgcttgatgaacgtacacaaaaagctgaagcatggcaccacaatgctgcaaaccgtgcaccatattccaaaccagctgatccaatcacttgcgcaacatttgctcaagacgtccttgaaggtagagcaagtgtttcgcaagctcatgagcacaaacaccaacccctgatatttggacctgcaagtcttgttggtggaggactaaccagtgaaagggaaagaatggcagcacaagtttttcagcccggttacaggctgccaacaatgagcatagaagaagctggtttacgtgaaatgaaaatgatggagaaatggcaagaaagaactgcaaatatgatcaaagaagcaaactcggcatggcacaaggacggtactagctcagctcaagaggatgaggatgcagaggaggcaaaagcaagagcttgggacgactggaaggatgacaaccctcgtggtgctggcaacaagaagctcacgccgtgcggctaaattgcttgcaatgtgttgaaatacccccttgtgatggatgttcgtgtagattatagaatgtttgatttttgtttttgtctcagttgtgcttttgtagtaattttctgtgtataatacgatactgatgatgtgctctgcaagtcagcaagtgcatgattacattgtttctgaagaggggtgtgctgttgaaagagtagcatcttgtctgttgatcaa

SEQ ID NO: 5073 - DNA, 1140 bp, Pennisetum glaucum
accgagaggatcgcgcaggaggaccggatcccgattcttaagtcgtcgcagaaccatttgaaggagttcattgctctatgtgaagtactagagcttattccacaggatgagcttgaattatctagacagaagcagcctgatactatggcaaacagaagagcacagaagattgcccggttcaaacgtcaaaaggctgcagaaacaaagctccaagagattaaagagagaaaagaaaggcgtgggcgctcattgagggcagctgctttatctgctcctgttgaagctggagaggaagatgcctttgaggatgatggggaggaagaaagagaggcttggctagctactatctcattggctctctgcaaggcctttgatcttctcgcatgctaaagaggaagaagaaatgcttctagctgtaaaggaaagaaaggaaaaggacgggaatgcatttgctcgtgaaatgcttgatgagcgtacacaaaaggctgaagcatggcaccaaaatgctgcaagccgtgcaccatattccaaaccagctgatccgatcacttgcgcaacatttgctcaagatgtccttgaaggtagagcaagtgtttcgcaagctcatgagcacaaacaccaacccatgatatttggacctgcaagccttgttggtggaggactgaccactgaaagggaaaggatggcagcacgagtctttcagcctggttacaggctgccaacaatgagcatagaagaagctggtctgcgcgaaatgaaaatgatggagacatggcaagaaaggaccgcagatatgatcaaagaagcaaactcggcgtggcacaaggacggcacaagctcagcccaagaggatgaggatgccgaggaggccaagcaagagcatgggacgactggaaggatgacaaccctcgcggtgcaggcaacaagaagctcaccccctgcggctgaatcgccctgcatttactgaagtcccacctgtggcaaatgtgtgtgtagattgcagaatgattgattttactaatgttccagctgtgcctctttcagtaacagtaacgctttgtctgtgtataacacgattcctgtgatgtgcaaatcagcaagtgcatggtttcttttttatatatatttatatgtatattt

SEQ ID NO: 5074 - DNA, 1555 bp, Oryza sativa
gacgtttcccgtttcccttccttcgcgcggcgctgctccggtagggtttttagccggcgatctctcccctctcgcgcgctcggcgactgagaatggtcgaggtggaggaagtcagcaacaagatgcaggcgcagatgcgcctccaccccgcggcggcggcggaggaggaggacgccgacctcccgctccctgccctcttcgacaaggcgtcccacctccactccctcgcctccagctcctccctcgatcaggaagggatccgcaagggggtcgacctgctgcggcggtgcgacgagatggtcagtaagctcggcctcttctcctccaacgagaccaaggatgacgtctccactgccaacctcaaatacctactcgtgccgtactaccttggggaaatgactgaaagggtagcgcaggaagatcggatcccagtccttaaggcgtcgcaggatcatttgaaggaattcatttctatctgtgaagcactggagcttatatcagaggatgagcttgaattgtctaggcagaagcaacctgataccatggcaaatcgaagagcacagaaggttgcacggttcaagcgccaaaaggctgcagaaacaaagctcctagaaatcaaggagaggaaagaaaggcgtaggcggtcattgagagcagctgctttatcagctcctattgaagctggggaggaagatgcttttgaggatgatggagaggaagaaagagaggcatggttagctactatctcattggctctatgcaaggcttttgaccttcttgacatgttaaagaaggaagaagaaatgcttctggcagtaaaagaaaggcaagcgaaggatggtaatgcatttgctcgtgaaatgcttgatgaacgtacaaaaaaggctgaagcatggcaccataatgctgccaaccgtgcaccatattccaagccagctgatccaatcacttgtgcaacatttgctcaagatgtcattgaaggtagagcaagtgtttcacaagcacatgagcacaaacaccagccgctgatatttggccctgcaagtcttgttggtggaggactaaccagtgaaagagagagaatggcagcacaagtttttcagccaagttacaggttgccaacgatgagcatagaagaagctggcttacgtgagatgaaaatgatggagaaatggcaagaaagaactgctaagatgattcaagaatcaaactccgcatggcacaaggatggcagtcggtcagcccaagaggatgaggacgctgaagaggagaaagcaagagcatgggatgactggaaggacgataaccctcgtggtgcaggcaacaagaagctcactccctgtggctagattatatgctatggcaattctattgaacttagatctgaaactgtagctcttgtaaaaatatgtggttttttactttccttactgcggcatttgttgactgttgagtaataatgtgttccatatgcctattgtaatggtgcatggttttcttctgccaatatattgggaagtaatgccaaaaaaaagctggtttgagaagcaagctt

SEQ ID NO: 5075 - DNA, 1557 bp, Panicum virgatum
cgaagccacgaacacgaagcgggcctctccctgctctgctctggaaatttctcctctgttcctccttccccacgcgagcgctctctcctctgcttcccctttcctccccgcgactctgcccggctctagggttttgcccccgatcgaaatggtggaagtggaggaggtcgggaacaagatgcggtcgcagatgcgcctccatccggagccggaggacgacgccgacctcccgctccccgccctcttcgacagggcgtcccggctccacggcctcgcctccagctccgccctcgaccaggaagggatccggaagggggtcgagctgctgcggcgctgcgacgagatggtcagcaagctcggcctcttctccactaacgagaccaaggaagacgtctccaccgccaacctcaaatacctgctcgtcccatactacctcggggaaatgactgagaagatcgcacaggaggacaggatcccaattcttaaggcgtcacagaaccatttgaaggaattcattgctctatgtgaagtactggagcttattccagaggatgagcttgaattatctagacagaagcaacctgatactatggcaaacagaagagcacagaagattgcccggttcaaacgtcaaaaagctgcagaaatgaagctccaagagattaaagagagaaaagaaaggcgtggacgctcattgagggcttctgctttatctgctcctgttgaagctggggaggaagatgccttggaggatgatggggaggaagaaagagaggcttggttagctactatctcactggctctctgcaaggcctttgatcttctcgacatgctaaagaaggaagaagaaatgcttctagatgtaaaggaaagacaggaaaaggatgggaatgcatttgctcgtgaaatgcttgatgagcgtacacaaaaagctgaagcatggcaccagaatgctgcaaaccgtgcaccatattccaaaccagctgatccaatcacttgcgcaacatttgctcaagatgtccttgaaggtagagcaagtgtttcacaagctcatgagcacaaacaccaacccctgatatttggacctgcaagtcttgttggtggaggactaaccactgaaagggaaagaacggcagcaaaagttttccagcctggttacaggctgccaacaatgagcatagaagaagccggtttacgcgaaatgaaaatgatggagaaatggcaagaaaggaccgcaaacatgatcaaagaagcaaactcggaatggcacaaggatggcactaactcagcccaagaagatgaggatgccgaggaggcaaaagcaagagcttgggacgactggaaggatgacaaccctcgtggtgctggcaacaagaagctcacgccctgcggctgaattgcttgcaatgtgttgaaataccccttgtgatggatgttcgtgtagattatagaatgtttgatttttattgatgtctgagttgtgattttgtagtaatgttctgtgtatgatacgatactgatgatgtgctctgcaacttagcgagtgcatgatttcat

SEQ ID NO: 5076 - DNA, 1501 bp, Oryza sativa
gacgtttccagtttcccttccttccttcctccgcgtcgcttcccttccttcgcgcggcgctgctccggtagggttttagccggcgatctctcccctctcgcgcgctcggcgactgagaatggtcgaggtggaggaagtcagcaacaagatgcaggtgcagatgcgcctccaccccgccgcggcggcggaggaggaggacgccgacctcccgctccccgccctcttcgacaaggcgtcccacctccactccctcgcctccagctcctccctcgaccaggaagggatccgcaagggggtcgacctgctgcggcggtgcgacgagatggtcagtaaggtcggcctcttctcctccaacgagaccaaggatgacatctccaccgccaacctcaaatacctactcgtaccgtactaccttggggaaatgactgaaagggtagcgcaggaagatcggatcccagtccttaaggcgtcgcaggatcatttgaaggaattcatttctatctgtgaagcactggagcttatatcagaggatgagcttgaaatatctaggcagaagcaacctgataccatggcaaatcgaagagcacagaaggttgcacggttcaagcgccaaaaggctgcagaaacaaagctcctagaaatcaaggagaggaaagaaaggcgtaggcggtcattgagagcagctgctttatcagctcctattgaagctggggaggaagatgcttttgaggatgatggagaggaagaaagagaggcatggttagctactatctcattggctctatgcaaggcttttgaccttcttgacatgttaaagaaggaagaagaaatgcttccggcagtaaaagaaaggaaagcgaaggatggtaatgcatttgctcgtgaaatgcttgatgaacgtacaaaaagggctgaagcatggcaccataatgctgccaaccgtgcaccatactccaaaccagctgatccaatcacttgtgcaacatttgctcaagatgtcattgaaggtagagcaagtgtttcacaagcacatgagcacaaacaccagccgctgatatttggccctgcaagtcttgttggtggaggactaaccagtgaaagagagagaatggcagcacaagtttttcagccaagttataggttgccaacgatgagcatagaagaagctggcttacgtgagatgaaaatgatggagaaatggcaagaaagaactgccaagatgattcaagaatcaaactccgcatggcacaaggatggcagtcggtcagcccaagaggacgaggacgccgaagaggagaaagcgagaggatgggatgactggaaggacgataaccctcgtggtgcaggcaacaagaagctcactccctgtggctaaattatatgctatggcaattctattgaacttacatctgaaactgaagctcgtgtaaaaatatgtggtttttactaactttccttactgcggcatttgttgattgctgagtaataatgtgttccatat

SEQ ID NO: 5077 - DNA, 1548 bp, Avena sativa
tgcttctccctctccctcccggcgactctgccccctttgtctagggttttacccggcgatctctctcctccctcgctcctgccgtggcgaggcgcccggtggaaaatgacggaggtggaggaggtcggtaacaggatggaagcgcagctgcgcctccacgcggggccggcggcggaggacaacggcgatctccccctccccgccctcttcgagagggcgtcccacctccactcgctcgcctccagctcctccctcgaccaggaagggatccgcacggggatcgacctgctgcggcgctgcgacgagatggtcagcaagctcggcctcttctcctccaacgagaccaaggaagacgtctccaccgccaacctcaagtacctactcgtgccatactaccttggtgagatgactgaacaagtggagcaggaggaccggattccagttctcaaggcatcacaagatcatttgaaggagttcatttctatatgtgaagctttggagcttattccagaggatgagctccagtcatctagacaggggcaatctgaaaccccggccaaccgaagagcacaaaaggttgcccggttcaagcggcaaaaggctgcagaaacaaagctccaagagatcaaagagaggaaggaaaggcgtgggcggtcattgagagcagcagctttatcagctcctattgaagctggcgaggaagatgactttgagaatgatggagaagaagaaagagaggcttggttagctactatctcactggctctctgcaaggcttttgatcttgttgacatgttaaagaaggaagaagaaatgcttctggctgtaaaagaaagaaaagaaaaggatgggaatgcatttgctcgtgaaatgcttgatgagcgaacacaaaacgctgaagcatggcaccaaaatgctgccagccgcgcaccatattccaagccagctaagccaatcacttgtgcaacttttgctcaagacgtgattgaaggtagagcaagtgtttcacaagctcatgaccacaaacaccaacccctgatatttggtcctgcaagtcttgttggcggaggactaaccagtgaaagggaaagaatggcagcacaagtttttcagcctagttacaggatgccgacaatgagcatagaagaagccgggttaactgaaatgaagattatggaagaatggcaagaaagaaccgccaaaatgattcaagaggctagctcctcttggcacaaagatgacactagtcgggccgaagacgacgaggacgccgaagaggagaaagcaagggcatgggatgactggaaggatgaaaaccctcgcggtgcaggcaacaagaagctcaccccatgcggctaggtgctgctatcaacactagtgaaaataccacatgatactgatatccatgttgctgagtgatggccagataacatttgtttagttttccctcatgtttgctgagtgatgttcttcagagtacgttatacaaatgctgtgctagtgcattatgatttcatacatacacttgttgaggtagtatgcatcgcc

SEQ ID NO: 5078 - DNA, 1550 bp, Brachypodium distachyon
gagaccaaaccggaaccagcccagacacttcagccatcgtcttctgctcccctcccggcgactccgcacccgctctcttctctagggttttaaccggcgatctctgatcccctcctctcgctcctgccgtgccggcgagaaatggcggaggtggaggaggtcgggagcaggatggaagcgcagctgcgcctccacgcgggcccagcggcgggcgaggaggacgacggcgatctcccgctccccgtcctcttcgacagggcgtcccacctccacgcgctcgcctccagctcctccctcgaccaggaagggatccggaagggggtcgacctgctgcggcagtgcgacgagatggtcagcaagcttggcctcttctcctccaacgagaccaaggacgacgtctccaccgccaacctcaagtacctcctcgtgccgtactaccttggggaaatgactgagcaagtggatcgggaggaccggattccagtcctcaaggcatcacaggatcatttgaaggagttcatttctatatgcgaagcgttggagcttattccagaggacgagctcgaattatctagacaagggcagtcggaaactgcggcgaaccgaagagcacaaaaggttgcccggttcaagcggcaaaaggctgcagaaacgaagctccaagagatcaaacagagaaaggaaaagcgtggacgatcattgagagcggcgactttatcagctcctattgaagctggcgaggaggatgactttgaggatggtggagaggaagaaagagaggcttggttagctactatcgcattggctctctgtaaggcttttgatcttgtggacatgttaaagaaagaagaagaaatgcttctggctgtaaaagaaagaaaagaaaaggatgggaatgcatttgctcgtgaaatgctcgatgagcgtacacaaaaggctgaagcttggcaccagaatgctgccagccgtgcaccatattcaaaaccagccgatcccattacttgcgcacattttgctcaagatgtcattgaaggtagagcaagtgtttcacaagctcatgaccacaaacaccaacccatgatatttggacctgcaagtcttgttggtgggggactaaccagtgaaagggaaagaatggcagcacgagtttttcagcctagttacaggatgccgacgatgagcatagaagaagccggattgactgaaatgaaaattatggaggaatggcaagcaaacacggccaagatgattcaagaggcaagctcctcttggcacaaggatggcaccagttcagcccaggacgacgaggacgccgaagaggagaaagcaagggcatgggatgactggaaggatgagaaccctcgtggcgcaggcaacaagaagctcactccctgcggctaaattgtgagctcgtacacagttgaaaataccacatgatactagcgatgttcatgtagaatgttacaacatttgtattatttccccgtccaatgtttgctgagtaatgtcgaaaattatatgcattttgtgcaagtgcttgtgttatcatc

SEQ ID NO: 5079 - DNA, 1331 bp, Brachypodium distachyon
aaatggcggaggtggaggaggtcgggagcaggatggaagcgcagctgcgcctccacgcgggccgaggacgacggcgatctcccgctccccgtgctcttcgacagggcgtccacctccaagcgctcggctccagctcctccctcgaccaggaagggatccggaagggggtcgacctgctgcggcagtgcgacgagatggtcagcaagcttggcctcttctcctccaacgagaccaaggacgacgtctccaccgccaacctcaagtacctcctcgtgccgtactaccttggggaaatgactgagcaagtggatcgggaggaccggattccagtcctcaaggcatcacaggatcatttgaaggagttcatttctatatgcgaagcgttggagcttattccagaggacgagctcgaattatctagacaagggcagtcggaaactgcggcgaaccgaagagcacaaaaggttgcccggttcaagcggcaaaaggctgcagaaacgaagctccaagagatcaaacagagaaaggaaaagcgtggacgatcattgagagcggcgactttatcagctcctattgaagctggcgaggaggatgactttgaggatggtggagaggaagaaagagaggcttggttagctactatcgcattggctctctgtaaggcttttgatcttgtggacatgttaaagaaagaagaagaaatgcttctggctgtaaaagaaagaaaagaaaaggatgggaatgcatttgctcgtgaaatgctcgatgagcgtacacaaaaggctgaagcttggcaccagaatgctgccagccgtgcaccatattcaaaaccagccgatcccattacttgcgcacattttgctcaagatgtcattgaaggtagagcaagtgtttcacaagctcatgaccacaaacaccaacccatgatatttggacctgcaagtcttgttggtgggggactaaccagtgaaagggaaagaatggcagcacgagtttttcagcctagttacaggatgccgacgatgagcatagaagaagccggattgactgaaatgaaaattatggaggaatggcaagcaaacacggccaagatgattcaagaggcaagctcctcttggcacaaggatggcaccagttcagcccaggacgacgaggacgccgaagaggagaaagcaagggcatgggatgactggaaggatgagaaccctcgtggcgcaggcaacaagaagctcactccctgcggctaaattgtgagctcgtacacagttgaaaataccacatgatactagcgatgttcatgtagaatgttacaacatttgtattatttcccc

SEQ ID NO: 5080 - DNA, 1571 bp, Triticum aestivum
cgagcccgacacttccattccaccatcgtcttcttccgcccctctccctcccggcgactctgccctgctgcccctccttagggttttacccggcgatctccccccacctcctctgccctcgctcttgccgtgtcgaggcgcccgctggaaaatgggggagatggaggacgtcagcaacaggatggagacgcagctgcgcgtccacgcggcggaggacgacgccgatctcccgctccccgccctcttcgacagggcatcccacctccactcgctcgcctccagctcctccatcgaccaggaagggatccggaagggggtcgacctgctgcggcgctgcgacgacatggtcagcaagctcggcctcttctcctccaacgagaccaaggaagacgtctccaccgccaatctcaagtacctgctcgtgccgtactaccttggggaaatgactgagcaagtggagcaggaggaccggattccggtcctcaaggcatcgcaggaccatttgaaggagttcatttctgtatgtgaagcattggagcttattccagaggacgagcttcagttatataggcaggggcagtctgaaacaggggcaaaccgaagagcacaaaaggttgccaggttcaagcggcaaaaggctgcagaaacgaagctccaagagatcaaagagagaaaggaaaggcgcggtcgttcattgagagcaacggctttatcagcacctattgaagccggggaagaagatgatttggaggccgatggagaggaagaaagggaggcttggcttgctactatctccttggctctctgcaaggcttttgatctcgttgacatgttaaagaaggaagaagagatgcttctggctgtaaaagaaagaaaagaaaaggatggaaatgcatttgctcgagaaatgctagatgagcgcaggcaaaaggctgaagcatggcaccagaatgctgccagccgtgcaccatattccaaaccagctgctccaatcacttgtgcaacttttgctcaagatgtcattgaaggcagagcaagtgtttcacaagctcatgaccacaaacaccaacccctgatatttggacctgcaagtcttgttggtgggggactcaccagtgagagggaaagaatggcagcacaagtttttcagcctagtttcaggatgccgacaatgagcatcgaacaagccggcttagctgaaatgaaaatgatggagcaatggcaagaaagaactgccaagatgattcaagaggcaagctcctcttggcacaaggatgacactagtttggcgcaggacgacgaggacgcagaagaggagaaagcaagggcatttgatgactggaaggatgaaaacccacgcggtgcaggcaacaagaagctcactccctgcggctaaattgaaagctattgacactgtgctgaagataccacatgtagctgatgttcatatactattataacgtttctgttatttcccctcacgtttgcaagagtgatcaccagagtacattatttgtagaaatgttgtgcaagtgcattatttcatccatatccccctttttcaggtgcca

SEQ ID NO: 5081 - DNA, 1438 bp, Cichorium intybus
gcggggatcatcaatctctcacttccatattagctttcgatatcagtttcagttttcttccaatgaagttcaatcttctcaatatttatacacttttttctttcgcgctggtggcaagtcatgcagtgactccagaaggctattggaagtccgtgttgccaaacagtcctatgcccaaagcaatcaaggatctattatacactgcagaatggtcagaagagaagagcaccgcagtaggagttgggaaaggcggtgtggccgtgcacaccggcaaaccagggaaaagaactaatgttggtgttagaaaaggaggtgtgactgttaacaccggaaaaccagggaagggaacgagcgtaggagtaggaaaaggcggagttggtgtgcatgccggaaaaccagggaaacggacggatgttggtgttggaaaaggtggtgtagccgtgcatactggccacaaggggaagccagtttacgtaggggtaggtaaaggacaaaatccattcaattacatgtacgctgcctctgcgaatcaactcaacgataacccaaatgtagcgttttttttcttggaaaacgacttgcatcaaggcacggaaatgaagttacattttaccaaagacaaccaaaaagcaacctttttaccacgacaggtagctgactcgatacccttttcatcaaacaaacttcctcaaatctacaatgagttctcgataaaagccggctccgtggaggctgcagacatgaagcaaaccctaagtgaatgcgagagcaaaggcattgaaggcgaggacaaatattgtgcaacctcattagagtccatgatcgattttagtactaccaagttaggaaaaaaggtcaaagcgatctcgacagaagtaaacactaaagaaagtaccccgttacaaaagtacacaattgagggagccaagaaactagcagcagataaagctgtggtttgccataaacaaaactacgcatatgctgtcttttattgccacaaaactgtcagcactcgagcgtacgctgtttctttggtgggcgcggatggtactaaagcaaaagcggtggcaatttgccatacagacaccgccaaatggaacccaaaacatttggcgtttcaagtccttaaagtgaaaccaggaagtgtcccagtttgccatttcttacccgaagatcacgttgtttgggttccatattaataaagacagtaggaaaaatacgtcaggccgatatatgtagtgtgtttatgcgtctttcctggaccagctataaggtttaccggtcaaactatttattaaggagttgttccatctttctttatgtttggtttatcatgtttgtaaagttaagcaaaatatactactttttctaaggagttactgcatctcttattatgtttggtttatcatgtataattgtaagacttcctgtgtaaaaa

SEQ ID NO: 5082 - DNA, 1141 bp, Taraxacum officinale
tcaacacttttgggtttccgtttagtttttctccaatgaagttcaatctcctcaacatttgtacacttttttccctagcgctagtggcaagtcatgcagtgactcctgatgtgtactggaagtctgtgttgccaaacagccctatgcccaaagcaatcaaggatcttgtgtacacttcagagtcgtggtcagaagagaagacactaaagtcggagttgggaaaggaggtgtagctgttaacaccggtaaaccagggaaaagaacaaatgtcggcgttcgaaaaggtggtgtgagtgtaaacaccggaaagcctggaaagggaacaaacgtaggtgttgggaaaggcggtgtaggcgtgcacaccggaaaaccagggaaacggacggatgttggtgttggaaaaggtggtgtggccgtacatactcgtcacaagggtaagccggtctacgttggggtaggaaagggaccaagtccatttgtgtacaactacgccgcctccgcagatcaacttaaagataacccaaacgtagccttctttttcttggaaaacgacttaaatcaaggcactgaaatgaatttacatttcattaaaaacgaccaaaaagcaaccttcttacctagacaggtggctgactctattccattttcatcaaacaaacttcctcaaatctacaacgagttctcgattaaacccgactcggtggaagctgaagacatgaagcagacattaagtgaatgcgaggacaaaggcattgaaggcgaggaaaaatattgtgctacctcgttagagtccatggtcgattttagtacctcaaagttgggtaaaaaggttaaagcggtttcaacagaggtaaatgctagagagagtacaccgttacaaaagtacaagattgagggagccaagaaactcgcggcagataaagctgtggtttgccataagcaaaactacgcttacgctgtcttttattgtcacaaaactgtcagcactcgagcttatgttgtttctttggtgggtgccgatggtactaaagccaaagctgtggcggttgccatacagacacttcgaagtggaacgcgaaacatttggcatttcaagtgcttaaagtcacaccaggaagtgtgccaatttgccatttcttac

SEQ ID NO: 5083 - DNA, 1857 bp, Petunia hybrida
cgggggccactcaccaccactttctcctttctctatttactccttttttcagtagcattttagcagatcttgagctcaaaaaagcacaacaaaatcttcagctgctatggagttcttcagatctcttaatgctacttcaatattattagtcttcttgctgtcttgcttcagcttttcatcaacagatgcctttgatgcacttgatcccaacggaaacatcacaataaaatgggatgtcatcagctggacaccagatggatatgttgctactgttagtatgttcaacttccagcaatataggcatattcaagcaccaggctggactttgggatggacatgggcgaagaaggaggtaatttggaacatgatgggagctcaaacaacagagcaaggagattgttcaaaatttaaaggaaacattccccattgctgtaagaaggatccaacagtcgtcgacttgctgccaggaactccttacaaccagcagattgcaaattgctgcaagggcggagtgatcaactcatgggggcaggatcctgcaactgctgtcagctcatttcaagttagcgttggtggctcaggaacaacgaataaaacagtcagagttcccaagaacttcaccttaaaggcaccagggcctggttatacttgcggacctgctaaaattgttaaacccactaagttcgttactaacgatggaagacgagtaacacaggccatgatgacttggaatatcacatgcacatactcacagttcctagctcaaaaactccaacatgctgcgtctctctctcatccttctacaatgacacaattgtaccgtgcccgacatgcacttgtggctgccagaagaatggcactcagtctggaaattgtgtagatgaagacgcaccacacctggcttcagttgtttcagaccatcatggaaagaacaaatttgcgcctttggttcagtgcacaaatcatatgtgcccgattagaattcactggcatgtgaaactcaactacaaggagtattggcgggtgaaggtcactataactaacttcaattacaatatgaattatacacaatggaacttagttgtccagcatcccaacttcgacaacctcactcagttattcagcttcaactacaagtcattaactccttatggagcaataaatgacactgcaatgttatggggtatgcaattctacaacgatctgctcatgcaagccggtcctttaggaaatgtccaatcagagctgctattccgaaaggatttatccactttcacttttgagaaggggtgggcttttccccgaagagtgtatttcaatggtgataattgtgtcatgccacctcctgatgcatatccttacatgccaaatgctggttcccaatggaacgtttccttgctaaagctagtggtgacgctgattttctcgatgtcattcttctttacatttatttagaagcctctcagtggataaacgccaagtgcctgtctcagtaagttatatttgggctgatccgctcccactattgagagaactgattggaaagtttgtatgcctgagcagtgacatagacgattcgggtatatttgttcaaggcaactataaggactggttgaattgctgccataattttccttcaacagttgaattaaatgttttttctactgtggtagattcatttttgttgtatgtagatttctcaagttcacaatgatctcagggttgtatgagaataacgaccatttacagagagagttaattactatgatattctttagtactctatttttgtgtactatcaccatgtaaccactttctacattgtgaaaaagattcttagcaacaggtcgcatttgt

SEQ ID NO: 5084 - DNA, 2862 bp, Triphysaria pusilla
attacattattcatcttttttgtgctcttcacttctatagctgcatatgatccgttagatccaaacgggaacataacaatcaaatgggacataatgtcgtggacagccgatggctatgtggcatccgtgacgatgaacaatttccaaatgtaccggcacatcatgagccctggctggaccgtcggctggacatgggccaaaaaagaagtaatctggtccatgatcggttcacagacgaccgaacaaggggactgctccaagttcaaaggcaacattccgcattgctgtaagaaaatcccgacagtggtcgacttgctacccggagttccttacaaccaacagttcagcaactgctgcaaaggcggcgtgctggccgcgtggggccaagaccctcaggcttcggtttcagcattccagatcagcgtgggccaggctgggacgtctaataagactgttaagctgccgaaaaacttcactttgttgggaccgggacctggatacacttgtggcccggctaaggttgcgcctccgacgaattttttaaccgccgatctgcgaaggaaaactcaagccctgatgacttggaacgtaacatgtacatactcacaatttatggcccgaaaacatccaagctgttgcgtatccttctcgactttctacaacgaaacaatcacatcctgcccttcttgtgcctgtggttgcgaaaacaagaacaaatgcatcaagagcgactcgaaactccttagcatggtgggattaaacactccaaaaaaagacaattcgcccctgttacaatgcacgcaccacatgtgccccgtcagggtacactggcacgtgaaagcaaactacaaagactattggagggttaaagttgccattacaaatttcaactacagaatgaactacacgcaatggactctcgtcgtccaacatcccaatctcaacaacgtcactcaagttttcagcttcgattacaagccacttgttcccttcggctccatcaatgatactgggatgttctacggcacgaaattctacaacgacctgttaatggaagctgggccgtctggaaatgtacagtccgaagtgcttatgcagaaggataaagacacttttagccccaagcaaggatgggcttttccccggagagtttatttcaacggggaggagtgtatgctgccaccgccggattcttacccgtttctgccaaattcgtcccgtccgaggcgagattctacctcgagcttgatattatctgctgcaattttgtcactcattacaatagtgtttttattttgaaattttgaagaacacactaaaaagggcattcttgtcatttctattgaaatttagagatactgaaattgacagcataaatcactacaaattacaagttatacaaatacaattatgttcggaatatttttgacgatgtaagattctcaaatacatccaaagtagaatatcgtagatgacaacagagtgattgttaacataaacatggacattttttctcgtaatccgatgttcggtaaataaggatacgcgtcaggaggtggcataacgcaattatcgccattgaagtagattcgcctcggaaaagcccatcccttttcgaacgtgaaagtggatttgtcctttcgaaatagaagctccgactgtacgtttcctagtgggcccgcttggtttagaaagtcgttatagaatttcacaccccacaacattgcagtatcatttatattttgatacggattaagcggcttatagttgaagctgaaaagctgtgtaagattatcgaagttgggatgttgagcgactaagttccattgtgtgtaattcattcggtaattgaagtttgttatagtaacttttactcgccaatattccttgtagtttacctttacgtgccaatggactcgaatagggcacatatgagacgtacattggactagaggcgcaaaactatttgccttgccatgatccgaaacaaccgaggcaatgtatggcgaatctggattcacacagcttcccgggtgagtaatattattttggcatccacaagtacaagtcgggcaagggacaattgtgtcattataaaaagacgaaagtgaaacacagcaagtcggagttttttgagccaagaattgtgaatacgtgcacgtaacattccacgtcatcatggcttgtgtcactcttcgtccatcttgcgtaacaaacttagtaggcttcacgattttagcgggcccacaagtatacccggggcccggtgctttcaaggtgaagtttttcggcacacgaaccgttttattagtggtcccagctgcaccgacgctaatttggaatgagctagcggagttatccggatcttgggcccacgagttaatcacgcctccttacaaacaattagcaatctgttgattgtaaggagttccgggtaataagtcgacgaccgttggatctttcttacagcaatgtggaatattccctttgaatcttgaacaatctccttgctcggtggtttggccgcccatcatgctccaaatcacttcctttttggcccatgtccagcccaaagtccagcccggagcttggatgtgtcggtattgttgaaagttgaacatcgtgacaacagcaacatagccatcagctgtccaactgataacatcccattttattgtgatatttccattaggatcaagggcatcataagcatctgttgaagtaatggagaagcatgaaatcaagaaaacagcaagatagtggtataagtgactctcaacagagatctaaagcacatttccattccactcagtagcagattttcttgatcagtgagatttaagatctgcaactaatatctag

SEQ ID NO: 5085 - DNA, 1861 bp, Vitis vinifera
gggtttttaaagtcccgttagctatgaaaagctcacttaccatgtgagaaagaaggctaccaccatccactgccactgtctcttctcatctttctctttctcagttcgaatatcaactacagctcagagcataatcagcaacaaggaatggagtttttcttcacatccattgccagatccatcaccaagctcagcagttacgccattttgcttgtgttgttgttttcttgctccattttcacttctacagaagcctacgattcgcttgatccagagggaaatatcaccatcaagtgggatgtaatgagctggactccagatggttatgttgctgttgttacaatgttcaacttccagcaatatcgccacattcaagcaccagggtggtcacttggatggtcatgggccaaaaaggaagtaatctggagtatgatgggaggacaaacaacagaacaaggggattgttcaagattcaaagggaatgtaccacattgctgtaaaaaggatccaacagttgtggatttactgccaggaactccttacaaccagcagattgcaaattgctgcaaagggggtgttataaactcatgggtccaggacccagctaatgcagcaagctcattccaggtcagtgtgggtgcagctgggactaccaacaaaactgtcaaattgccaaagaacttcacgttgagagctccagggcctggatatacttgtgggcctgccaagattgtaaaaccaaccaagtttaccacggcggatcagaggagagtcactcaggctttgatgacttggaatgttacttgcacgtattcacaattcctggctcagaagacgcctacatgttgtgtctcattgtcatcgttctataataacactatagtatcctgcccaacttgcacctgtggctgtcaaaataatctaactcatccagggagctgtgtagacccaaacaatccatatttagcttcagtcgttgaaggctcaggtaaaaccagttatcagcctctcgtccagtgtaccagccatatgtgcccaatccgtgtccattggcatgttaagctcaactacaaggattactggcgggtgaagatcacaatcacaaatttcaattacagaatgaactacacccaatggaatcttgttgttcaacatcccaactttgataatctcacacagattttcagttttaattacaagtcattaactccttatgcagccataaatgacactgccatgttatggggagtcaagttttacaatgatttgctctctcaagctggtcctcttgggaatgtgcagtcagagctactatttcgaaaggataaagcaactttcacttttgataagggatgggctttccctcgaagaatttatttcaatggtgataattgcgtcatgcctccaccagatgcctacccatggttgccaaatgccagctcccgacccactgtctctctcctttactcaatcttgacaatcttggcagtttctgtcattgtattggcttatgcttagtgaattatacaggaaaaatccaagaaattacctgttctggaaatttcacaaacttcaatctggtttagatcatacaaaaagtcgtggaaatctcaccaatggggggttgaatgtgttggtgctgtgtttcaaggttaatgcaggtcactaaaaaactctgccttgttatctattttatgcattgggggtgagtttaattttgcttagatttagtttttgtgttgtatgtttatgtatttttatttatacctttgataattttgtttgtagcatatccacgaaaatattcttagcattgtaataaggaaattcacgagcaaatgacagttgatatatggtttag

SEQ ID NO: 5086 - DNA, 1891 bp, Gossypium hirsutum
  misc_feature (14)..(14): n is a, c, g, or t
  misc_feature (28)..(28): n is a, c, g, or t
  misc_feature (78)..(78): n is a, c, g, or t
  misc_feature (124)..(124): n is a, c, g, or t
  misc_feature (306)..(306): n is a, c, g, or t
ttcgcggccgcgtngacgaaaaagctantcatctccgttcttctctctgagtcttccctgtctgccacagatcttganccgaagtcaataacaaaagaagactcctaaaatcctacagaaatgnctaatctttttttgttcattgctagatctttcttcaacctaagctctttcagcttcttgcttctgtttttgctctctttctcgagtttcactgcaacagaagcctatgatcctttggaccctaatggaaatatcacaatcaaatgggatatcatgagttggactgctgatggctatgttgcngttgtcacaatctttaacttccagcagtaccgtcacatccaagcaccagggtggacattaggttggaaatggtctaagaaagaggtaatttggagtatgatgggaggacaaacaactgaacaaggggattgttcaagattcaaagggaacattccacattgttgtaagaaggacccaacagtcgtggatttattgccaggaacaccttataatcagcagattgcgaattgctgtaaagggggagtgctaaactcatgggtacaagatccagctacggcaggaagctcattccaggtgagtgtggggcaagctggaactacaaacaagacggttagagttccaaaaaacttcactttgaaggcaccagggcccggttatacttgtggtccagcaaaaattgtgaaacccagtagatttgttactgcagacaaaagaagagtcacacaagctttgatgacttggaatgttacttgcacgtattcacaatttctagctcagaaaacacctacttgttgcgtctctctctcatcattctataatgaaaccatagtaccttgcccgcaatgtgcttgtggctgccaaaatacttctcagccagggagctgtgtagaccccaaagctccgcatatagcatcggttgttccaagtacagggaagaataactatgcacctttggtccaatgtacaagtcatatgtgtccggtccgagttcattggcatgttaagcaaaactacaaggagtattggcgggttaaggtcacaattactaatttcaattataatatgaactatacacagtggaacttagttgtgcaacatcccaacttcgacaatctcacccagattttcagctttaactacaagtctttaactccatatactgcaataaatgatactgccatgttatggggtgttaaattttacaatgatttgctttcccaagctggtcagctcggtaatgtgcagtcagagctacttttccgaaaggacaaagcaactttcacttttgagaagggttgggctttcgctcgaagaatctacttcaatggagataattgtgttatgccaccgcccgacacctatccttggttgcctaacggcagttcccatcagcttatctccacacttagtttgttgacaactctcttggcagcaatggcatttttattgggatatgcataaagttcaaccatttttatactgggaaatctggtatgctccaaaattttgactgaatcagttcgatgtagaatgtacggcgtgagaagttgcagtttgtgtcagttagaggaagtcaatgtgcagtggtgtcgttttaatgtatggtcagtgaattcactcgtgctgttgtatgtatgcatgttcgtttatgtacttaaaccaaaaacaatgttgattgtagaattcccacgatattttattacagtagtaacagacataaatcattgacagagaaactttagctaacttatgcgttgcggttgtttagggttcgtaagcatatttatgatttgtcaataactcagttagtatcttaaaaaagaagtaaataagaaaagaaacaaactagagatagaaaaaaaac

SEQ ID NO: 5087 - DNA, 1991 bp, Coffea canephora
cggccggggggagggagggagggagcttaggcatagccaggtagtgttagtgctgaccaaagacagctcaccgccgcgttttctctatcgcttactcttttccctttgcttcccaaccaacattcacttcggtgccaaatctggagcggtggccaaacaagaaagcttgctgctgaaaacaaatatggattcttcctgctttagatctctatccaaatttacagcatgtgccattgtggtgctactttccctttcttgcttcagctttaccacgacagaagcttatgatgcacttgatccaaacgggaacatcacgatcaaatgggacgttatggcttggacgccagatggctatgtggctgttgtcacaatgttcaacttccagcaatatcggcgcattcaggcaccaggttggactttgggatggacatgggcaaagaaagaagtcatatggaatatggtgggagcccaaactacagagcaaggtgattgttcaagattcaaagggaacataccacattgctgtaagaaagacccaacggtagttgacttgcttcctggaacgccttacaaccaacaaatagcaaattgctgcaagggaggtgtgctgaacccatgggttcaagatccagcaactgctgttagtgctttccaagttagtgttggttcttcaggaacaaccaacaagacagttaggatgcctaaaaacttcactttaaaagcacctggacctggatatacttgtggaccagctaaagttggtaaacctacgaaattttccaccgcagatggaaggaggacaacacaggcaatgatgacatggaacgttacgtgtacatactctcagttcttggctcagaaaactccgagttgctgtgtttcactctcatcgttttataatgataccattgtaccgtgcccaacttgcacgtgtggctgccaaaataatggttctcatccagggagttgtgtagacgctgatgcgccacatctagcttcagttgtttcagaccatgggaagagcaacaacttagcacctcttatccaatgcacgagtcatatgtgcccaattcgcgtccactggcatgtgaaagtcaactacaaggaatattggcgggttaaggtcacaataacaaacttcaattacagaatgaattactcacagtggaatttagtcgtccaacaccccaactttgataacctgactcagatattcagcttcaacttcaagccattaactccttatcaagctataaatgataccgccatgctttttggaattaagttctacaatgatttcctcatggaagctggtccttatggaaatgtacagtcagaacttctattccggaaggataaatcaactttcacatttgacaagggttgggcttttcctcgaagaatctatttcaatggagataactgtgtaatgccgcctccggattcttatccgtatttacccaatggcggttctcgacgagatatctccattgttgtgcttgtgactgctcttttgtcatctattgcattcttctttacttgtctttaagaatgctgcatttctagcagtagcttaagcagcagtgtcaagcctacagctgagggagcccaattgaagagtcgacaccgcatcaaagatgtctaggaatgcatagctgccaagtgcataaatttggaaaaaccatcggtttcatcttcttcttacagcaaagattggtgaacacactgccaacctcctttttgtgacagttcgtgccatgccatgtttgttgtaccacgttgtattgtttatagttttttagttcttagtgttaataaataccactcgaggacatatatagctgatagcaaagatgattttgacttgtatttttcagctctctgctcttgttttcttgacattgtctacataatagagccattcagaagataatgcacgcttgtagtaccttaatctaattttttttcgacacaaaaaaaaaaaaaaaaaa

SEQ ID NO: 5088 - DNA, 1890 bp, Phaseolus coccineus
  misc_feature (979)..(979): n is a, c, g, or t
  misc_feature (988)..(988): n is a, c, g, or t
cccattatggtcggggaaactagatagtcagtttctggcgctcatcttttccactctctctctttcttttcttcactctctctctctcttcttttttttttctttattgctggttttctctgtcacagatcttgaattgttcaggcaagaactcagaccagttatcatcttgtaccatccaaaatgggtttctctctgttaccaaaagcaactccttgcattttgctcttggttctgctgtattgcacttgcttcacttcaacagatgcttatgatccgcttgacccaaatgggaatatcacaatcaaatgggatattataacttggacccctgatggatatgtagctgttgttacaatgaacaatttccaacaatatcgtcatattgcttcacctggctggagactaggatggacatgggcaaaaaaggaggtaatatggagcatgatgggagggcagaccactgaacaaggagattgttcaaaatttaaggcaggtattccacattgctgtaagaaagatccgacggttgtggatttgcttcctggaacaccttacaatcaacaaattgcaaattgctgcaaaggtggggtgcttggttcttgggtgcaggatccgaccaatgcagtttcatcatttcaagttagtgttggtagagctggaaccacaaacaaaactgtcaaagtcccaaaaaactttaccttgagtgcaccaggaccaggttatacttgtggtccagccaagattgtgaaacccacacaattcattcaagcagacaaaaggagagtgacccaagcactgatgacatggaatgtgacatgccaatactcacaatttctagctcagaaaactccctcttgctgtgtctcactttcatctttctacaatgatactattgtgccgtgcccaacatgtgcatgtggctgccagggtaactcatctctgtcaggaagctgtgtgaattcacaaacgccacatnttggcatcnggttgtttctggctctgggaagaataacttgtcacctttggttcaatgtactaatcatatgtgtccagtccgaatccactggcatgtgaaggtaaactacaaggagtactggcgtgtaaaggttactattactaattttaattacaggatgaactattctgagtggaacatggttgttcaacatccaaacttcgacaatttgactcaattgttcagtttcaactacaagtcattgaccccttacggttcaataaatgacacagcaatgctatggggagttaagttctataatgattttctgagccaagctggccctaatggcaatgttcaatccgagctactcttccgaaaggataaagcaacttttacttttgataagggatgggcttttcctcgaaggatctatttcaatggtgacaattgtgtcatgccaccacctgatgcttatccgtggttacctaatgctggttctcggcaagaagtttccttgtttgccttggtgatagcttatttggtagccttggtattttatgcccacgcataaagttccaatctgtggtacacttaggcttgtaacagaaaattttcagtcagaccagttttgactcatatttgtgatgtcagtttatcatttgaagcatgagggaggaatgaggatgacatccagtggcaactcaagattagcttcacgtgtcctatagtttgttaccgagggttcagcacattggtggtagaatttgtttttgtttttgtgtttgttgtaattcagtgatgtatgtatcgttattatgatgtaactgtaattataataaatatacacaccaacatgtcacatgaatatagacttgatgaatcatgtgagtttgaaatgatagtgatcttttactaaaagtttcctacac

SEQ ID NO: 5089 - DNA, 2113 bp, Ricinus communis
aacattcaaagttttcttcttttctattttttttggttattttagtgaaagcaatggcaaaagttgtgggttttctccaggacgtgtttttaaagattttttaacaatgggcttaaagaagtctttaaaagagttggacaaactgtgttggcttttcttggccaagtggaattgtgaactgaactaagcataaaccaagagccagttattttagccagtatgccacaccctcttctttaagtctttaagtctttttttcttttttgtttctcttttttctgtgtgtttggtttatataatccttgagcccaccaagaacgcaaagacaatcttttcaacaatttaaagtacaaaacaatctgtatcaagatcaagaaatgtactttctctttaaacccgttatgagaacgctctctcaattctccattttggttctttttcttatttcttgcaccaccttcactcaaacagaggcctacgacgcacttgaccctactggaaatatcacaatcaaatgggatattattaactggacacctgatggctatgttgctgttgttacaatgtacaacttccagcaatatcgtcacattcaagcaccaggttggacattagggtggacatgggcaaagaaggaggtaatatggaacatggtgggaggtcaaacaacggagcagggagactgttcaaaattcaaaggaaacattccacattgctgtaagaaaaatccaactgttgtggatttattgcctggaactccttacaaccagcagattgcaaattgttgcaaagggggtgtaatcagctcctggggacaagatccctccaaagcagtaagcgcattccagcttagtgtaggtgcagctggaaccacaaacaaaacagtcagggtaccaaaaaacttcaccttgaaggcaccaggacctggttatacatgtggtccagcaaaaattgttagacctagtagatttttcactactgataaaaggagagtcacacaagctttgatgacatggaatgttacatgcacgtattcacaattcctggcacagaagactcctacttgctgtgtttcactctcatctttctataataacacgattgttccctgcccaacatgtgcctgtggctgccaaagcaacagttctctgtcaggaggttgtgtagatccagatgcaccccacttggcttcagttgtttccggatcagggaagaacagccctgcacctcttgtccaatgcacacgtcatatgtgtccagtcagaattcattggcatgttaaacttaactacagagagtactggcgggttaagatcactattacaaatttcaattacaatatgaactactcgcaatggaacctagttgtccaacacccaaattttgacaatctgactcagattttcagttttaactacaaatcattgaatccttatgcagctataaatgatacagccatgctatggggagttcagttttacaatgatttgctgatgcaagcgggcccgtctggtaatgttcagtcagagctgcttttccaaaaggataaaactacttttacctttgagaaaggttgggctttccctaggaggatctatttcaatggtgataactgtgtcatgccacctcctgatgcctatccatggttgccaaatgctggttcacgccagttttccccacctctcgtactaactataactttgctctctgcattggctttcttaaactttttagtgttccaaccttaatcagcctattctagttttctgctatggcataaactcacaagcttgctgcaaactaagataatctgcaactaagataatctgcaaattctgaccagctcttaacccagtattaattggaagccgattgaaaatttaacttgtttgtacaatgccatccgccattccggttgaaggtgttcaacatttagttatataatggcttctgtttaacgtatttgtgggtgattttgtaccatcttgtttcttgtagctcctgtctcacatgctattactgaactttctcttccttgtaaatttcctcaacacaattagaatgtaacaaaattgagtgtaataaaaagaactcatctctcagagaaactggt

SEQ ID NO: 5090 - DNA, 1371 bp, Ricinus communis
atgtactttctctttaaacccgttatgagaacgctctctcaattctccattttggttctttttcttatttcttgcaccaccttcactcaaacagaggcctacgacgcacttgaccctactggaaatatcacaatcaaatgggatattattaactggacacctgatggctatgttgctgttgttacaatgtacaacttccagcaatatcgtcacattcaagcaccaggttggacattagggtggacatgggcaaagaaggaggtaatatggaacatggtgggaggtcaaacaacggagcagggagactgttcaaaattcaaaggaaacattccacattgctgtaagaaaaatccaactgttgtggatttattgcctggaactccttacaaccagcagattgcaaattgttgcaaagggggtgtaatcagctcctggggacaagatccctccaaagcagtaagcgcattccagcttagtgtaggtgcagctggaaccacaaacaaaacagtcagggtaccaaaaaacttcaccttgaaggcaccaggacctggttatacatgtggtccagcaaaaattgttagacctagtagatttttcactactgataaaaggagagtcacacaagctttgatgacatggaatgttacatgcacgtattcacaattcctggcacagaagactcctacttgctgtgtttcactctcatctttctataataacacgattgttccctgcccaacatgtgcctgtggctgccaaagcaacagttctctgtcaggaggttgtgtagatccagatgcaccccacttggcttcagttgtttccggatcagggaagaacagccctgcacctcttgtccaatgcacacgtcatatgtgtccagtcagaattcattggcatgttaaacttaactacagagagtactggcgggttaagatcactattacaaatttcaattacaatatgaactactcgcaatggaacctagttgtccaacacccaaattttgacaatctgactcagattttcagttttaactacaaatcattgaatccttatgcagctataaatgatacagccatgctatggggagttcagttttacaatgatttgctgatgcaagcgggcccgtctggtaatgttcagtcagagctgcttttccaaaaggataaaactacttttacctttgagaaaggttgggctttccctaggaggatctatttcaatggtgataactgtgtcatgccacctcctgatgcctatccatggttgccaaatgctggttcacgccagttttccccacctctcgtactaactataactttgctctctgcattggctttcttaaactttttagtgttccaaccttaa

SEQ ID NO: 5091 - DNA, 1838 bp, Glycine max
gggacaaaccagacactcagtttctgcctcttattttttttttcctcactttctctctctactttttctctttatttctagtcttctctgtctatcatagatcttgaactatcctggcaagaactcagagcactaacatcttgcagccacaaaaatgggcttctttctgttaccaaaagcaactccttgcattttgttcttggctctgctgtcttgtacttgctttacttctacagatgcttatgatccactcgacccaaatgggaatatcacaatcaaatgggatattataagttggaccccagatggatatgtggctgttgttacgatgaacaacttccaacaatatcgtcatatcgcttcacctggctggtcaatgggatggacatgggcaaaaaaggaggtaatatggagcatgatgggagggcagaccactgaacaaggggattgttcaaaatttaagggaggcattccacattgctgtaagaaagatccgacggttgtagatttgctacctggaacaccttacaatcaacaaattgcaaattgctgcaaaggtggggtgctcagttcatgggtgcaggatccaaccaatgcagtttcctcatttcaagtcagtgttggtagagctggaaccacaaatagaactgtcaaagtcccaaaaaacttcaccttgaaagcaccaggaccaggttatacttgtgggccagctaagattgtggcacccactaaattcattacttcagacaaaaggagagtgacccaagcactgatgacatggaatgtgacatgcacatactcacaatttctggctcaaaaaactccctcttgttgtgtctcactttcatctttctataatgatacccttgttccctgcctaacatgtgcatgtggctgccaaagtaactcatctcagtcagggacttgtgtagatccagatacaccacatttggcatcagttgttgctggctctgggaagaataacttttcacctttggttcaatgtactcatcatatgtgcccagtcagtatccactggcatgttaagcttaactacaaggagtactggcgtgtgaaggttactattactaattataattacaggatgaattattctgaatggaacatggttgttcaacatccaaactttgacaatctgactcaactgttcagtttcaactacaagtcattgactccttatggttcaataaatgatactgcaatgctgtggggagttaagttctataatgattttctaaaccaagctggccctaatggcaatgttcaatcagagctactcttccgaaaggataaagcaacttttacttttgataagggttgggcttttcctcgaaggatctacttcaacggtgacaactgtgtaatgccaccacctgatgcttatccgtggttaccgaatgctggtgctaggcaagaggtttccttgtttgctttagtgatagcatctttggtagccttggtattttatgcacccgcataagtttcaatctgtggtgtacagttaggcttgtaatagaaaattttcagtcagacagttttgactcatctttgatgtcaatttggtatttgaagcatatgggaggatgacatccaagattaggtcacgtgtcctatgatttgttacagaggattcacattggtggtagaatttgctattgttgtgtttgttgtaattcaatgatgtatgtatcattattataattgtaaactgtaattataataactatacagagcaagatgtcacacgaaaatatggacttgatggatcatatgtggatttgaaatgataatggtctttttacttgcagtttcctaca

SEQ ID NO: 5092 - DNA, 1868 bp, Glycine max
actagacagtcagtttctgcctcttatttttttccacactctctttctctatctgtctttcttttcctcactttctctctctactttttttttctctttatttctagtcttctctgtctatcacagatcttgaactgttctggcaagaactcagaccacttacttcttgtagcatccaaaatgggcttctctctgttaccaaaagcaactccttgcattttgttcttggctctgctgttttgtacttgcttcacttcaacagatgcttatgatccgcttgacccaaatgggaatatcacaatcaaatgggatattataagctggacccctgatggatatgtggctgttgttacgatgaacaacttccaacaatatcgtcatatcgcttcacctggctggtcaatgggatggacatgggcgaaaaaggaggtaatatggagcatgatgggagggcagaccactgaacaaggggattgttcaaaatttaagggtggtattccacattgctgtaagaaagatccgacagttgtagatttgcttcctggaacaccttacaatcaacaaattgcaaattgctgcaaaggtggggtgctcagttcatgggcgcaggatccaaccaatgcagtttcatcatttcaagtcagtgttggtagagctggaaccacaaacaaaactgtcaaagtccccaaaaacttcaccttgaaagcaccaggaccaggttatacttgtgggccagccaagattgtggcacccactaaattcattacttcagacaaaaggagagtgacccaagcactgatgacatggaatgtgacatgcacatactcacaatttctggctcagaaaactccctcttgctgtgtctcactttcatctttctataatgatacccttgttccctgcccaacatgtgcatgtggctgccaaagtaactcgtctcggtcagggacctgtgtagatccagatacaccacatttggcatcagttgttgctggctctgggaagaataacttttcacctttggttcaatgtactagacatatgtgcccagtccgtatccactggcatgttaagcttaactacaaggagtactggcgtgtgaaggttactattactaattttaattacaggatgaattattctgagtggaacatggttgttcaacatccaaactttgacaatctgactcagctgttcagtttcaactacaagtcattgactccttatggttcaataaatgatactgcaatgctatggggagttaagttctataatgattttctcaaccaagctggccctaatggcaatgttcaatcagagctactcttccgaaaggataaagcaacttttacttttgataagggttgggcttttcctcgaagggtctacttcaacggtgacaactgtgtaatgccaccacctgattcttatccgtggttacctaatgctggtgctaggcaagaggtttccttgttttctttagtgatagcatctttggtagccttggtattttatgctcacgcataaagtttcaatctgtggtacacttagccttgtaatagaaaattttcagtcagaccagttttgactcatctgtgatgtcaatttggtatttgaagcatatgggaggatgacatccaagattagatcacgtgtcccatgatttgttacaagaggatttacattggtggtagaatttgctattgttttttgtgtttgttgtaattcaatgatgtatgtatcgttattatattgtaaactgtaattataataaatatacacaacgagatgtcacgtgaaaatatggacttgatgaatcatatgtggatttgaaatgataacggtctttttacttgcggtttcctaca

SEQ ID NO: 5093 - DNA, 1898 bp, Tragopogon dubius
ctggagacagttgtctggcttagtaagctaaatagatattttttttttcaaaattaatgattaatataccaacgacatttatacaattttgtatctgcattgttttcaagaattatactttttccaacaaaatggaccaacatttgtatatgtgatgcacaagatagatagtttccaacaatcggcatagactttctcttttaataacgaatcctcctcactactttgagaacagaggaagctgctcccgctctctcgttctctcttatacacactcgctcaaggaaacgagctggaaacgcaacggatctagtaaatcttggaaagcagtaatggattactgcttcagatctctcaccagattatcaatttccactattgttctcgctatcttgctttcttctttcagtttcacttgcacagaagcctatgatgcacttgacccgaatggaaacataactataaaatgggatatcataagttggacccctgatggctatgttgctgttgttacaatgtacaacttccagcaatatcgccacatttcacctccagggtggacattaggttggacctgggctaaaaaagaggtgatctggagcatgatgggaagtcaaaccacagagcaaggagactgttcaaaattcaaaagtgcaccaccacattgctgcaagaaaactccaacagtagttgatttgttaccaggaaccccgtacaatcagcagattgcaaattgctgcaagggaggtgtaatcaactcatgggcccaagatcccaacaactacgccagctcattccaggtcagcgtgggtggggccggaaccactaacaaaaccgtcaaaccacccaaaaacttcaccttgcttgcacccggccctggctacacttgtggacccgctgttgttggtaaaccaacaaagttcattacctcagatggaagaagagtaactcaagccatgatgacatggaacgttacatgtacatattcacaatttcttgctcagaaaactcccacttgttgtgtatctctttcttccttttacaatgagacgattgtaccctgcccaacctgcacatgtggatgccaaaataacgcaactcaccctggaagttgtgtaaatccaaactcaccatatctggcttcggttgtgaatggtcctggtaagaatagcttgacacctttggttcaatgcactaaacatatgtgtcctattcgaattcactggcatgtaaagctgaattacaaggagtattggcgtgtgaaggtcacaattacaaactttaactaccgaatgaattactcccaatggaacttggttctacaacatcccaactttgacaaccttacgcaaattttcagctttaattacaaaccattgactccttattcttctataaatgatacggctatgctatggggtgttaagttctataacgactttctgaatcaagctggacctttggggaatgttcagtcagagctactcttccgaaaagacaaatcaactttcacatttgaaaagggttgggcttttcctcgaagaatctatttcaatggggataattgtgtcatgccaccgcctgatgcatacccgtatctcccaaatgccacttctcgtctaagcttctctttattcactctgttgatggcgtctttggcgtttttcttttgctctgtttaaagtttgagtagcccttgaagattttctgcacgtgcgccctttatcttaaacaagaaagtttaagtgtgtcatgtattgtgttgtaaagtagttgaagttatagtgttttttacggttgtataattaaaaccctcaaatgataatttaaagacaatattcaattttggttatgttgtgcttcttggaagattataacttatgtggtacaatgttttg

SEQ ID NO: 5094 - DNA, 3629 bp, Castanea mollissima
tatctctctctctctctccatttcctgtgcagatcttgagctaagccatagctttaaccatcacaatcagcaacaacgtttgcaccaaaacatggagtccctctccttatcagcgtctggatccattacaaagctcagtagctttgctgtactgtttgtggtggtgtttttgtgctccagttttacttcaacagaagcctacgatgcacttgatccaactggaaatatcacaatcaaatgggatgtaataagctggacaccagatggctatgttgctactgttacaatgtataacttccagcaatatcgccatattcaagcaccagggtggacattggggtggacatgggcgaagaaggaagtaatatggagcatgatggggggccaaacaacagagcaaggggattgttcaagatttaaagggaacgttccacattgctgtaagaaggatccaacggttgtggatttattgccaggaactccatacaaccagcagattgctaattgctgcaaagggggagtattaaactcatgggtccaggacccatccaatgcagcaagctcattccaggtgagtgtgggtgctgcaggaacaactaacaaaactgtcaaactacctaaaaacttcaccctgaaagcaccagggcctggatattcctgtggaccggcaaagattgtgagaccaagtaaatatttgacagcagataaaaggagggtcactcaagctttgatgacctggaatgttacttgcacatattcacaattcttggctcaaaagacacccacttgttgtgtttctctctcgtccttctataatgacacaatagtaaattgcccaacctgcacctgtggctgtcaaaacaatataacagaaccagggagttgtgtgaatcccgactctccatatttagcttcagctgtatcaggtccaggaaaatctagtaatgcacctctggtccagtgcaccagccatatgtgtcctatccgagtccattggcatgtcaaactcaattacaaggactactggagggtgaagatcacaataacgaatttcaattacagaatgaactacacgcaatggaatcttgttgtacaacatcccaactttgataatctaacccagcttttcagttttcaatacaagtccttgactccttatgctggcctgaatgacactgcaatgttatggggagtcaagttttacaatgattttctctcgcaagctggaccatatgggaatgtgcagtcagagctcctattccgcaaggaccagtcaacttttacttttgaaaagggatgggctttcccacgaaggatttattttaatggtgataactgtgtcatgccacctccagatgcctacccatggttgccaaatgctggttcccggccactttcttctctacttcattcagcatttaccatcctgtcatctttggtattcttattggcttttgcatagtgagttatgcctggggaaatttacaaatgccatctgttgctctagaacatgctagaattttccatatggtttggactgcaacaaagcttatggcagtccagttgatggggttgaatgtgttggtactacaatttctagcaatacaagaggggttcaggtgcactatggcttctcactgcaaaagtctgctctgttatctgtttttatatttattggggattagactttactagcatttttgtttagattagctggtgctttatttatatcatacacttgatgtcttgttgtagaatatccacaaaaatatgtgctgagcattgtaataagatatttggagaagaaatcacacacttgatgtattcatatctgttatgggttccaaatacatgattcttatgctacatgaagaaaaaggaacagcaaatgagcttacaatgtttgtatggtttagagtagcaagagagacaaattggcaaagcaacactttttagttacattggtgaaccatggaccaactcaaaaccatgggagactttttttctggagtttcaggtgtagtttgctcattgataagctcattcgtccaatctaaaacatccaactgaattatcacacaccaaacaatatcttctagtgctagaattgacaatgtatgtacctgctatcagtgatggccaagcctcacagccatctagctttatctatctcaaaaatatcaagaaagcatatgtacctcccatagaagtgtgatcaccacatggacagtagtaataataggaaggcagccactgctggagttgcaattggatttgcatgagcagagtttggtagaaatggataggtatcgggtggaggaagcatacattcgtcgccattgaagtaaactttccgaggaaatgcccatccttgcttgaatgtaaatgtgtccttgtctttctggagaagcacttcagattggacatttcctagaggcccagcttccattagtaggtcattgtagaatttcatgccatagaacataccagtatcatttatggattcataggggacaagaggcttgtaatcaaagctaaagacttgggtgacattgttgagattgggatgctgtgccacgagtgtccattgtgagtagttcagccggtagttaaaattagtgatggcaaccttcacacgccaatagtccttataattgagctttacatgccagtgtacacgtatggggcacatatgatgtgtgcactgtaacaatggtgtattatcctttttaggagtgtttattcctgccctacgtagtagctttgagttgctcttgatacaatttttcttgttctggcaaccacaagcacaagatgggcagggggtgattgtttgattgtagaaggatgaaaaggaaacacaacagctagggttcttagaggcaagaaactgagaataagtgcacgtcacattccatgtcataagtgcctgagttttcctccttttatcaggggtgaggaagactgtggatggcacaatctttgcagggccacaagtgtaccctggtcctggaccaagcaaagtgaagtttttgggaagcttgactgtcttattagaagtgccagctagtccaacgctcacctggaaggcagagactgcgcttaaggggtcctgtccccaagttcccaacacgccacccttgcagcaattggtgtactgttgattgtaaggaactccagggagcaagtcaacaattgtgggagtcctcttacagcagtgaggtacatttcctttgaacttggagcagtctccttgctctgtggattgagctcctatcattgtccagattacttctttcttagcccaactccatcctaaagtccagccagggttcatgattcctcgatacatttgaaagttgttcattgtcactgcagccacataaccatcaggcgtccaagacattacatcccatttgattgttatatttccagttggatccaagggatcatatgcctctgtgggagagaacatcatgacatataaaacagccaagaacatgaacttcagctctggaaagacgtagcattgccgcctttgagaacaacctctggcgtctaacatactttcctcaatcgggtctgtatggttattgaattccattgcctgaagttcaccagatcacaaa

SEQ ID NO: 5095 - DNA, 1855 bp, Citrus sinensis
ctctctctctctctctctctctctctctctctctctctgtttcatttcactttgaagcagatcttgagttttgagtcattgatcatttgttccttgggaaacctctacatcaaggaaaatggaatctttaaggggttcggtcactggatccattaccagcaagctcagtggcttcaccattctgcttctgtttttgctttcttgctccacttttacttccacagaagcctatgatgcacttgatccaaatgggaatatcacaataaaatgggatataatgtcctggactccagatggctatgttgctgttgttacgattttcaacttccaacaatatcgccatattcaagcaccaggttggacattggggtggacatgggcaaaaaaggaagtcatctggagcatgatgggaggacaaaccacagagcaaggagattgttcaaaatataaagggaacatcccacattgctgcaagaaggatccaacagttgtagatttgttgccggggactccatataaccagcagattgcaaattgttgcaaagggggagtaataagctcctgggcacaggacccaactactgcattaagctcattccagctcagtgttggtgctgcaggaacaactaacaaaactgtcagagtacccaaaaatttcacacttaaagccccagggcctggatatacttgtggacctgcaaaagttggtaaaccaactaaattcattacgtcagataagaggagagtcacacaagctatgatgacctggaatgtcacatgcacatattcacagttcttggctcaaaagacacccacctgttgtgtttctctctcttccttctacaatgaaacaatagtaagctgcccaacgtgtgcttgtggctgtcaaaacaatggaacggaatctgggagttgcataaatccaaagactccacatttggcatcagttgtgaatactccaggaaaacccaacagaccaatggttcagtgtaccagccatatgtgtcccatccgagttcattggcatgtcaagctcaattataaggagtactggcgtgtgaagatcacaatcactaattttaattacgcaatgaattactcactgtggaatctagtcgtgcaacaccccaactttgataatctcacacagcttttcagcttttattacaagtcattaactccttatgaaggcttaaatgatacagccatgctgtggggaataaagttttacaatgattttctctctgaagcaggccctaatgggaacgtgcagtcagagctgctgtttcgaaaagatgcatcaacatttacttttgagaagggttgggctttccctagaaggatttattttaatggagataactgtgtgatgccacctccagatgcctacccgtggttgccaaacgcaagttcccggcctgttatttctctacttcgttcagccataataatcttggcatcttgggtattcttattggcttatgcgtgatgaattatatctgaggccaaaaggctaacttctagaacgttcttgacgtgctatctggtctgatatgtgctgaagcatatgtaatcctgttgctcgggttcaatgtgcaagtgctgcaacttgtacacaacataaagagggttcagatgcattacagcctgctgctgtacatgcttttcatctaattatgtattgggaatcagaagtttttgccatatttttttgagttatttgttgtgttgtatgtttatctatacatacacttgataaaaaaattgtttgtaggatatcccacaagaaaagtatttgtaataaggaactccatgaagaaattatagttgatatcttgttctgttcgttattagc

SEQ ID NO: 5096 - DNA, 1720 bp, Cucumis sativus
aaatgaggtctcggcgcttcgcttccactggatccgtcgccgaccttactgtcattgccgtcttggttctctttctactttccagcttcagtttcacttcaacagaagcctatgatgcacttgatcccaacgggaacatcacaatcaagtgggatgtaatgagctggactccagatggctatgttgctgttgttacaatgtacaacttccagcaataccgccatattcaagctccaggttggacattagggtggacatgggcaaagaaagaggtcatctggagcatgatgggaagccaaacaaccgaacagggtgactgctcaagattcaaaggaaatactcctcattgctgcaagaaagatccaactgttgtggatttattgccaggaacaccttacaatcagcagattgcaaattgttgcaaaggtggagtgataaactcatgggcccaagacccagccaatgcagcaagttcatttcaagtcagtgttggttctgcaggaacaagtaacaaaactgtcaaactccctaaaaacttcacgcttaaagcaccaggacctggatatacttgtgggccagcaaagattgtgaggccaaccaaatttgtttctggagacaaaagaagagtaactcaagctttgatgacttggaacgttacatgcacctattctcaattccttgctcagaagacacctacttgttgtgtttccctctcttccttctacaatgatactatagtcaactgcccaacctgcacttgtggatgtcaaaataacacggcgggttctgggagctgtgtggatccagattctccctttttggcttcagttgtatcagctcctgataaatcgggcaacaatccacccttggtccagtgtaccagccacatgtgccctattcgtgtccattggcacgtgaagctgaattacaaggattactggagagtgaagatcacaatcacaaatttcaattaccgaatgaactacactctctggaatctggtggtgcagcatcccaattttgataatatcactaaattattcagctttaactataagtcgttgagcccatatggtgacctaaatgataccgcgatgttatggggagttaagttctacaacgatctgctcaatcaagctggtcctcttggtaatgtgcagtctgagcttctatttcaaaaagaccagaacactttcactttcgacaagggttgggctttcccaagaagagtttatttcaatggtgataactgtgtgatgccacctccagaggcctatccttacttgccaaatgccagttccagaccagctatatctctacttgtgaccatcttaatatctttggcattactgttgaattttgcacaataagtcacgcctacggggacaacaaacactattagttgctctaccactctagatttcccacgagcttttggcaatctggtcaatgatgttgaatttactgatgcttaaatcaaaggcaatatgagcttgttcctattcgtggatgggttatttaactcaacctcattcttgtgtagttttggagcgaattgtgttgtacaaatagttacattatacgttcaatcattttattgtataatgattaaaaagtatttgtcgctctcagtgtaataacttatgaaacagttcaatttttccacagaatgcctgttttctgcatagtttatttgttattaaagttgatacatgatgga

SEQ ID NO: 5097 - DNA, 1928 bp, Coffea canephora
  misc_feature (461)..(462): n is a, c, g, or t
  misc_feature (468)..(468): n is a, c, g, or t
  misc_feature (563)..(563): n is a, c, g, or t
  misc_feature (565)..(565): n is a, c, g, or t
  misc_feature (569)..(569): n is a, c, g, or t
  misc_feature (642)..(642): n is a, c, g, or t
  misc_feature (735)..(735): n is a, c, g, or t
ggtagtgttagtgctgaccaaagacagctcaccgccgcgttttctctatcgcttactcttttccctttgcttcccaaccaatattcacttcggtgccaaatctggagcggtggccaaacaagaaagcttgctgctgaaaacaaatatggattcttcctgctttagatctctatccacagcatgtgccattgtggtgctactttccctttcttgcttcagctttaccacgacagaagcttatgatgcacttgatccaaacgggaacatcacgatcaaatgggacgttataacttggacgccagatggctatgtggctgttgtcacaatgttcaacttccagcaatatcggcgcattcaggcaccaggttggactttgggatggacgtgggcaaagaaagaagtcatatggaatatggtgggagcccaaactacagagcaaggtgattgttcaagattcaaanngaacanaccacattgctgtaagaaagacccaacggtagttgacttgcttcctggaacgccttacaaccaacaaatagcaaattgctgcaagggaggtgtgntnaacncatgggttcaagatccagcaactgctgttagtgctttccaagttagtgttggttcttcaggaacaaccaacangacagttaggatgcctaaaaacttcactttaaaagcacctggacctggatatacttgtggaccagctaaagttggtaaacctacgaaattttncaccgcagatggaaggaggacaacacaggcaatgatgacatggaacgttacgtgtacatactctcagttcttggctcagaaaactccgagttgctgtgtttcactctcatcgttttataatgataccattgtaccgtgcccaacttgcacgtgtggctgccaaaataatggttctcatccagggagttgtgtagacgctgatgcgccacatctagcttcagttgtttcagaccatgggaagagcaacaacttagcacctcttatccaatgcacgagtcatatgtgcccaattcgcgtccactggcatgtgaaagtcaactacaaggaatattggcgggttaaggtcacaataacaaacttcaattacagaatgaattactcacagtggaatttagtcgtccaacaccccaactttgataacctgactcagatattcagcttcaacttcaagccattaactccttatcaagctataaatgataccgccatgctttttggaattaagttctacaatgatttcctcatggaagctggtccttatggaaatgtacagtcagaacttctattccggaaggataaatcaactttcacatttgacaagggttgggcttttcctcgaagaatctatttcaatggagataactgtgtaatgccgcctccggattcttatccgtatttacccaatggcggttctcgacgagatatctccattgttgtgcttgtgactgctcttttgtcatctattgcattcttctttacttgtctttaagaatgctgcatttctagcagtagcttaagcagcagtgtcaagcctacagctgagggagcccaattgaagagtcgacaccgcatcaaagatgtctaggaatgcatagctgccaagtgcataaatttggaaaaaccatcggtttcatcttcttcttacagcaaagattggtgaacacactgccaacctcctttttgtgacagttcgtgccatgccatgtttgttgtaccacgttgtattgtttatagttttttagttcttagtgttaataaataccactcgaggacatatatagctgatagcaaagatgattttgacttgtatttttcagctctctgctcttgttttcttgacattgtctacataatagagccattcagaagataatgcacgcttgtagtaccttaatctaattttttttcgacac

SEQ ID NO: 5098 - DNA, 1714 bp, Lotus japonicus
gaaaaatgggcttctctttgtcttcaacagcagcaagtacttgcattttgttcttgtttctactctcttgcacttgcttcacttcaacagatgcttatgatccgcttgatcctaatgggaatatcacaatcaaatgggatattacaacctggacatcagatggttatgttgcggttgttacaatgaacaacttccaacaatatcgtcatatcactgcacctggctggtcattaggatggacatgggccaaaaaggaggtaatatggagcatggtgggggggcagaccactgaacaaggggattgttcaaaatttaagggatcgattccacattgctgtaaaaaggaccccacagtagtagatttacttcccggaacaccttacaatatgcaattctcaaattgctgcaaaggtggggtgcttagttcatgggcacaagatccaaccaatgcagtagcatcatttcaagtcagtgttggtagagctggaacaacaaataaaactgtcaaagtccccaaaaacttcactttgaaagcaccaggaccaggttatacatgtgggccagcaaaaattgtgacacccactaaattcattcaaccagataaaaggagggtgactcaagcactcatgacatggaatgtgacatgcacgtattcacaatttctagctcagaaaactcccacttgctgtgtctccctctcatctttttataatgataccatcgtaccctgcccaacatgtgcttgtggttgccagagtaactcatctcgatcagggagctgtatagaggcagatacaccacatttagcatcggttgttgccggttctggaaagaatacacctttggttcaatgcactaggcatatgtgccccgtccgaatacattggcatgttaaggttaactacaaagagtactggcgtgtgaaggtcactattactaattttaattacaaaatgaactattctgagtggaacttggttgctcaacacccgaacttcgacaatctaactcagttattcagtttcaactacaagtcattaactccttatggttcaataaatgatacagcattgctttggggagtgaagttctataatgattttctcaatgaagctggccctagtggtaatgttcagtcagagatactcttccgaaaggacaaatcaacttttacttttgagaagggctgggcttttcctcggaggatctacttcaatggtgacaactgtgttatgccctcgcccgatgcttatccatggttacctaatgctggttctcggcaagaggtttccttgtttgctttagtgatggcctctttggtagctgtggtattatgtttcgcacaggcataaagtttcaacctgtgccacactcagccttgtgatagaaaattttctgccagaccagttttgactcatttgtgacttgtgatgtcaatttgatatttgaagcgagtgagaggatgacatccggggccaatacaggattaggtcacgtgccccatgatttgtgttaccaaggattcagcatgtttgtggtagactttgctactgtattattatttgtgtctgttgtacttgtaatgcagtaatgtgtgaatccttatcatagtttaactgtaattctaatgaatatatatatatatagcaacgtatcacattaaaatcacttaatcatatgtgcatttgaaatgttaatggctttctaaatgctc

SEQ ID NO: 5099 - DNA, 1818 bp, Cichorium intybus
acaatttgttatagaaattatgtatgctttaatgcttgttccaagaaaaggacatcgaatatgtcttgcacaagatagatagttttcaccaaatgaatctattttaataagaggtgggtaattggacatggactttctattttaataacgaatcgtcacttgtttgcgagagaaaggccgctctactctctcctctctttatacacactcgctcaagaaaacgggctcgaaacggaaacggatctagtagatctttgaaagcagtaatggactgcttcagatctctcgccagattatcaatttccaccgttgttcttgccatcttgctttcctcattcagtttcacttgcacagaagcatatgatgcacttgacccaaatggaaacatcacaatcaagtgggacattattagttggacccctgatggctatgtcgctgttgttacaatgtataacttccaacaatatcgccacatttcaccgccagggtggaccttaggttggacatgggctaaaaaggaggtgatatggagcatgatggggagtcaaaccaccgagcaaggagactgttcaagatacaaaagtgcaccaccacattgctgcaagaaaactccaaccgttgttgatttattaccaggaaccccttacaatcaacaaatcgcaaattgctgtaagggaggtgtcatcaactcgtgggcccaagatcccaacaattacgccagctcattccaggtcagcgtgggtgcagccggaaccactaacaaaaccgtcaaaccacccaagaactttaccttgcttgcacctggccccggttatacgtgtgggcccgctgttgttggtaaacccacaaagttcattactgcagatggaagaagagtaactcaagctatgatgacatggaacgttacatgtacatattcacaatttcttgctcaaaaaactcccacttgctgcgtatctctctcgtcattctacaatgacacaatcgtcccctgcccaacctgcacatgtggatgccaaaataacgcgactcaccctggaagttgtgtaaacccaaactcactatatctagcttcagtggttaatgggcccggtaaaaacagctaacacctctagttcaatgcacaaaacatatgtgcccaattcgagttcactggcacgtgaaacttaattacaaggattactggcgcgtgaaggtcaccattacaaatttcaactacagaatgaattactctcaatggaatatggtagtccaacaccccaatttcgataaccttacgcaaatttttagtttcaattacaaaccgttgactccgtattcttctataaatgatactgctatgctatggggtgttaagttctataatgattttctgaatcaagctggaccattggggaatgtacagtcagagttactcttccgtaaagataaatcgactttcacatttgaaaagggttgggcttttcctagaagaatctatttcaatggtgataattgtgtgatgccaccacctgatgcatacccgtatctcccaaatgccagctcacgtctaagcttctcgttaattactgtattgatggggtctttggtctttttgtttgcttttgtttaaggtttgaatagctattgaggatttttcccacgtgcgtgcttcatcttgaacgagaaagtataagtgtgtaatgtgggacgtgtttgtcggtgttgttttacatgtattgtgttgtagagtagttgaagttatagtgttgtttacagttgtataattaaaacccacaagccataatttaaaacaaatattcatttttggtccaaaaa

SEQ ID NO: 5100 - DNA, 1103 bp, Helianthus annuus
  misc_feature (257)..(257): n is a, c, g, or t
  misc_feature (465)..(465): n is a, c, g, or t
  misc_feature (870)..(870): n is a, c, g, or t
aaatataaaagtgcacaaccgcattgctgctagaaaactccaaccatcgtagacttattacccggaaccccttacaatcagcagatcgctaattgctgcaagggcggtgtcatcaactcgtgggcccaagatcccaacaactacgccagctctttccaggtcagcgttggtgcagccggaaccaccaacaaaactgtcaagccgcccaaaaacttcaccttgcttgcacccggccctggctatacatgtggacccgntatagttggtaaaccaacgaagtttattaccgcagatggaagaagagtaactcaagctatgatgacatggaatgttacgtgtacatattcacaatttttggctcagaaaacgcctacttgttgtgtatctctctcttctttctacaacgagacgatcgtaccctgccctacatgcacatgcggatgccaaaataacgctactcacccnggtagttgtgtaaacccgaactcgccatatttagcgtcagttgttaacggtcctggtaaaaacagctttacacccctggttcaatgcacgaaacatatgtgcccgattcgggttcactggcatgtgaagcttaattacaaggaatattggcgtgtgaaggtcaccattacaaatttcaactaccggatgaattactcacagtggaatttagtcgttcaacaccccaacttcgacaatcttactcaaatattcagttttaattacaaaccgttgactccttattcttctataaatgatactgctatgctatggggagttaaattttataacgattttctgaaccaagctggaccgttggggaacgtacagtcagagttgttgtttcgcaaagataaatcgactttnacattcgaaaagggttgggcgtttcctcgaagaatttatttcaacggtgataactgtgtgatgccgccacctgatgcatacccgtatctcccgaatgctggttcgcgtttaagcttctctttacttgcattattgatggcgtgttcggctgttttctttgtttttgtttgatgtttgagcagcagcagaccttgaagatttgtttgatatgtaggtgaattcacctgttggtc

SEQ ID NO: 5101 - DNA, 1582 bp, Helianthus annuus
  misc_feature (43)..(43): n is a, c, g, or t
  misc_feature (1541)..(1541): n is a, c, g, or t
cgggggctcaatcctctctctctctctctctctctctctctcncacacacacacacactcaaactagtaaatcttggaagcaagtaatggattactgcttcatcagatctctcactcgattgtcagtttcaaccattgttctcgccatcttgctttcttcattgagtttcacttgcacagaagcctatgatgcacttgacccaaatggcaacattacaatcaagtgggatattattagttggacccctgatggctatgttgccgttgttacgatgtacaacttccaacagtaccgtcacatttcacctccagggtggaccttgggttggacctgggctaagaaagaggtaatatggtccatgatgggtagtcaaaccaccgagcaaggagactgttcaaaatacaaaagtgcacaaccacattgctgcaagaaaaccccaacggttgtcgatctattacccgggaccccttacaatcagcaaattgcaaattgctgtaaaggaggtgttattaactcgtgggcccaagatcccaacaattatgccagctcattccaggttagcgttggtgcagccggaaccaccaataaaacggtcaaaccacccaagaacttcaccttgcttgcaccgggccctggctacacctgtggaccggctgtagttggtaaaccaacgaagttcattactccagacggaagaagagtaacccaagctatgatgacatggaacgttacatgtacatattcacaatttttggctcagaaaactcccacttgctgtgtatctttatcttctttctacaatgagacaatcgtaccctgccctacgtgcacatgtggatgccaaaataatattactcaccctggaagttgtgtagacgcacactcaccgtatctagcttcggtcgtgaacggccccggtaaaaacaccctgacacctctggttcaatgcacaaaacacatgtgtccgattcgagttcactggcacgtgaagcttaattacaaggaatattggcgtgtgaaggtcaccattacaaattttaactacaggatgaattactcccagtggaatttagtcgttcaacaccccaactttgataaccttactcaaattttcagtttcaattacaaaccgttgactccttattcttctataaatgatactgctatgctatggggggttaagttttataacgattttctgaatcaagctggaccgttggggaatgtgcagtcggagttgctatttcgtaaagataaatcgactttcacgtttgaaaagggttgggcttttccgcgaagaatatattttaacggtgataactgtgtgatgccaccgcctgatgcatacccgtatcttccaaacgccagctctcgtttaaggttctctttgtttactataatgtcaacgtgtttggcggttttctttgtgtttgtttgaaaagcccttgaagattttgcacattcatcttcaaaatctggtcacactgatgtttcaaatgtttttatcttgtagagtagttgaagttgtagtgttgtttanagttacacttatataaattaaacttacatttgataagttaa

SEQ ID NO: 5102 - DNA, 1723 bp, Artemisia annua
ggagagaaagacacactcacacatctctcaatctttctctcacatacacacaataaaaaacacacacacttataacacactgtcggatcttggaaaccttagaagcaagtaatcatggattactgcttcagatctttaacaagattgtcactttccaccattgttgttgctatattgctttcttcattcagttttacttccacagaagcgtatgatgcacttgacccaaatggaaacatcacaatcaagtgggatatcattagttggacccctgatggctacgttgcagttgttacaatgtataatttccagcaataccgccatgtctcgcctcccggatggaccttaggttggacgtgggctaagaaagaagtgatatggagcatgatgggggctcaaaccacggagcaaggagactgttctagatataagagtgcaccaccacattgctgtaagaagaccccaacggttgttgatttattacccggaacaccttacaatcagcagattgcaaattgctgtaagggaggtgttatcaactcatgggcccaaagtcccgacaattatgctagctcatttcaagttagtgtgggtgcagccggaaccaccaacaaaacggtcaagccacccaagaacttcaccttgcttgcacctggccctggctatacatgtggacctggtgtcgttggtaaaccaacaaagttcattactgcagatggaagaagagtaactcaagctatgatgacatggaacgttacgtgtacatattcacagtttttggctcagaaaacgcccacttgctgtgtatcgctctcttcgttttacaatgagacgattgtaccctgcccaacatgcacctgtggatgccaaaataacatcactcaccctggaagttgtgtaaacccaaattcgccatatctagcttccgttgttaatggtcctggtaaaaacagcttgactcccttggttcaatgcacgaaacatatgtgccctattcgagttcactggcatgtgaagctgaattacaaggaatactggcgtgtgaaggtcaccattacaaactttaactacaggatgaattactctcagtggaacttagtcgctcaacacccaaacttcgacaaccttactcaaattttcagtttcaactacaaaccactgactccttattcttccataaatgatactgctatgctatggggagttaagttctacaacgattttctaaatcaagctggaccattagggaacgttcagtcagagctactcttccgtaaagacaaatcaacattcacatttgaaaagggttgggcgtttcctagaagaatctatttcaatggggacaattgtgtgatgccaccacctgatgcatacccatatctcccaaacgccagttctcgtctaagcttctctttactgactctactggcaacgtcgttagcctttttctttgcttttgtttgatgttggagcagcccttaaagatttttcacacgtgggtgtctacacgtttcacaagtaagtttaagtgtgtaatgcgggtgaaatcattttttcgtcactgtttatttattgtattttcttgtagagtagttgaagtcatagtgttgtttacagttgtataatttaaacctacacattataagttaaatccgataaattcgatttggttctgttcatacaaaaaaaaaaaaaaacatgttgatctagaattgtcgagcgt

SEQ ID NO: 5103 - DNA, 1631 bp, Artemisia annua
  misc_feature (686)..(686): n is a, c, g, or t
  misc_feature (1182)..(1182): n is a, c, g, or t
cacacacacactaaaaaacacacacactgataacacactgtcggatcttggaaaccttagaagcaagtaatcatggattactgcttcagatctttaacaagattgtcactttccaccattgttgtagctatattgctttcttcattcagttttacttccacagaagcgtatgatgcacttgacccaaatggaaacatcacaatcaagtgggatatcattagttggacccctgatggctacgttgcagttgttacaatgtataatttccagcaataccgccatgtctcgcctcccggatggaccttaggttggacgtgggctaagaaagaagtgatatggagcatgatgggggctcaaaccacggagcaaggagactgttctagatataagagtgcaccaccgcattgctgtaagaagaccccaacggttgttgatttattacccggaacaccttacaatcagcagattgcaaattgctgtaagggaggtgttatcaactcatgggcccaaagtcccgacaattatgctagctcatttcaagttagtgtgggtgcagccggaaccaccaacaaaacggtcaagccacccaagaacttcaccttgcttgcacctggccctggctatacatgtggacctggtgtcgttggtaaaccacaaagttcattactgcagatggaagaagagtnactcaagctatgatgacatggaacgttacgtgtacatattcacagtttttggctcagaaaacgcccacttgctgtgtatcgctctcttcgttttacaatgagacgattgtaccctgcccaacatgcacctgtggatgccaaaataacatcactcaccctggaagttgtgtaaacccaaattcgccatatctagcttctgttgttaatggtcctggtaaaaacagcttgactcccttggttcaatgcacgaaacatatgtgccctattcgagttcactggcatgtgaagctgaattacaaggaatactggcgtgtgaaggtcaccattacaaactttaactacaggatgaattactctcagtggaacttagtcgctcaacacccaaacttcgacaaccttactcaaattttcagtttcaactacaaaccactgactccttattcttccataaatgatactgctatgctatggggagttaagttctacaacgattttntaaatcaagctggaccattagggaacgttcagtcagagctactcttccgtaaagacaaatcaacattcacatttgaaaagggttgggcgtttcctagaagaatctatttcaatggggacaattgtgtgatgccaccacctgatgcatacccatatctcccaaacgccagttttcgtttaagcttctctttactgactctactggcaacgtcggtagcctttttctttgcttttgtttgatgttggagcagcccttaaagatttttcacacgtgggtgtctacacgtttcacaagtaagtttaagtgtgtaatgcgggtgaaatcattttttcgtcactgtttatttattgtattttcttgtagagtagttgaagtcatagtgttgtttacagttgtataatttaaacctacacattataagttaaatccgataaattcgattttggttc

SEQ ID NO: 5104 - DNA, 963 bp, Solanum tuberosum
tacaaagcttgcaacttatcaatcaaaaatggcgagagagccgctattaaataagagagaagagaaacactactacgaaaattgccccggttgtaaaatggatcttcacaaagcgggtcaaacgggtttgcccattaaggagcttttcactatatgggttgtcgtgcttggaacagcacttccaatatcatctctctttccatttatttatttcatggtaagggactttcacattgcaaagagagaggaagatattggttcctatgcaggttatgtaggttctgcatatatgtttggaagaactttaacatctgccttttggggtgttgtggctgaccgatatggacgaaaaccagttataattttcggcacttctatagtggtcgttttcaatactctttttggtcttagtaccaacttttggatggctgtcataacaagatttcttcttggtagtttaaatggtttgcttgcaccaataaaggcgtatgctgctgaaatttttcgcgaagaatatcaagcactaggaatgtcaacgattagtactgcatggggcattggtttgattattggcccagctttaggaggcttccttgctcagcctgcagagaaatatccagacttgttctcaaaggattcattatttgggagattttccctattttcttgcccttgcctatgcatatcagtgttcgccttggttgtggctgttggttcattttggattccggaaacattacataaccatgattcagaaaggccgtgtcaagattctttacaagggctcctggaggctgccatcagatacaaaagacggaaatgaatcagacccaaaagaaaatctttttaagaacttgccgttaatgttcatctatcatattatactgcgtcttctctcttcatgatatggcttactcagagattttctcattatgggctgtgagccccagaaagtttggtggc

SEQ ID NO: 5105 - DNA, 1248 bp, Capsicum annuum
ggcacgaggttttttttttttataaataaaaattcccaatttttctcttctccaaattcccctagccaaaaaaattctctattacaaatttagccattttcttgatctaatggcatcaattgcacaaaatggacatgttaatggagatgttgtagctattgatttttgcaagaaatcaattcatgatccattgaattgggaaatggctgctgaatcattaaaagggagtcatttggatgaagtgaaaaaaatggtggatgaatttagaaagccaattgttaaacttggaggtgaaactttgacagttgcacaagttgcatccattgcaaatgctgataataaaacttgtggggctaaagtggagctttctgaacgtgcaagggctggtgtgaaagctagtagtgattgggttatggatagtatgtgtaaaggtacagatagttatggtgttactactggttttggtgcaacatcacatagaagaaccaagaatggtggtgctttacaaaaagaacttattaggttcttgaatgctggagtttttggaaatggaacagaaagttgtcacacattgccacattcagcaacaagggcagctatgcttgttaggatcaacactttgcttcaagggtactctggcattagatttgaaatcttggaagcaattaccaagttgatcaacagcaacatcactccgtgtttgcccctccgtggcacgatcactgcctcgggtgatcttgtcccgttatcctacattgctggtttgcttactggcaggcctaattccaaggctgttggtcccaatggtgagaaacttaatgctgaggaagcgttccgcgtggctggtgttagtggtggatttttcgagttgcagccgaaggaaggacttgcccttgtgaatggtacagcagttggttctggtatggcgtcgatggtcctgtttgagtccaacattcttgctgttatgtctgaagttttgtcagcgattttcgctgaagtgatgaatggaaagcccgaattcactgaccatctgacacacaagttgaagcatcaccctggtcagattgaggctgctgctattatggaacacattttggatggcagctcttatgtcaaggcagctcaaaagctccatgaaatggatcctctccagaaaccaaagcaagatcgttatgctctccgaacatctccacaatggctaggccctcaaattgaagtcattcgtgctgcaactaagatgatcgagag

SEQ ID NO: 5106 - DNA, 1451 bp, Solanum phureja
aaagttttataagttcacaacattccttttttatataaataaaactctcattttctcttcactaaaatttatccattacaaatctaaccattttcttgatccaatggcacaaaatggacatattaatggagaagttgtagccatggaattatgcaagaaatcaattaatgttcatgatccattgaattgggaaatggctgctgattctttaagagggagtcatttggatgaagtaaaaaagatggtggatgaatttagaaagccaattgtgaaacttgggggtgaaactttgacagttgcacaagttgcatccattgcaaatgctgataacaaaagtaatggggtcaaagtggaactttctgaaagttcaagggctggtgtgaaagctagtagtgattgggtgatggatagtatgagcaaaggtacagatagttatggtgttactactggatttggtgcaacatctcatagaagaacaaaaaatggtggtgcccttcaaaaggaacttattaggttcttgaatgccggagtttttgggaatggaacagaatcatctcacactttgccacattcagcaacaagggcagctatgcttgttaggatcaacactctgcttcaaggctactctggcattagatttgaaatcttggaagcaattactaagttgatcaatagcaacattaccccgtgtttgcccctccgtggaacggtcactgcctcaggtgatcttgtccctctgtcctacattgctggtttgctcactggcaggcctaattccaaggctgttggacccaatggtgagaaacttgacgctgatgaagcgttccgtgtggctggtgttagtggtggatttttcgagttgcagcctaaggaaggacttgcacttgtgaatggtacagcagttggttctggtatggcatcaattgtcctgtatgactccaacattcttgctgttatgtctgaagttttatcagcgatttttgctgaagtgatgaacggaaagcccgaattcactgactatttgacacacaagttgaagcatcaccctggtcagattgaggctgctgctattatggaacacattttggatggcagctcttatgtcaaggcagctcagaagctccatgaaatggatcctcttcaaaaaccaaagcaagatcgttatgctctccgaacatctccacaatggcttggccctcaaattgaagtcatccgtgctgcaactaagatgatcgagagggagattaactcagtgaacgacaatccattgatcgacgtttcaagaaacaaggccttacatggtggcaacttccaaggcacccctattggtgtctccatggataatacaagattggcccttgcgtcaattggtaaattgatgtttgcccaattctcagagcttgtcaacgactattacaacaatgggttgccatctaatctcacagcaggaa

SEQ ID NO: 5107 - DNA, 911 bp, Solanum tuberosum
ttttttctcttctccaaattctcctaagtaaaatttctccattacaattctagccattttcttgatctaatggcatcaattgcacaaaatggacatgttaatggagaagttgtagccatggaattatgcaagaaatcaattaatgttgatgatccattaaattgggaaatggctgctgattctttaagagggagtcatttggatgaagtgaaaaagatggtggatgaatttagaaagccaattgtgaaacttgggggtgaaactttgacagttgcacaagttgcatccattgcaaatgctgataacaaaagtaatggggtcaaagtggaactttctgaaagtgcaagggctggtgtgaaagctagtagtgattgggttatggatagtatgagtaaaggtacagatagttatggtgttactactggatttggtgcaacatctcatagaagaaccaaaaatggtggtgcccttcaaaaggaacttattaggttcttgaatgctggagtttttgggaatggaacagaatcatctcacacattgccacattcagcaacaagggcagctatgcttgttaggatcaatactctgcttcaaggctactctggcattagatttgaaatcttggaagcaattactaagttgatcaacagcaacatcaccccgtgtttgcccctccgtggcacgatcactgcctcgggtgatcttgtccctctgtcctacattgctggtttgctcactggcaggcctaactccaaggctgttggaccaaatggagagaaacttaatgctgaggaagcattccgcgtggctggtgttactggtggatttttcgagttgcagcctaaggaaggacttgcacttgtgaatggtacagcagttggttctggtatggcatcaatggtcctgtttga

SEQ ID NO: 5108 - DNA, 1160 bp, Petunia hybrida
aaaaaaagaaacaataacgtcatagacatctttctagtagtaatatttatataatcccatttttcttctctaaatctcctcacttctccatatacatttctaccacccttaataaacattttcttgatccaatggcaccaaccacacaaaatggtcatgctaatggtcatgttaatggtcatgaagacatggagttgtgcaagacatcagctgatccattgaactgggaaatggcagctgaatctttaaaagggagtcatttagatgaagtgaaaaaaatggttaatgaatttaggaaaccaatcgtgaaacttggtggtgaaacattaactgttgcacaagtggctgctattgctagtattgctagagaaaatgatattaaagttgaactttctgaagaggctagagctggtgttaaagccagtagtgattgggttatggatagcatgggtaaaggaactgatagttatggtgttactactggttttggtgctacatcacatagaagaaccaagaatggtggtgctcttcaaaaggaacttattaggttcttgaatgctggagtatttggcaatggaacagaatcttctcacacattgccacattcagcaacaagggcagcaatggttgttaggatcaacactctccttcaaggttactctggcataagatttgaaatcttggaagcaattaccaagctgattaacagcaacattactccatgtttgccactccgtggcacgatcactgcctctggtgatcttgtcccattgtcctacattgctggtttgctaactggcaggcctaattccaaagctgttggaccaaatggtgagaaacttaatgctgaagaagcgtttcgcgttgctggtgttactggtggatttttcgagttgcagccaaaggaaggccttgcacttgtgaatggtactgcagttggttctggtatggcatcaatggtcttatttgagtctaacgttcttgcagttatgtctgaagttttatcagcaatttttgctgaagtgatgaacggtaagccagaatttactgaccatttgacacacaagttgaagcatcaccctggtcaaattgaggctgctgctattatggaacatattttagatggcagcgcttatgttacggcagctcacaagcttctg

SEQ ID NO: 5109 - DNA, 1074 bp, Artemisia annua
gttttaaaaacaaaaaacaaaaaaaacattgataaccagctgactgtctttttgtgtgtgatctaagcaagattatcgaatacttactaaaaatggaaaatggtcatgcaaatggggtggcaaaggagttgtgcattaaggatccattaaactggggtgtagcagctgaggctttgacagggagtcatttagatgaggttaagaagatggttgctgagtttaggaaacctgttgtgaaactaggtggtgaaacactgacagtttcccaggttgctgggattgcggctagtgaaaacactggtgtaaaggttgagttgtctgaaagtgctagagctggagttaaagctagtagtgattgggttatggagagtatggggaaagggactgatagttatggtgttactactggttttggcgctacttctcacaggagaaccaagaatggtggtgctcttcagaaggaactcattagatttttgaacgccgggatctttggcaatggcactgaatcgaaccacacccttccacattcagccacaagagccgcaatgctcgtaagaatcaacacgttgctccagggctactctggcattcgtttcgagatcttggaagcaatcaccaagtttcttaacactaatgtcaccccttgtttgcctcttcgtggtaccatcaccgcatctggtgatcttgtcccattgtcctacattgctggacttctcactggtcgacccaactccaaagctgtcggtcctgatggacaaatccttaatgccgaaaaggctttcagcctagctggtgttgatggagggttctttgagctacagcctaaagaaggtcttgcacttgtgaatggtaccgctgttggatcaggaatggcctcaatggttctttttgaggctaatgtacttgcattgctatccgaagtcttgtctgctatttttgctgaggtcatgcaaggaaagcccgagtttactgaccacttgacacacaaattgaagcatcacccaggccagatcgaggctgcagccattatggaatacatattagatggaagtgattatgtcaaggccgcgt

SEQ ID NO: 5110 - DNA, 2547 bp, Artemisia annua
cgtgtgaccattggttaaggtttccaccgacatttttttttaaaagatttggaagggatctcgaaatgggtatgatttaaagattggaaattggaagtgggtttacaagatgagcaaatgggtatgcataaaactggaaaaagattcgatttttttttatggaaatgggattgtgtgatcaagaaaagcaaatgggtgtgaattaaattgaaaagggtatgtgaaaacaattgaaataatgtaatgtaatgtaatggtggtagtgtacctgaagaagaagaaaatggtagatctagatttagagggaaagatgttgttgttgattgatgatgacccccgttggagtactgcgttgataccactgttattgttatttcacacacaaagagtgtgagtctagtgtgtgaactaataacaagaacaaagattgttctttgtcttataattgtgttctttgtttgctcattgtctttgcaccaaataaataaataaataaacaacaatggaaaacggtaccggggtctatgctaatggtaatggtaatggtcacgttaatgatttatgcattaaggatccattaaactggggtgttgctgctgaagcattgacagggagtcatttagatgaggttaagaaaatggttaaggagtttagaaaccctattgttaagataggtggggagacattaactgtctcccaagttgcggggatcgcagcatctgacaacgccagtgttaaagtggagttgtcagagtctgcgagagctggagttaaagctagtagtgattgggttatggaaagtatgggtaaagggactgatagctatggtgttactactggatttggtgctacttctcataggagaaccaagaatggtggtgctcttcaaaaggaactcattagatttttgaacgctggaattttcggcaatgggaccgaagcaagtcacactctcccacattcagcaacacgagcggcaatgcttgttagaattaacactctcctccagggttactcaggcatccgttttgagatcttggaagcaatcaccaagttcctcaacaacaatgttactccttgtttaccacttcgtgggaccatcaccgcttctggtgacctggtcccattgtcctacattgcaggacttcaggcccaactcaaaagcagttggacccactggtgaaatcctgactgctgaaaaggcatttgcccaagctggtgtcgagggagggttctttgaattgcagccaaaagaaggtctggcactcgttaatggaaccgcagttggttcaggaatggcttccatggttctctttgaagctaacgtacttgcattgctgtccgaagtcttatcagctatttttgccgaagtcatgcaaggaaagcccgagtttactgaccacttgacacataagttgaagcatcaccctggtcaaattgaggctgcagccattatggagtacattttggacgggagtgactatgtgaaagccgctcaaaaggtgcacgaaatggacccgttacagaaacccaaacaagaccgatatgctctccgtacctcaccccaatggttgggtccacaaattgaagtcattcggtctgctactaaaatgattgaaagggaaatcaactcagttaacgacaacccattgattgatgtttcacgaaacaaggctttacatggtggtaacttccaaggaaccccgatcggtgtttccatggataacactcgcttagctattgctgcaatcgggaaactcatgttcgcgcaattctctgagctagtgaatgacttctacaacaatggtttgccttcaaatctttctggtggacgtaacccaagtttggattatggattcaaaggtggtgaaatcgccatgttctgagctccaatttcttgccaaccccgttacaaaccatgttcaaagcgctgaacaacacaaccaagacgttaactctttgggtttgatctcagctcgtaaaacagctgaagcagttgatatcttgaagcttatgtcatcaacttacttagttgctctatgccaatcagtcgacttgaggcatttggaagagaacatgaagtcaacagtcaagaacaccgtaagccaagtagccaaaaaggtcctaaccacaggtgtcaacggcgagcttcacccatcaagattctgcgaaaaagacttgcttcgtgtagttgatcgcgagtatgtttttgcctacattgacgacccttgccttgccacatacccattgatgcaaaagctcagacaagtcctagtcgaccacgctttaaccaatggtgaaaccgagaagaacacaaacacatccatcttccaaaagattgctacttttgaagaagagataaaggccattttacctaaagaagttgaagctgtgagagtcgcatttgagaatggtacattggctatccccaacaggatcaaggcttgtagatcgtacccattatatagattcgtgagggaggagattgatggagtttacttgacgggcgagaaggtgacatcacctggtgaagagttcgacaaggtg

SEQ ID NO: 5111 - DNA, 979 bp, Lactuca sativa
cattgctagccattcaatcctttcatcctccacctatatatacattatacacagacactcacacactcaagaacactaacagacactatacaagaggtagctagatcgatccaaagtacagttgcattaatggagaacgggcatgtaaatggagtggcgaccgagttctgcattaaagatcccttgaactggggagttgcagcggaggcattgaaggggagccaccttgatgaggtgaagagaatggtgaaggagttcaggaagcctgttgtgaagctcggaggagagacgttgacggtgtctcaggtggcgggtattgctgctgccggtgatagctccactgtgaaggtggagctgtcggagactgctagggctggagtgaaagcgagtagtgattgggtgatggagagcatgaacaaagggactgatagttatggagtcaccaccgggtttggagccacctctcaccggaggaccaagcaaggcggtgctcttcagaaggagctcattagattcttaaacgccggaatctttggcaacggaacggaatcaagccacacccttccgcattcagcaaccagagccgccatgctcgtaagaatcaacaccctcctccagggttactccggtatccgttttgagatattggaagccataactaagttcctcaacaccaacgtcaccccttgcttacccctccgaggcacaatcaccgcctccggcgaccttgtcccattgtcttacatcgccggacttctcaccggccgccccaactccaaagcagtcggccccaacggtgaaatcctcaacgccgaaaaagccttcaacctcgccggagttactggtgggttctttgagctacaacctaaagaaggtctagcacttgttaatggcaccgccgtcggatctggcatggcttccatggtcctcttcgaagctaatgtccttgcattgttgtcggaagtttgtcggctatctt

SEQ ID NO: 5112 - DNA, 1213 bp, Papaver somniferum
  misc_feature (1046)..(1046): n is a, c, g, or t
gttcatgttgtcgtcggaactcctggacgtgtgtttgacatgttgcgaagacaagcacttcgtgctgattgcattaagatgtttgttctggatgaagctgatgagatgctttcacgtggtttcaaggaccagatctatgacattttccagctccttccttctaaagtccaggttggagtgttctctgccaccatgccacctgaggcccttgagataaccagaaagttcatggacaaacctgttaggattctggttaagcgtgatgaactcacccttgagggtattaagcagttttatgttaatgttgagaaagaagaatggaagcttgagacactctgtgatctctatgaaactctggccatcacccagagtgttatcttcgttaacacccgacgtaaggttgactggcttactgacaagatgaggagccgtgaccataccgtctctgcaacccatggagacatggaccaaaataccagagatattatcatgcgtgaattccgatctgggtcctcacgtgtcctcatcactactgatcttcttgctcgtggtattgatgttcagcaagtttcattggtcatcaactatgatcttcctactcaaccagaaaattaccttcatcgtattggacgtagtggtcgatttggaaggaagggtgttgctattaactttgtgactaaagatgatgagaggatgctttttgatatccagaagttctataacgtggtcattgaggaacttccatcgaacgtcgcagatctcctgtaattgaattgatgatgatgaagacgtgtttagttccttggcttttattgacaatgatggtggtgaagggaacttttatctatttggtaagaagtggtatttaatgtttttttctttataggttatctactttttttgtcgtaatctaggatatatggtcgaactgctgactatctcgtgatttgggtactgcacatttgctcatggaaacgggcatgccccgatattttggtgtgggtgtgttggcatcattttgcaattttgtgcagtagtttgtatcntagtgtctgtaaaactacccaatgagtagtttggattgggtttcactctgtttgtttggggttatttgtgtctttttttttgtctctttttatgattaagagagaatactatgtagaatgaaaaccatgatttgttaatttatgtcagatccctctgactattacct

SEQ ID NO: 5113 - DNA, 1130 bp, Brassica napus
cagatcgagaaggtcatgagagccctcggcgactacctcggcgtcaaggtccacgcctgcgtcggcgggaccagcgtccgcgaggaccagcgcatcctccaggccggcgtccacgtcgtcgtcggcaccccggggcgcgtgttcgacatgctgaagcgccagtccctccgcgccgaccacatcaagatgtttgtccttgatgaggccgacgagatgctctcacgcgggttcaaggaccagatctacgacatcttccagctcctccccccgaagatccaggtgggagtgttctctgccaccatgccgccggaggctctcgagatcacgaggaagttcatgagcaagccggtgaggattcttgtgaagcgcgacgagcttactttagaaggtatcaagcagttttacgtcaacgttgagaaggaagactggaagctcgagacgctctgcgacctctacgagacgctggccatcactcagagcgtcatctttgtcaacactaggcggaaggttgactggctcactgataaaatgagggggcgtgaccatacagtctctgcgactcacggagacatggaccagaacactagagacattatcatgagagagttcaggtctggctcatctcgtgtgttgatcacgactgatctcttggctcgtggtatcgatgttcagcaggtgtctctggtgatcaactacgatctgccgactcagcctgagaactaccttcaccgtattggaagaagtgggaggtttgggaggaaaggagtggcgatcaactttgtgaccaaggatgatgagaggatgctgtttgatattcagaagttttacaacgtggttgttgaggagctgccttcgaacgttgctgatctgctgtgaaggggagaaaaagtttggtattgtctaccggagaagaaaggttttttacttgtttgttaaggcacgcacacctctttgatctgattttgatctcatcttcatcatctctctttccataagcggtttgtttacgttttctcttgtgtgtttctctaagaacatatctctcgtatttttaaaatcatatggagtatttgtttctggtttgctgtcttttctcatcttcttttgtatcaaatcttgtcgtgaaagtt

SEQ ID NO: 5114 - DNA, 636 bp, Solanum melongena
aagagtggaagcttgaaacactttgtgatctttacgagactttggccatcacccagagtgtcatctttgtcaacactaggcgaaaggttgattggctcactgacaaaatgcgtagccgtgatcacacagtatctgcaactcatggagacatggatcagaatacaagagatatcattatgagggagttccgatctggctcatctcgtgtgcttatcacaaccgatctccttgctcgtggtattgatgtacagcaagtctcccttgttattaactacgatctgccaactcaaccagaaaactacctgcatcgtattggtcgtagtggacgatttggaaggaagggtgttgctatcaactttgtcaccagggatgatgaaaggatgcttttcgacattcaaaagttctataacgtcgtaattgaggagctcccagccaatgttgctgatctcctttgaggcaattttggctctgtgagggaactgttccttagtagtctaatatatttgttccagagtgaactgcaaattttgtctggtttatcatttgttttttggaagtgtccaagtaacttctaatttggtggtggtttgaattgcttatttgaactatttttctatggactaggctttcagttgc

SEQ ID NO: 5115 - DNA, 754 bp, Solanum melongena
aacaccaggcgcaaggttgattggctcactgataagatgcgtagccgtgatcatacagtatctgcaactcatggagacatggaccagaacactagagatatcattatgcgtgagttccgatctgggtcgtctcgtgtgctcatcactactgatcttttggcacgtggtattgatgtgcagcaagtatcccttgtgattaactatgacctgcctactcagccagaaaactacctgcatcgtattggtcgtagtgggcggtttggaaggaagggtgtagctatcaactttgtcacaaaggatgatgaaaggatgctttttgacattcagaagttttacaatgttgtaatcgaggagctgccagccaatgtggccgatcttctttgaggtggttttggttctcagaggtgaattcttccttaatatcaagtaatttaatattttattcttaggtaagttagaattgcactggactgaaaattgggaaatgcagtagtttccgtgatttgccatgggaattgtagttctccaattgggttggacttatttgcaaatttttgttggtttgtctttttgtattgtaagtccacgacaacttcttcaggtttgggatgttctttgaatttagtttaatttgattttaactcttcgccttgtttttcagttgttgtataaggaatgcttctaaagacaatttgttcctctgtattgtgtgatcgcttctcttcgtaatgccttgtatagtctcttcctttct

SEQ ID NO: 5116 - DNA, 1408 bp, Sorghum bicolor
cagcagaataagagtcaaggatgacacaaataaataccatcattcggtcatacatagttttaaacaaagtactaataaagagaaaaacactccagcgccagcagcgtcttcctcttgatactaatgaacccccacagcagcacataccacaaggcctaggcagctacaaaaattcccaaaacatggcataaagaaaaaccacaaattgtccatgaccacgactttaacatagaaaccccaccgaccatatcacttcctcccccgcgatatttcgacaaaaccaagccttatcagttcccctcgcctcccttttttttgttcagtttttcttcaaaatgatcacagaaggtcagcaacattggcaggcagctcctcaatcaccacattgtagaacttctggatgtcaaacagcatccgctcgtcgtcgcgggtcacaaagttgatggcaacacccttcctaccgaaacgaccactacgaccaatgcgatgcaggtagttctctggctgggtgggaagatcatagttgatgaccagggacacttgctgaacatcaataccacgagcaagcaggtcggtggtgatgagcacacgcgaggaaccagaccggaactccctcatgatgatgtctctagtgttctggtccatgtcaccgtgagtggcagagacagtgtggtccctgctcctcatcttgtcagtgagccagtccaccttgcggcgggtgttgacgaagatgacactctgggtgatggccagggtctcgtacaggtcacacagtgtgtccagcttccagtcttccttctccacattcacatagaactgcttgataccctcaagagtcagctcatctctcttcacaaggattctgacaggcttgttcatgaacttgcgggtgatctcaagggcctcagggggcatggtagcagagaagactccaacctgaatcttggctggaagaagttggaagataagagtttacctgatccttgaaaccacgagaaagcatttcatcagcttcatcaagcacaaacatcttgatgttatcagggcggagggactgcctacgcagcatgtcaaaaacacgaccaggtgtaccaacaacaacatgcacaccactggcaagaatcctttgatcctcacggacagatgttcctcccacacatgcatggaccttaacacccaggtagtcaccaagtgcgcgcatgactttctcaatttgctgtgcaagctcacgggtgggagcaaggaccaaggcctggcattccaccaggccataatcaagctgctgcaagatcccagaacagaaagttgctgtttttcctgtaccagattgtgcttgctgaatgacatcaagccccttgcagaagggaacaattcctctctgctgaattgcagaaggcttctcaaaacc

SEQ ID NO: 5117 - DNA, 1372 bp, Solanum lycopersicum
cagataatccaactaaaagctttaccttccatagggaaatagatcaattaaacaattcaaacaacaccaaatacaaagttatttggatactttaaaggtataaaatgacaaaccaaacaaaatttgcaaaaaaaaaaaaaaaggtttcatttgaatcaggaaaggaactggtgctgtggcaaaccatggctaccagcatttcctaattccaagtctagtacaaactgatactaaatctaagaataaatataccaaaaatcgccttagaggagatcagcaacattggctgggagctcctcaattacgacgttgtaaaacttctgtatgtcaaaaagcatcctttcatcatccttggtgacaaagttgatagcaacacccttccttccaaatcgtccactacgaccaatacgatgcaggtagttttctggttgagttggcaggtcatagttaataacaagggagacttgttggacatcaataccacgagcaaggagatcggttgtgataagcacacgagatgagccagatcggaactccctcatgatgatatctcttgtgttctgatccatgtctccatgagttgcagatactgtgtggtcacgtccacgcattttatcagtgagccagtcaacctttcgcctagtgttaacaaagatgacgctctgggtgatggccaaggtctcgtaaagatcacatagtgtttcaagcttccactcttccttatcgacattgacataaaactgcttaataccttcaagagtgagctcatcacgcttcacgagaattctcacaggcttgttcatgaactttctagtaatctcaagagcctctggtggcatagtcgcagagaaaacacccacttggatttttggtggcaaaagctggaatatatcataaatctggaaaataatatttgtggcaacctgatccttgaaacctctagagagcatttcgtcagcttcatccaaaacaaacatcttgatgtggtcggggcgaagagactgcctgcgcaacatgtcaaagacacggcctggagtaccaaccacaacatgaacaccgctctgaaggatgcgctgatcctcacggacactggtacccccaacacaagcatgaaccttcacacccaggtagtcaccaagtgctctcataaccttctcaatctgttgtgcaagctcacgggttggtgcaagaaccagagcctgacactcaactaaactgtaatcaagctgctggagaattccagagcagaaagttgccgtctttccagtaccagattgtgcctgctggatgacatcaaggcccttgcaaaaaggaacaatgcccctttgctgaatagcagatggcttctcaaaaccttaaagaaattcaaaag

SEQ ID NO: 5118 - DNA, 1262 bp, Solanum lycopersicum
agttcaaataaacaattcaaaacaaccaccaaatccaaagttatttggacacttccaaaaacaaaataacacaaaaaccagacaaaatttgcagttgttcactctgaataaatatattagactactacttgtagggaaggaacaattccccctcacagagccaaaaccacctcaaaggagatcagcaacattggctgggagctcctcgattacgacgttgtaaaacttttgaatgtcaaaaagcatcctttcatcatccttggtaacaaagttgatagcaacacccttccttccaaatcgtccactacgaccaatacgatgcaggtagttttctggttgagttggcaggtcatagttgatgacaagggagacttgttggacgtcaataccacgagcaaggagatcggtggtgataagcacacgagatgagccagatcggaactccctcataatgatatccctagtgttctgatccatgtctccgtgagttgcagatactgtgtgatcacgaccacgcattttgtcagtgagccaatcaacctttcgcctggtgttgacaaagatgacactctgggtgatggccaaggtctcgtaaagatcacaaagtgtttcaagtttccactcttccttatcgacgttgacatagaattgcttaataccttcaagagtgagctcatcacgcttcacgagaattctcactggcttgttcatgaattttctagtaatctcaagagcctctggtggcattgtagcagagaaaacacccacttggatctttggtggcaaaagctggaatatatcataaatctagaaaaaaataattgcggagacctgatccttgaaacctctagagagcatttcatcagcttcatccaaaacaaacatcttgatgtggtcggggcgaagagactgtctgcgcaacatgtcaaagacacggcctggagtaccaactaccacatgaacaccactctgaaggatacgctgatcctcacggacactggtacccccaacacacgcatgaaccttcacgcccagatagtctccgagcgcacgcataaccttctcaatctgttgtgccagctcacgggttggtgcaagaacaagagcctgacattcaactaaactgtaatcaagttgctggagaactccagagcagaaagttgccgtctttccagttcccgattgtgcctgctggataacatcaaggcccttgcaaaagggaacgatgcccctttgctgaatagctgatggcttctcaaaac

SEQ ID NO: 5119 - DNA, 701 bp, Brassica juncea
  misc_feature (122)..(122): n is a, c, g, or t
  misc_feature (383)..(383): n is a, c, g, or t
  misc_feature (584)..(585): n is a, c, g, or t
  misc_feature (587)..(589): n is a, c, g, or t
  misc_feature (686)..(686): n is a, c, g, or t
tccttgtgaagcgtgatgagctcactcttgaaggtatcaagcagttttacgtcaacgtggagaaggaagagtggaagctcgagacgctctgcgacctctacgagacgcttgccatcactcanagcgtcatcttcgtgaacacgaggaggaaggtggactggctcaccgacaagatgaggggacgtgaccacacggtctcggcgactcacggggacatggaccagaacacgagagacatcatcatgagggagttcaggtctggctcctcccgtgtgctcatcaccaccgacctcttggctcgtggtatcgatgtgcagcaagtgtctttggttatcaactacgatctgccgactcagcctgagaactaccttcaccgtattggnagaagtgggaggttcgggaggaaaggtgtggcgattaactttgtgaccaaggatgatgagaggatgctgtttgatatccagaagttttacaacgttgttgttgaggagcttccttccaacgttgctgatctgctttgagggagagaagaaaaggtctctttcttgttacacaaggcactctttgatctgattttgataccnntnnnctctcttttcatcagcatttattgttatctctctttgaacttctaagaacgtatctctctcttgtgaccatttttattttaaaatcatatggagtantttattttcttatcc

SEQ ID NO: 5120 - DNA, 879 bp, Brassica oleracea
ttctcggcgaccatgccgccggaggctctcgagatcacgaggaagttcatgagcaagccggtgaggatcctggtgaagcgcgacgagctcaccttggaaggtatcaagcagttttacgtcaacgttgagaaggaggagtggaagctcgagacgctctgcgacctctacgagacgctggccatcactcagagcgtcatcttcgtgaacaccaggcggaaggtggactggctcactgataaaatgagggggcgtgaccacacggtgtctgcgactcacggagacatggaccagaacactagagacattattatgagagagttcaggtctggctcctcgcgtgtgcttatcaccactgatctcttggctcgtggtatcgatgttcagcaggtgtctctggtgatcaactacgatctgccgactcagcctgagaactaccttcaccgtataggaagaagtgggaggtttgggaggaaaggtgtggcgatcaacttcgtgaccaaggatgatgagaggatgctgtttgatattcagaagttttacaacgtggttgttgaggagctgccttcgaacgttgctgatctgctgtgaaggggagaaagtttggcattgtctaccggagaagaaaggtttttacttgtctgttaaggcacgcactctttgatctgattttcatctcatcttcatctctctttccataagcggtttgtttgcattttctcttgtgttttcacctcttctgttcctaagaacatatcatatctctcttgtgaccatttttatttttataaatcatatgaagtatttgtttctggtttgttgtcttttcttatcttcctttgtatcaaatcttggagtgaaagttttggtttaaacattttc

SEQ ID NO: 5121 - DNA, 865 bp, Brassica napus
gaccagatctacgacatcttccagctcctcccgcccaagatccaggtcggagtgttctcagcaacaatgccaccagaggctctcgagattacaagaaagttcatgagtaagccggtgaggatcttagtgaagcgcgacgagctcaccttggaaggtatcaagcagttctacgttaacgtggagaaggaggactggaagctcgagacgctctgcgatctctacgagactctggccatcactcagagcgtcatcttcgtgaacactaggcgtaaggttgactggttaaccgataaaatgagggggcgtgaccacacggtctcggcgactcatggagacatggaccagaacacgagggatattataatgagggagttcaggtccggctcttctcgcgtgctgatcaccaccgatctgttagctcgtggtatcgatgtgcagcaggtgtctttggtgatcaactacgatttgccgactcagccggagaattatctccaccgtattggaaggagtgggaggtttgggaggaaaggtgtggcgattaactttgtgacgaaggatgacgagaggatgttgtttgatattcagaagttttataatgttgttgttgaggagctgccttctaacgttgctgatctgctgtgagagggagaagaagttcgccgacgtcaccggagaagaaaggttttttgtttgttttgaaagggcacaacaacaactactcttttgatttgattttgtctctcttccgaccatttttattctactatttaagatcattatggagtatttatttctggtttgttgtttgtctttgtatcagtcaaatcttttcatgcaagtgtttcatttattaatatccttttta

SEQ ID NO: 5122 - DNA, 770 bp, Brassica napus
  misc_feature (399)..(399): n is a, c, g, or t
  misc_feature (405)..(405): n is a, c, g, or t
  misc_feature (435)..(435): n is a, c, g, or t
  misc_feature (468)..(468): n is a, c, g, or t
  misc_feature (474)..(474): n is a, c, g, or t
ttggaaggtatcaagcagttttacgtcaacgttgagaaggaggagtggaagctcgagacgctctgcgacctctacgagacgctggccatcactcagagcgtcatcttcgtgaacaccaggcggaaggttgactggctcactgataaaatgagggggcgtgaccacacggtgtctgcgactcacggagacatggaccagaacactagagacattattatgagagagttcaggtctggctcctcgcgtgtgcttatcaccactgatctcttggctcgtggtatcgatgttcagcaggtgtctctggtgatcaactacgatctgccgactcagcctgagaactaccttcaccgtatcggaagaagtgggaggtttgggaggaaaggtgtggcgatcaacttngtgacnaaggatgatgagaggatgctgtttgatatncagaagttttacaacgtggttgttgaggagctnccttcnaacgttgctgatctgctgtgaaggggagaaactttggcattgtctaccggagaagaaaggtttttacttgtttgttaaggcacgcactctttgatctgattttgatctcatcttcatctctctttccataagcggtttgtttacattttctcgtgttttgtcacctcttctgttcctaagaacatatctctctctctcttgtgaccatttttatttttaaaatcatatggagtatttgtttctggcttgttggttttcttatcttcctttgtatcaaatcttgtcgtacagttaag

SEQ ID NO: 5123 - DNA, 791 bp, Brassica napus
cgggttcaaggaccagatctacgacatcttccagcttctcccaccaaagatccaagtcggcgtcttctcggcgaccatgcccccggaggctctcgagatcacgaggaagttcatgagcaagccggtgaggatcctggtcaagcgcgacgagctgaccttggaaggtatcaagcagttctacgtcaacgttgagaaggaggagtggaagctcgagacgctctgcgacctctacgagacgctcgccatcactcagagcgtcatcttcgtgaacacgaggaggaaggtggactggctcaccgacaagatgagggggcgtgaccacacggtctcggcgactcacggagacatggaccagaacacgagagacatcatcatgagggagtttaggtccgggtcctcgcgtgtgctcatcaccactgatctcttggctcgtggtatcgatgttcagcaggtgtctttggttatcaactacgatctgccgactcagcctgagaactaccttcaccgtatcggaagaagtgggaggtttgggaggaaaggtgtggcgatcaactttgtgaccaaggatgatgagaggatgctgtttgatatccagaagttttacaacgtggttgttgaggagcttccttccaacgttgctgatctgctttgaggaagaagaaaaggtctctttcttgttacacaaggcactctttgatctgattttgatacctattctctttccatcagcgtttattgttatatctctttaaatttctaagaacgtatctctctttgtgacaatttttatt

SEQ ID NO: 5124 - DNA, 971 bp, Brassica napus
gaccagcgcatcctccaggccggcgtccacgtcgtcgtcggcacaccggggcgagtcttcgacatgctgaagaggcagtccctccgcgccgacaacatcaagatgtttgttcttgatgaggctgacgagatgctctcccgcgggttcaaggaccagatctacgacatcttccagcttctcccaccaaagatccaagtcggcgtcttctcggccaccatgcccccggaggctctcgagatcacgaggaagttcatgagcaagccggtgaggatcctggtgaagcgcgacgagctgaccttggaaggtatcaagcagttttacgtcaacgttgagaaggaggattggaagctcgagacgctctgcgacctctacgagacgcttgccatcactcagagcgtcatcttcgtgaacacgaggaggaaggttgactggctcaccgacaagatgagggggcgtgaccacactgtctcggctactcacggagacatggaccagaacacgagagacatcatcatgagggagtttaggtctggctcctcgcgtgtgctcatcaccactgatctcttggctcgtgggattgatgttcagcaggtgtctttggttatcaactacgatctgccgactcagcctgagaactaccttcaccgtatcggaagaagtgggaggttcgggaggaaaggtgtggcgatcaactttgtgaccaaggatgatgagaggatgctgtttgatatccagaagttttacaacgttgttgttgaggagcttccttccaacgttgctgatctgctttgagggagagaagaaaggtctctttctttttacacaaggcactctttgatctgattttgatacctattatctctctttccatcagcgtttattgttatctctctttaaatttctaagaacatatctctctctttgtgacaatttttattactaaaatcatatggagtattttattttcttgt

SEQ ID NO: 5125 - DNA, 881 bp, Brassica napus
gatccaggtgggtgtcttctcggcgaccatgccgccggaggctctcgagatcacgaggaagttcatgagcaagccggtgaggatcctggtgaagcgcgacgagctcaccttggaaggtatcaagcagttttacgtcaacgttgagaaggaggagtggaagctcgagacgctctgcgacctctacgagacgctggccatcactcagagcgtcatcttcgtgaacaccaggcggaaggttgactggctcactgataaaatgagggggcgtgaccacacggtgtctgcgactcacggagacatggaccagaacactagagacattattatgagagagttcaggtctggctcctcgcgtgtgcttatcaccactgatctcttggctcgtggtatcgatgttcagcaggtgtctctggtgatcaactacgatctgccgactcagcctgagaactaccttcaccgtatcggaagaagtgggaggtttgggaggaaaggtgtggcgatcaacttcgtgacgaaggatgatgagaggatgctgtttgatattcagaagttttacaacgtggttgttgaggagctgccttcgaacgttgctgatctgctgtgaaggggagaaactttggcattgtctaccggagaagaaaggtttttacttgtttgttaaggcacgcactctttgatctgattttgatctcatcttcatctctctttccataagcggtttgtttacattttctcgtgttttgtcacctcttctgttcctaagaacatatctctctctctcttgtgaccatttttatttttaaaatcatatggagtatttgtttctggcttgttgcctttctgatcttcctttgtaacaaatcttgtcgtgacagtttagg

SEQ ID NO: 5126 - DNA, 1266 bp, Manihot esculenta
ttcagcaggcccagtctggaactggtaaaacagcaactttctgctctggcattctgcagcaacttgattatggtctagttcaatgtcaagcgctagtcttggctccaacaagagaactggcacagcagattgagaaagttatgcgagcccttggtgattaccttggtgtgaaggttcacgcatgtgtaggtggaacaagtgttcgtgaggatcaacgcattcttcaagcaggtgttcatgttgttgtgggaactcctggtcgtgtgtttgacatgctgagaaggcagtcacttcgtccagattacattagaatgtttgtgttggatgaagctgatgagatgctgtcacgtggtttcaaggatcagatctatgatattttccagttgctgccagcaaaagttcaggttggtgttttctctgctaccatgccaccagaggcccttgaaatcacaaggaagttcatgaacaagcctgtgaggatcttggttaagcgtgatgagcttacccttgagggtatcaagcagttctatgtgaatgttgagaaagaagaatggaaactagaaacactatgtgatctgtatgagaccctagccatcacccagagtgtcatttttgttaacacaaggcgcaaggttgactggcttactgacaagatgcgtagccgtgaccacacagtatcagcaactcatggagatatggaccagaacactcgtgatatcattatgcgggaattccgttctggctcttctcgtgttctgatcactaccgatctcttggctcgtggtattgatgtgcagcaagtttcacttgtcataaactatgacctgccgactcaaccggaaaactaccttcatcgtattggaagaggtggacgatttggaagaaaaggtgtagctattaattttgtgacaagggatgatgagagaatgctgtttgacattcagaaattttataatgtggtaatcgaggagctgccatctaatgttgctgatctcctgtgatgagaaattttggcgtgtgtcgagaaaggtttcttatttaacgtgttgtttttcgtttcttgtttagtgtcttgatttaatattttgagacatatctgacagtttattctcatatgagccttctcaattgcaacatgaagagattgtctagttcttattaccttttttatatttttgccctcttggaaagttttgcatgctgggtgtttttgtactgtataacccccctctttctataaattattgtggaattgtttacttgtcc

SEQ ID NO: 5127 - DNA, 1108 bp, Manihot esculenta
  misc_feature (285)..(285): n is a, c, g, or t
  misc_feature (1012)..(1012): n is a, c, g, or t
cattcttcaagcaggtgttcatgttgttgtgggaactcctggtcgtgtgtttgacatgctgagaaggcagtcacttcgtccagattacattagaatgtttgtgttggatgaagctgatgagatgctgtcacgtggtttcaaggatcagatctatgatattttccagttgctgccagcaaaagttcaggttggtgttttctctgctaccatgccaccagaggcccttgaaatcacaaggaagttcatgaacaagcctgtgaggatcttggttaagcgtgatgagcntacccttgagggtatcaagcagttctatgtgaatgttgagaaagaagaatggaaactagaaacactatgtgatctgtatgagaccctagccatcacccagagtgtcatttttgttaacacaaggcgcaaggttgactggcttactgacaagatgcgtagccgtgaccacacagtatcagcaactcatggagatatggaccagaacactcgtgatatcattatgcgggaattccgatctggctcttctcgtgttctcatcactaccgatctcttggctcgtggtattgatgtgcagcaagtttcacttgtcataaactatgacctgccgactcaaccggaaaactaccttcatcgtattggaagaggtggacgatttggaagaaaaggtgtagctattaattttgtgacaagggatgatgagagaatgctgtttgacattcagaagttttataatgtggtaatcgaggagctgccatcaaatgttgctgatctcctgtgatgagaaattttggcgtgtgtcgagaaaggtttcttatttaacgtgttgtttttcgtttcttgtttagtgtcttgatttaatattttgagacatatctgacagtttattctcatatgagccttctcaattgcaacatgaagagattgtctagttcttattaccttttttatatttttgccctcttggaaagttttgcatgctgggtgtttttgtactgtataacccccntctttctataaattattgtggaattgtttacttgtccatatttgtttctgtgactgcaagtttaatctttatttgcctttggtgtttaacttctcg

SEQ ID NO: 5128 - DNA, 833 bp, Gossypium hirsutum
  misc_feature (461)..(461): n is a, c, g, or t
  misc_feature (473)..(473): n is a, c, g, or t
  misc_feature (479)..(479): n is a, c, g, or t
ttcaggttggggtattttctgctacaatgccacccgaagccctagagatcactcggaagttcatgaacaaacctgtgagaattttggttaagcgcgacgaactaaccctggagggtatcaagcagttttatgttaatgttgaaaaggaagagtggaagctggaaacactttgcgatctctatgaaacactggccattacccaaagtgtcattttcgtgaacacaaggcgcaaggttgactggctaactgacaagatgcgaagtcgagaccacacagtttctgccacccatggagacatggaccagaatacgcgtgatgtcatcatgcgggaattccgttctggttcttcccgtgttctcatcactaccgatctcttagcccgtggtattgatgtgcagcaagtctcccttgtcataaactacgatctgcctactcaaccagaaaactacctccaccgaatnggaagaagtggnaggttngggagaaaaggtgttgccataaactttgtgactctagatgatgaaagaatgctgtttgatatccagaagttctacaatgttgtcatcgaggagctgccatcgaatgtcgcggatctcctttgatgagagattacgttttcagaaggttgtcgaggcgagcgctttcattgtttgaatgtccaattaagtgtgctctttttttcttttttggttttccctttttagcattttaagttgaatgttctttaagatatttgaccatttaattatgtgttctaaaattgctacataaagtttatccacttttcctcactcttttgcactttatttatgctattcatagttttgagtttt

SEQ ID NO: 5129 - DNA, 943 bp, Petunia hybrida
cagatgaatgctctctagaggtttcaaggaccagatttatgatatattccagcttttgccaccaaaaatccaagtgggtgttttctctgccactatgccacctgaggcccttgaaattactagaaagttcatgaacaagcctgtgaggattcttgtaaagcgtgatgagctcactcttgaaggtattaagcaattttatgtgaatgttgaaaaggaagaatggaagcttgagacgctctgtgatctttacgagaccttggccatcacccagagtgtcatctttgttaacactaggcgaaaggttgattggctcactgacaagatgcgtggccgtgatcacacagtgtcagcaacccatggagacatggatcagaacacaagagatatcattatgcgggagttccgatctggctcatctcgtgtgcttattactactgatctccttgctcgtggtattgatgtccagcaagtctcccttgttatcaactacgatctgccgactcaaccagaaaactacctgcatcgtattgggcgtagtggacgatttggaaggaagggtgttgccatcaactttgtcaccaaggatgacgaaaggatgctttttgacatacagaagttttacaatgttgtaattgaggagctgccagccaatgttgctgatctcctttgatgcggttttggttctgaggggggacttgttccttacatgaagtagcttaatatctttgttcttagggttagtttcattttgaatgaattgggaaatgctggtcccatgatttgccaaatcacaccagttactctcccaattcagttgaacttggagtcaactatcgcaaattttgttttgtttgtctttttgtattttggaatgtccaaataacttcagatttggttgttttaattatattgagttcaacagagctacttatctctgcaagag

SEQ ID NO: 5130 - DNA, 906 bp, Solanum tuberosum
aaaaatccaagtgggtgtttctctgccactatgccaccagaggctcttgagattactagaaaattcatgaacaaacctgtgagaattctcgtgaagcgtgatgagctcactcttgaaggtattaagcaattttatgtcaatgtcgataaggaagagtggaagcttgaaacactttgtgatctttacgagaccttggccatcacccagagtgtcatctttgttaacactaggcgaaaggttgactggctcactgataaaatgcgtggccgtgatcacacagtatctgcaactcacggagacatggatcagaacacaagagatatcattatgagggagttccgatctggctcatctcgtgtgcttatcacaaccgatctccttgctcgtggtattgatgtccaacaagtctctcttgttattaactatgacctgccaactcaaccagaaaactacctgcatcgtattggtcgtagtggacgatttggaaggaagggtgttgctatcaactttgtcaccaaggatgacgaaaggatgctttttgacatacagaagttttacaacgtcgtaattgaggagctcccagccaatgttgctgatctcctttaaggcgattttggtatattttttcttagatttagtttcagtttgtactagacttggaattaggaaatgctggtaccatggtttgccacagcaccagttactttcctgattcaaatgaaacttctagagtcaacttttgcaaattttgtttggtttgtcattttatatcttaaagcatccaaataactttggatttggtattgtttgaattgtttaatttatctatttccctatggaaggtaaagcttttagttggatatctgtttttccccattttgatgctatatttcatatttgaactcc

SEQ ID NO: 5131 - DNA, 926 bp, Raphanus sativus
aaagaccagatctatgacatcttccagcttctcccacctaagatccaagtaggtgtcttctctgcaacaatgccaccagaagctctcgagatcacaaggaagttcatgagcaagccagtgagaatcctggtgaagcgtgacgagctcaccctagaaggtatcaagcagttctacgtcaacgttgagaaggaagactggaagctcgagacgctctgcgacctctacgagactctagccatcactcagagcgtcatcttcgtgaacaccaggaggaaggtggactggctcaccgacaagatgagaggtcgcgaccacactgtctcggcgactcacggagacatggaccagaacacgagagacatcatcatgagggagttcaggtccggctcctcccgtgtgctcatcaccactgacctcttggctcgtggtatcgatgtccagcaagtgtccttggtcatcaactatgatttgccgactcagcctgagaactaccttcaccgtattggaaggagtgggaggttcgggaggaaaggtgtggcgatcaactttgtgaccaaggatgatgagaggatgctgtttgatatccagaagttttacaacgttgttgttgaggagcttccttccaacgttgctgatctgctttgaggggagaaagaaaggtctctctctttcttgtttcgcaaggcacctctttgatctggttttgatacactcttcgtctctcttttcttcagcatttattgttgttaccttctcttgaaattttctaagaacgtatctctctctcttgtgaccatttttatttttaatatcatatggagtattttattttcttgtttatttcaattctctggtatgtttgtcttttttattttgtatcaaaccaaaagcttttattttgtatcaaacgaaaagcttctcgttaa

SEQ ID NO: 5132 - DNA, 805 bp, Raphanus sativus
aagatccaggtcggagtcttctctgcgaccatgcctcccgaagctctcgagatcacgaggaagttcatgagcaagccggtgaggatacttgtgaagcgcgacgagctcaccttggaaggtatcaagcagttctacgtgaacgttgagaaggaagactggaagctcgagacgctttgtgatctctacgagacgctggccatcactcagagcgtcatcttcgtgaacactaggaggaaagtggactggctcaccgacaagatgagggggcgtgaccatactgtttctgcgactcacggagacatggaccagaacacgagggatattatcatgagggagttcaggtctggctcctcgcgtgtgcttattacgactgatctgttggctcgtgggatcgatgtgcagcaggtgtcgctggtgatcaactacgatttgccgactcagcctgagaactacctgcaccgtatcggaaggagtgggaggtttgggaggaaaggtgtggcgatcaactttgtgaccaaggatgatgagaggatgttgtttgatattcagaagttttataatgtggttgttgaggagctgccttccaacgttgctgatctgctgtgagaaggacaagttcgctcttgctgttctataacaccggagaagaaaggttttctttgttttttgaaaggcacaacaactactctttgatttggttttgacacttctctctctatttacgaacatatctctctctatctctcttttccgaccatttttatatttaagatcatatggaatgtttatttttggtttgttgtta

SEQ ID NO: 5133 - DNA, 657 bp, Juglans hindsii x Juglans regia
gttcatgaacaaacctgtaagaattcttgtgaagcgtgatgagcttaccctggagggtataaagcagttttatgtcaatgttgataaggaggaatggaaacttgagaccctctgcgacctttatgaaactctggccatcacccagagtgtcatttttgtgaacaccaggcgcaaggttgattggctgactgacaagatgcggagccgtgaccacacggtctctgccacccatggagatatggaccagaacacgagagacattatcatgcgtgaatttcgttccggatcgtctcgtgtccttataaccactgatcttttggcacgtggtattgatgtccagcaagtctcccttgtaataaattatgatctccctacacagccagagaactatctccatcgtattggacgaagtggacggtttgggaggaagggtgtggccatcaacttcgtaacaaaggatgacgaaaggatgctgtttgacatccagaagttttataatgtcgtagttgaggagctgccatcaaatgtcgccgatctcctctaacgagattttgcctatttagtagagaatcggattctctttggttaccagtatttatgtgtttttctttcttttctgtttcctttcctttccagtgtcatggcttatagggtatg

SEQ ID NO: 5134 - DNA, 839 bp, Brassica rapa
ctcacggagacatggaccagaacactagagacattatcatgagagagttcaggtctggttcatctcgtgtgttgatcacgactgatctcttggctcgtggtatcgatgttcagcaggtgtctctggtgatcaactacgatctgccgactcagcctgagaactaccttcaccgtattggaagaagtgggaggtttgggaggaaaggagtggcgatcaactttgtgaccaaggatgatgagaggatgctgtttgatattcagaagttttacaacgtggttgttgaggagctgccttcgaacgttgctgatctgctgtgaaggggagaaaaagtttggtattgtctaccggagaagaaaggttttttacttgtttgttaaggcacgcacacctctttgatctgattttgatctcatcatcatctctctctttccataagcggtttgtttacattttctcttgtgtgtttctctaagaacatatctctcttatttttaaaatcatatggagtatttgtttctggtttgctgtcttttcttatcttcttttgtatcaaatcttgtcgtgaaagttttggttttaaactttttcatatctcggtgcagaagtagtaaggattacacgaactttaatgagaagtgaatgatggagagaagatatttagaataaatatcttatttatttagtgttttatttagagtttatttattattaagatatttatctctaatgttttagggtttctatgtttttttatatataaccgtttaggcttaagtttgtattgggatgactgatattaatatattttataaaagagaggtttgaaaccaaaaaaaaaa

SEQ ID NO: 5135 - DNA, 577 bp, Nicotiana benthamiana
  misc_feature (90)..(90): n is a, c, g, or t
  misc_feature (231)..(231): n is a, c, g, or t
  misc_feature (276)..(276): n is a, c, g, or t
  misc_feature (543)..(543): n is a, c, g, or t
ggagacatggaccagaacactagagatatcattatgcgagagttcagatctgggtcatctcgtgtgctcatcaccactgatcttctggcncgtggtattgatgtgcagcaagtttcccttgtgattaactatgaccttccaactcagccagagaactacctgcatcgtattggtcgtagtggacgttttggaaggaagggtgttgctatcaactttgtcacaaaggatgangaaaggatgctttttgacattcagaagttttacaatgttgtcatngaggagttgccagccaatgtggccgatctcctttgaggttgttttgattatgtgagatgaattcttccttacatgaagtaatttaatatcttattcttaggttagttagaatgctaccaggcttggaattgggaaatgcaggtgccgtgattcaccatggaacctgtaaatcttcaattttggttggattatcgactataaattttatcggtttgccttttgtattgtaagtctacaataacttacgtttttggatgttctttgaanttttattgagatttaactccgctattgtgtatga

SEQ ID NO: 5136 - DNA, 1169 bp, Cleome spinosa
agggagcttgcccagcagattgaaaaagttatgagggctctcggagattacctcggtgtcaaggttcatgcctgtgtcggtggtactagcgttcgtgaagaccaacgcattctccaggccggtgtccatgtcgttgtcggtactcctggtcgtgtctttgatatgttgcgtaggcaatccctccgtcctgactacatcaagatgtttgttcttgatgaggctgatgaaatgctctcccggggtttcaaggatcagatctacgacatctttcagctcctcccacccaagatccaggtcggtgtgttttcagccacaatgcctccagaggctctcgagatcacaaggaagttcatgaacaaacccgtgaggatcttggtgaagcgtgatgagcttaccctcgagggtatcaagcaattctatgtgaacgttgagaaggaggagtggaagctcgaaacactctgcgatctctacgagactctggccatcacccagagcgtgatctttgtgaacacccggcgcaaggtggactggctcacagacaagatgagaagccgcgaccacacggtctcggccactcacggtgacatggaccagaacactcgagacatcatcatgcgtgagttcaggtcaggatcatcccgtgtcttgatcacgacagatctcttggcccgtggtatcgatgtccagcaggtctctctggtcataaactttgaccttccgacacagccggagaactatctccaccgtatcggaagaagtggaaggttcgggagaaagggtgtggccatcaacttcgtgactcgtgacgatgagaggatgctctttgatatccagaagttctacaacgttgtcgtggaggagcttccgtccaacgtggcggatcttctgtgaggcacaaaagagggggaagtgatttgagtgtctgtgttgtccggagaagaaggttgcttgtttcgcaaggttctatttgattttgaccccgccaactctctctaagcatttcctgttttatcattcttcttctttcgcgtctcttccgttatatttttgttttttatttttaattttctagtgttctcggaaggaaaaaggtcttttttaaagaaccattgttgtttccgccctccctcttatgaacatatttctgaccatttttatggagtatcatc

SEQ ID NO: 5137 - DNA, 1037 bp, Cucumis sativus
gagatctgcaacattggctggcagctcctcaatgaccacattatagaacttctgaatatcaaaaagcattctctcatcatcatttgtaacaaaattgatggcaacaccctttcttccaaaacgcccacttcgaccaattcgatggaggtaattttcaggttgggtcggcaaatcataatttatgacaagggacacttgctgaacatcgataccacgagctaacaagtcagttgtgataagaacacgagacgacccagaacgaaattcacgcatgattatatcacgagtgttctggtccatgtcaccatgagtggccgatacggtatgatcacggcttctcatcttgtccgtaagccaatcaaccttgcgacgtgtgttaacaaagatgacactttgagtgatagccagagtctcgtacagatcacatagagtttcaagcttccaatcttccttatcaacatttacgtaaaattgtttgataccttccaaagtaagctcatcacgttttaccaagattctgacaggcttgttcatgaatttcctagtgatctccaaagcttccggaggcattaaattcacctggtctttgaaacctcgagaaagcatttcatcagcttcatccaatacaaacatcttaatacaatctgggcgaagagactgcctcctcaacatgtcaaacacacgaccaggtgttccaactactacatgaacaccagcttgaagaatgcgttgatcctcacggacacttgtccctcccacgcaagcatgaaccttaactccaagataatctccaagagctctcataaccttctcaatttgttgagccagctccctagtcggtgccaaaactaatgcctggcactggactagaccataatcaagttgctgaagtatcccagagcagaaagttgcagtttttccagttccagattgagcctgctgaatcacatcgaggcccttgcagaagggaactatacctctttgctgaattgcagaaggtttctcaaaaccttaaagaattaggaaaactccaggaa

SEQ ID NO: 5138 - DNA, 846 bp, Solanum melongena
ctctgccactatgccaccagaggctcttgagattactagaaagttcatgaacaagcctgtgagaattcttgtgaagcgtgatgagctcactcttgaaggtattaagcaattttatgtcaatgtcgataaggaagagtggaagcttgaaacactttgtgatctttacgagactttggccatcacccagagtgtcatctttgttaacactcggcgaaaggttgattggctcactgataaaatgcgtagccgtgatcacacagtatctgcaactcatggagacatggatcaaaatacaagagacatcattatgagggagttccgatctggctcatctcgtgtgctcatcacagccgatctccttgctcgtggtattgatgtacagcaagtctccctcgttattaactacgacctgccaactcaaccagaaaactacctgcatcgtattggtcgtagtggacgatttggaaggaagggtgttgctatcaactttgtcaccaaggatgatgaaaggatgctttttgacatacagaaattttataacgtcgtaattgaggagctcccagccaatgttgctgatctcctttgaggcaattttggctctgtgagggaactgtcccttccctacaggaagtaatctaatatatttcttcaaagagtgaacaactgcaaattttgtctggtttgtcctttcgtttttgaaagtttccaaataactttgaatttggtggttgttttaactgtttatttgaactatttttctatggattttaggcttttagatggacctctcttttctcatgttggtgatgtatttgtaccctactattgcattagcccaatcaatcg

SEQ ID NO: 5139 - DNA, 558 bp, Eschscholzia californica
tctgtgatctttacgagacattagccattacccagagtgtcatctttgtcaacactcgacgaaaggttgattggctaaccgacaagatgcgtagccgtgatcatacagtttcggcgactcatggagacatggaccagaacaccagggacattatcatgcgtgaattccgatctggatcttcccgtgtcttaatcaccaccgatctcttggctcgtggtattgatgttcaacaagtttccctagttataaacttcgatctcccaacacagccagagaactacctccaccgtatcggacgtagtggacgatttggaaggaaaggagttgctatcaatttcgtgaccaaggatgacgagaggatgttgttcgacatccagaagttttacaatgtggttgttgaggagctaccatcaaatgttgcagatcttctctgagaaaacaactctttttactgttagttttttgattaaaattttggtaattagacctattgaactatttattgcctttttcttttttcatagaactaagtcttattaattaggtcctacttttaac

SEQ ID NO: 5140 - DNA, 849 bp, Unknown
  Sequence found in Organisms: Ipomoea nil, Ipomoea nil
cttctcagctacaatgcctcctgaggcacttgagataacaaggaaattcatgaacaaacctgtgagaattcttgtgaagcgtgatgagctgacactagagggtattaagcaattccatgtcaatgtcgacaaagaagagtggaagcttgagacactttgtgatttgtacgaaacccttgccattacacagagtgtgatttttgtgaatacccgtcgtaaggttgactggttaactgacaagatgagaagccgagaccatacagtgtcagccacccatggtgacatggaccagaacacaagggacattattatgcgtgaattccgttctgggtcctcccgtgttctcatcactactgatctgttggcaagaggaattgatgttcaacaagtatccctcgtcattaactatgatctccctactcaacccgagaactacctgcatcgtattggtcgtagtggaaggttcgggaggaaaggtgtggcaatcaactttgtaacaaaggacgatgagaggatgctttttgacatccagaagttctacaacgtgatgatcgaggagctgccagcaaatgttgctgatctcctgtaacaaagttttgtcactacaagctcaaaaaccagtctcttcctgctttcgacttttcttcttttctgcagttcccttagtttagcaactcttattgtctaaatttatgaagcaatgtaatccatctctgtatcttataagtggggatcaatttagaagattttgcatttgaggtttgtaactgaaaggttaccttattaacctaaggattgttactttggttatgttttgtcttttattgcttgaatgatggaagcagtgat

SEQ ID NO: 5141 - DNA, 745 bp, Rhizophora mangle
gattttccagttgctgccacccaaaattcaggtaggggttttctctgctacaatgccgccagaggcccttgagatcacaaggaagttcatgaataaacctgtgaggatcttagtcaagcgtgatgagcttacacttgagggcatcaagcagttctatgtcaatgttgaaaaggaggaatggaagcttgagacactttgtgatctctatgaaaccttggcaattacccaaagtgtgatctttgtgaacactagacgaaaggtagattggctcacagacaagatgcgcagccgtgaccatacagtttctgctacccatggtgacatggaccagaacactagggatattattatgcgggaattccgttctggttcctctcgtgtgcttattactactgatcttttggcacgtggtattgatgtccagcaagtctcacttgtcatcaactatgatctcccaacacagccagagaactacctccacagaattggtcgtagtggacggtttgggagaaagggtgttgctataaattttgtcaccaaggatgatgaaagaatgctttttgacatccagagattttataatgtcatcatagaggagctgccatcaaatgttgccgatcttctttgaagcaattttggcttggcaaggtaaatggcctgaagttacaagtcataaattattgtgtttgttgttgtaggccttggctgtcaagcatttatcggacttaccctacagatggtttct

SEQ ID NO: 5142 - DNA, 763 bp, Rhizophora mangle
ataaaacagttttatgtcaacgtggataaggaggaatggaagcttgagacgctatgtgatccttatgaaaccttagccattacccagagtgtcatttttgttaatactcgacgcaaagtggactggctgactgacaagatgcggagcagagaccatacagtctctgccactcatggtgatatggaccagaacacaagagacataattatgcgtgaatttcgatctgggtcatctcgtgttctgattaccaccgatctcctagcccgaggcatagatgtgcagcaagtctcccttgtcataaattatgatctccctacacagcctgagaactatctccatcgtattggacgtggtggacgatttggaaggaaaggtgttgcaatcaactttgtaacaaaggatgacgagaggatgttgtttgacatccagaagttttataatgtggtgattgaggagctgccagcaaatgttgccgatctcctctgagcaatttttgttttccaattactagtagaaagagggatataacgcatggtaagtgttatttgttgtgcttttggctttttatattttaccttcccagcttcccttttcttaacctagatgtgtttttttataggcatgataagaagcctgacttctgtttatttaagtgatatgaacttctctttttgcaatgtcaagcacttctgtcccggatgttttctaatgggttctgtgactttaagttattggtaagtgggggattttcatttgttatggt

SEQ ID NO: 5143 - DNA, 1257 bp, Solanum phureja
agttcaaataaacaaaattcaaacaaccaaatccaaagttatttggacacttccaaaaacaaaataacaaaaaccagacaaaatttgcagttgttcactctgaataaatatattagactacttccagtagggaaggaacaattcccctcacagagccaaaatcacctcaaaggagatcagcaacattggctgggagctcctcaactacaacgttgtaaaacttttgaatgtcaaaaagcatcctttcgtcatccttggtaacaaagttgatagcaacacccttccttccaaatcgtccactacgaccaatacgatgcaggtagttttctggttgagtaggcaggtcgtagttaataacaagggagacttgttggacatcaataccacgagcaaggagatcggttgtgataagcacacgagatgagccagatcggaactccctcataatgatatctctagtgttctgatccatgtctccgtgagttgcagatactgtgtgatcacggccacgcattttatcagtgagccaatcaacctttcgcctggtgttaacaaagatgacactctgggtgatggccaaggtctcgtaaagatcacagagtgtttcgagcttccactcttccttatcgacgttgacatagaattgcttaataccttcaagagtgagctcatcacgcttcacaagaattctcacaggcttgttcatgaactttctagtaatctcaagagcctctggcggcatagtggcagagaaaacacccacttggatttttggtggcaaaagctggaatatatcataaatctggaaaatggaaattgtggagacctgatccttgaaacctctggagagcatttcatcagcttcatccaaaacaaacatcttgatgtggtcggggcgaagagactgtctgcgcaacatgtcaaagacacggcctggagtaccaaccactacatgaacaccactctgaaggatacgctgatcttcacggacactggtacccccaacacacgcatgaaccttcacgcccagatagtcaccgagtgcacgcataaccttctcaatctgttgtgccagctcacgggttggtgcaagaacaagagcctgacattcaactaaactataatcaagttgctggagaactccagagcagaaagttgctgtctttccagttccagattgtgcctgctggataacatcaaggcccttgcaaaagggaacgatgcccctttgctgaatagctgatggcttctcaaaac

SEQ ID NO: 5144 - DNA, 1313 bp, Solanum phureja
gtttaaatcaaatatacttaaaaattcaaagacatccaaaacctgaagttgttgtggacttgcaatacaaaaagacaaaaccaacaaaattggaaaactacgacgaatcacagaaactgcagtttccaacttttagtccagtgcggttctaactaacctaagaataaaatattaaattacttaatataaggaagaattcagctcagacaaccaaaaccaccacctcaaagaagatcggccacattggctggtagctcctccactacaacattgtaaaacttctgaatgtcaaaaagcatcctttcatcatcctttgtgacaaaattgatagctacacccttccttccaaatcgtccactacgaccaatacgatgcaagtagttttctggctgagtaggaaggtcatagttaatcacaagggatacttgctgcacatcaataccacgtgccagaagatcggtagtgataagcacacgagatgacccagatcggaactctcgcataatgatatctctggtgttctggtccatgtctccatgagtggcagatactgtgtgatcacggctgcgcatcttatcagtgagccaatcaaccttacgcctggtgttcacaaagatcacactctgggtgatggctaaggtctcgtaaagatcgcaaagagtttcaagcttccactcttccttgtcaacattcacataaaattgcttgataccttcaagagtgagctcatcacgcttcacaaggatcctcacaggcttgttcatgaacttcctagtaatttcaagggcctctggtggcattgtggcagagaaaacaccaacttgaatctttggtggcagcaattggaaaatatcataaatctggaaaataacaagacaacttcaaaatgagacactatttcttcatccagaacaaacatcttgatgtggtcggggcgaagagactgcctgcgcaacatgtcaaatacacgaccaggagtaccaacaaccacatgaacaccactttgaaggatacgctgatcctcacggacactggtacctcctacacaggcatgaaccttcacaccaagatagtcaccaagtgctcgcataaccttctcaatctgttgggcaagctcacgggttggagccagaaccagagcctgacattcgactaagctgtaatcaagttgctggagaatcccagagcagaaagttgcagtctttcctgtaccagattgtgcctgttggatcacatcaagacccttgcaaaaaggaacaatacccctttgctggatagcagatggcttctcaaaaccttcaagcaatttaaga

SEQ ID NO: 5145 - DNA, 1302 bp, Solanum lycopersicum
aaatgaaatatactaaattcaaagacatccaaaacctgaagttgttgtggacttacaatacaaaaagacaaaaccaacaaaatttgtaaataaggcgaatcacagaaactgcagtttccaagttttagtccactgcggctctaactaacctaacaataaaatattaaattacttaatataacgaaaaattcacctcacagaaccaaaatcacctcaaagaagatcggccacattggctggcagctcctcaactacaacattgtaaaacttctgaatgtcaaaaagcatcctttcatcatcctttgtgacaaaattgatagctacacccttccttccaaatcgtccactacgaccaatacgatgcaagtagttttctggctgagtaggcaggtcatagttaatcacaagggatacttgctgcacatcaataccacgtgccagaagatcagtagtgatgagcacacgagatgatccagatcggaactctcgcataatgatatctctagtgttctggtccatgtctccatgagtggcagatactgtgtgatcacggctgcgcatcttatcagtgagccaatcaaccttgcgcctggtgttcacaaagatgacactctgggtgatggctaaggtctcgtaaagatcgcaaagagtttcaagcttccactcttccttgtcaacattgacataaaattgcttgataccttcaagagtgagctcatcacgcttcacaaggatcctcacaggcttgttcatgaacttcctagtaatttcaagagcctctggtggcattgtagcagagaaaacaccaacttgaatctttggtggcagcaattggaaaatatcataaatctggaaaatgacaagacaactttaaaatgagacactatatcttcatccagaacaaacatcttgatgtggtcagggcgaagagactgcctacgcaacatatcaaatacacgaccaggagtaccaacaaccacatgaacaccactttgaaggatacgctgatcctcacggacactggtacctcctacacaggcatgaaccttcacaccaagatagtcaccaagtgctcgcataaccttctcaatctgttgggcaagctcacgggttggagccagaaccagagcctgacattcgactaagctgtaatcaagctgctggagaatcccagagcagaaagttgctgtctttcctgtaccagattgtgcctgttgaatcacatcaagacccttgcaaaaaggaacaatacccctttgctggatagcagatggcttctcaaaaccttcaagcaatttaaga

SEQ ID NO: 5146 - DNA, 948 bp, Brassica juncea
tacgttgtcgttggaactcccggtcgtgtctttgacatgctccggagacagtcacttcgctctgactccatcaagatgtttgtccttgatgaagctgatgaaatgctctcccgtggtttcaaggatcagatctatgacatattccagcttctcccaccaaagattcaggtgggagtgttctcagctacaatgccaccagaggctctcgagatcacaaggaagttcatgagcaaaccggtgagaatcttggtgaagcgtgacgagctcaccctcgaaggtatcaagcagttctacgtgaacgtggagaaagaagagtggaagctcgaaactctctgtgacctctacgagacattagccatcactcagagtgtcatcttcgtcaacacacgtcgcaaggtggactggctcactgacaaaatgaggagccgcgaccacacggtctcggccactcacggagacatggaccagaacacgagagacatcatcatgagagagttcaggtctggttcttcccgtgtcctcatcaccacagatctcttggctcgtggtatcgatgtgcagcaagtctctctggtcatcaacttcgacctcccaactcagccggagaactaccttcatcgtatcggaagaagtggaaggtttgggaggaaaggtgtggcgattaacttcgtgactcgtgatgatgagagaatgctttttgatattcagaaattctacaatgtggttgttgaggagcttccatcaaacgtcgccgacctgctttgaagaagaagaacagaaaaccaccgttgttcgcccgataagaagaaaaggttacttgtttcgcaagttttgttattttgatttttgacccatctttctctgtctctctattactcctcgacacctctttctcattctcaaacatatgtctcgtctgaacatgtttcttcttaatctcatgcaatt

SEQ ID NO: 5147 - DNA, 827 bp, Musa acuminata
gatgaataaacctgtgaggatcctggtgaagagagatgagcttactttggagggtatcaagcaattccatgtcaatgttgagaaggaagaatggaagcttgagaccctgtgtgatctctatgagaccttggccatcacacagagcgtgattttcgtcaatactcgacgcaaggtggactggctcactgacaaaatgaggagcagggatcatactgtctctgcgacccatggagatatggatcagaacactcgggacattataatgcgggagttccgttcgggctcctctcgtgtactcatcaccactgatctccttgctcgtggtattgatgtccagcaggtctccctggttataaattatgatctgccgacacagccagagaactatcttcatcgtattggacgcagtggccgttttggaagaaagggtgtcgcaatcaattttgtcactcgtgatgatgaacgaatgttgtttgatatccaaaggttctataatgtggtgattgaggagctgccatccaacgttgccgacctaatctgataaggattttttggttgaactgaatgtttgatctttataacctgtttaggtttagcaataaactcatcgaaggtgtctcttgactatcttgaatggtgcggttataaaggaagttacaagtgctggtcttgtttgaagcgactattcctagtactttattatcgttcatcacatctttttagagttgcagccactaagttgtatctccccatcttttttgttgcgattgctgagcctttttggatctgcacatcttttttgaacctgttttgtttctagatgtact

SEQ ID NO: 5148 - DNA, 638 bp, Hordeum vulgare
cgcaaggtggactggctcaccgacaagatgaggggaagggaccacactgtctctgcaacacacggagacatggaccagaacactagggacatcatcatgagggagttcagatctggctcttctcgtgtgctcatcaccaccgacctgctggcccgtggtattgatgtgcagcaagtctcccttgtcatcaactacgacctgccgacccagcctgagaactacctccatcgcattggtcgtagtggtcggttcgggaggaagggagttgccatcaacttcgtcacccgtgaagatgagaggatgctgttcgacatccagaagttctacaacgtggtcattgaggagctcccggccaatgtcgctgaccttctctagattattatcataggaatgcagtaaggtgcttgataaagttcgtttttgttgaatatctcccaactctcagttttggagtggtcaggtctggttctgtttgaatcgcggttaaggatcgagtttttttttttcttgttatgcaatgtccggaaatttttgtagtgcgtaggctgtgccaactcccgggctagctgggatagagtgacactggtggagtattttacttctcgttgtgaagctattttattgcccctctgttttta

SEQ ID NO: 5149 - DNA, 808 bp, Eucalyptus gunnii
cggccggggaaggtatcaagcagttctacgtcaatgttgacaaggaagaatggaagcttgacactttgtgtgatctttatgaaaccttggccattacccaaagtgtgatctttgtgaacaccaggcggaaggttgactggcttactgataagatgcgaagccgagaccacacagtctctgcaactcatggtgacatggaccagaacaccagggatattattatgcgtgagttccgttctggatcttctagggttcttatcaccactgacctcctggctcgtggtattgatgtgcagcaggtctcgcttgttataaactacgatttgccaactcaaccagaaaattacctccatcgtataggacgaagtggccgttttggaagaaagggtgtggcgattaattttgtgaacaaagatgatgagagaatgctatttgatattcagaaattttacaatgtggtggtcgaggagctaccatccaatgttgctgatctcctttgatgagtttttcttattggtcgaagcaggaggtttttcttattctcaaggtatcgacagcattctgttttggttcctcaaaaattagtttcctaagttattgatgtccaaacggatctgacgattaactcataatgctcctggtgcaattgcaatactgcttcaagttttgttgtagggaaggttttgtattatctttatcatttaaggttatggacaaagtcgttagttggtctaagcatggtcttttcgttctggtgaccgcataactttttcatgttgtatgtcatagtggcaatgtgtcgtggtct

SEQ ID NO: 5150 - DNA, 889 bp, Zingiber officinale
  misc_feature (764)..(764): n is a, c, g, or t
ttccaaggttcagatatacgatttcttcccactacttccttcaaaaaatccaggttggtgtcttttcagccacaatgccacctgaggccctggagattaccaggaagttcatggataaaccagttaggattctcgtgaagcgagatgaacttaccctggaaggtataaagcaattctatggtgaatgttgaaaaggatgaatggaaacttgatacactatgcgacctgtacgagacattagccatcactcaaagcgtcatctttgttaatacccgacgaaaggtggactggctcactgaccaaatgaggggcagggatcatactgtctcagccacacatggtgatatggatcaaaacaccagggacattatcatgcgtgaattcagatctggctcctcaagagttctcatcactaccgatctccttgcccgtggtattgacgtccagcaagtctccctggtcataaattatgatttgccaactcagccagagaactacctccacaggattggacgtagtggacggtttggtagaaagggtgttgcgataaattttgtttcccatgatgatgagaggatgttgtttgatatccaaaagttctacaacgtggtcatagaagagctgccttccaatgtggctgatcttatctgagtaggttgttttgtattgttgggtatttatgcgccactttcaggcctcgttttattaagtaatcattaagcataactgttcagtggaaagtgttggacccttctctatatgantttgaaacaagttatcggcatgtcttactgctaatctttgaagcttttttatcagtcttgtaagacctattgagaattctgtttatgcttttttgaataatttttagtggaagctttttgcaaaa

SEQ ID NO: 5151 - DNA, 1045 bp, Leymus cinereus x Leymus triticoides
  misc_feature (100)..(100): n is a, c, g, or t
  misc_feature (181)..(181): n is a, c, g, or t
  misc_feature (196)..(196): n is a, c, g, or t
  misc_feature (211)..(211): n is a, c, g, or t
  misc_feature (337)..(337): n is a, c, g, or t
  misc_feature (343)..(343): n is a, c, g, or t
  misc_feature (397)..(397): n is a, c, g, or t
  misc_feature (433)..(433): n is a, c, g, or t
  misc_feature (448)..(448): n is a, c, g, or t
  misc_feature (451)..(451): n is a, c, g, or t
  misc_feature (505)..(505): n is a, c, g, or t
  misc_feature (529)..(529): n is a, c, g, or t
  misc_feature (550)..(550): n is a, c, g, or t
  misc_feature (556)..(556): n is a, c, g, or t
  misc_feature (784)..(784): n is a, c, g, or t
  misc_feature (816)..(816): n is a, c, g, or t
  misc_feature (847)..(847): n is a, c, g, or t
  misc_feature (868)..(868): n is a, c, g, or t
  misc_feature (872)..(872): n is a, c, g, or t
  misc_feature (905)..(905): n is a, c, g, or t
  misc_feature (907)..(907): n is a, c, g, or t
  misc_feature (922)..(922): n is a, c, g, or t
  misc_feature (935)..(936): n is a, c, g, or t
  misc_feature (973)..(973): n is a, c, g, or t
  misc_feature (984)..(985): n is a, c, g, or t
  misc_feature (992)..(992): n is a, c, g, or t
  misc_feature (1002)..(1004): n is a, c, g, or t
  misc_feature (1008)..(1008): n is a, c, g, or t
  misc_feature (1010)..(1010): n is a, c, g, or t
tgttgttgtcggcacacctggtcgtgtgtttgatatgttgcgcaggcaatccctccgcccagacaacatcaagatgtttgtgttggatgaagctgatganatgctttcacgtggtttcaaggatcagatctatgatatcttccagcttcttccatcaaagattcaggttggggtgttctcngctaccatgcctccngaggcccttgagatnacccgcaagttcatgaacaagcctgtgaggattcttgtcaagagggatgagcttacccttgagggtatcaagcaattctatgtcaatgtggagaaggaagagtggaagctggatacactctgtganctgtangagaccttggcaattacccagagtgtcatctttgtgaacacccgccgcaaggtngactggctcaccgacaagatgaggggaagggaccanactgtctctgccacncanggagacatggaccagaacactagggacatcatcatgagggagttcagatctggntcttctcgtgtgctcatcaccacngacctgctggcccgtggtatngatgtncagcaagtctcccttgtcatcaactacgacctgccgactcagcctgagaactacctccatcgcattggtcgtagtggtcggttcgggaggaagggagttgccatcaactttgtcacccgtgaagatgagaggatgctgttcgacatccagaagttctacaacgtggtcattgaggagctcccggccaatgtcgctgaccttctctagattatatcttaggaatgcagnaaggtgataaagttcgtttttgttgaatatcncccaactctcagttttggagtggtaaggtcngggtctgtttgaatcgtggtnaagnacggtcttgagttttttcttgttatgcaatgtncngaaatttttgtagtncgtaggctgtgcnntctcctgggctagctgggatagagtgacactgatggngtattttattnncgttctngcaagctcgnnntcananatttttcctttatatgtgaggtgatattttgttga

SEQ ID NO: 5152 - DNA, 1389 bp, Zea mays
ggatgacacaaataaataccaccattcggtcatacatagttttaaacaaaatactaataaagagaaagactccgcgccagcagcgtcttcctcttcatactaatgaacccccacagcagcacattaccacaaggcctaggcagctacaaaaattccaaaacatggcataaaggagaaaaaatcacaaattgtccatgaccacgacttcaacatagaaaccccaccgtccttatcaccccctctcccacggtatttcgacaaaaccaatccttaccaggttcctcaccacccttttttgttttgttttttcttcaaattgatcacagaaggtcagcaacattggcaggcagctcctcaatcaacacgttgtagaacttctgaatgtcaaacagcatacgttcgtcgtcgcgggtcacaaagttgatggcaacacccttcctaccaaaacgaccactacgaccaatacgatgcaggtagttctctggctgggtgggaagatcatagttgatgaccagggacacctgctgaacatcaataccacgagcaagcaggtcagtggtgatgagcacacgggaggagccagaccggaactccctcatgatgatgtctctagtgttctggtccatgtcaccatgagtggcagaaacggtgtggtccctgctcctcatcttgtcagtgagccagtccaccttgcggcgggtgttgacaaagatgacactctgggtaatggccagggtctcatacaggtcacacagtgtgtccagcttccagtcttccttgtccacattcacatagaactgcttgataccctcaagggtcagctcatctctcttcacaagaattctcactggtttgttcatgaacttgcgggtaatctcaagggcttcaggtggcatggtagcagagaagactccaacctgaatcttggatggcagaagctggaagataagtgtttacctgatccttgaaaccacgagaaagcatttcatcagcttcgtcaagaacaaacatcttgatgttatcagggcggagggactgtctacgcagcatgtcaaacacacgaccaggtgtaccaacaacaacatgcacaccactggcgagaatcctttggtcctcacgaacagatgttcctccaacgcatgcatggactttaacaccaaggtagtcaccaagtgcgcgcataactttctcaatttgttgtgcaagctcacgggtgggagcaagaaccagggcctggcattcaaccagaccatagtcaagctgctgcaagatcccagaacagaaggttgctgtctttcctgtaccagattgtgcttgctgaatgacatcaagccccttgcagaagggaacaattcctctctgctgaattgcagatggtttctcaaaacc

SEQ ID NO: 5153 - DNA, 931 bp, Elaeis guineensis
  misc_feature (46)..(46): n is a, c, g, or t
  misc_feature (58)..(58): n is a, c, g, or t
  misc_feature (61)..(61): n is a, c, g, or t
  misc_feature (65)..(65): n is a, c, g, or t
  misc_feature (67)..(67): n is a, c, g, or t
  misc_feature (76)..(76): n is a, c, g, or t
  misc_feature (88)..(88): n is a, c, g, or t
  misc_feature (136)..(136): n is a, c, g, or t
atgaaatgctttcacgtgtttcaaggaccagatctacgacatcttncaacttcttccntcnaaantncaggttggngtcttctctgcnacaatgcctcctgaggcccttgagataactcgcaagttcatgaacaancctgtgaggatccttgtgaagcgagatgagctcaccctcgagggtattaaacagttttatgtcaacatcgagagagaagagtggaagctcgagactctctgtgatctttatgagactctggccatcactcagagtgtcatctttgtgaacaccaggcgcaaggttgactggctcactgacaagatgaggagcagggatcacacagtctcggccacgcatggagacatggatcagaacactagggacattataatgcgtgaattccgatctggttcctcccgtgttcttatcaccactgatctccttgctcgtggtattgatgttcagcaagtctcgctggtcataaattatgatctgccaacccaaccagagaactatcttcaccgaattggacgaagtggacgtttcggaaggaagggtgtggcgatcaactttgtcactcgtgatgatgaaaggatgttgtttgatattcagaggttttacaacgtggtgatcgaggagctcccatctaatgttgctgaccttatctaagcgaatctttaatcgtagcatggtaattaatattaatgccttctagatttttttttttgctctctccaaagattattcttctacaagttttattttgagtggtaaggactggaaccatttgaattgatggcccagagcaaatcattgtctatgccatctttttgatatttttgtagctgctagcttgttctgtatgtgttttggtatccttaaagaggagacagtatggataatttatctttatgggacttggtttgattgctc

SEQ ID NO: 5154 - DNA, 694 bp, Ananas comosus
cagttctatgtcaatgtcgaaaaagaagaatggaaattggagaccctctgcgacctctatgaaaccctggccatcacccagagtgtcatattcgtaaatacccgtcgcaaggttgactggctcactgacaaaatgagaagtagggatcatactgtttctgccactcacggagacatggaccagaatacgagagatatcatcatgcgtgaattccgatcgggctcttcgcgcgttcttattaccaccgatcttcttgctcgaggtattgatgtgcagcaggtctcgctcgtcataaattatgacttgcccacacagcctgagaactatcttcaccggattggacgtagcgggcggtttgggagaaagggggttgcaataaatttcgtcactcaggatgatgagaggatgctgttcgatatccagaggttttataacgctgtgattgaggagctgccatccaatgttgccgacctgctctgatcgtcttacctgtggaagggaatatatgatatgtaatgtgggatattgcaatttcttgctttctttttttttttttttttttttttgtgtgttttatttttaatgtttgttcgggcaccccaaaatctcatctgtgaaacttgatcattgtaggacttgctttagctttctcgttgtttaatctttggttcagtatatgtggtctatattttct

SEQ ID NO: 5155 - DNA, 1662 bp, Populus trichocarpa
ctataccgacctataaataatcacgcagacacgtgaacaaagcctctttcaaactccacggcgcagatccgaggagtttgggatttctgatatctcactacatacttcaacttcatacaatctctccacttttctttctagctatcaatcactcgcttactaccagtcatggcaggtctggcaccagaaggatcacaatatgatgctaagcaatatgatgccaaaatgaatgatctgcttgcaaatgatgggcaagatttcttcacaatgtatgaggaggtttttgaaacctttgattcgatgggattgcaagagaaccttctgaggggcatctatgcctatggttttgagaagccatctgcaatccagcaaagaggaattgttccattttgtaaaggccttgatgtgattcagcaggcacaatctggaactgggaaaacagcaactttctgttctggcattctccagcaacttgattatggtctggtgcaatgtcaagcattggtcctggctcccaccagggaactagcacaacagattgaaaaggttatgcgagcacttggtgattatcttggtgtcaaagttcatgcttgtgttggtggcacaagtgttcgtgaggaccaacgcattcttcaagctggtgttcatgttgttgttggcacacctggtcgtgtgtttgacatgttgagaaggcagtcacttcgtcaagattacattaaaatgtttgtcttggatgaggctgatgaaatgctttcacgtggttttaaggatcagatctatgatattttccagttgctgccatcaaaagttcaagttggtgtgttctccgctactatgccacctgaagctcttgagatcacaaggaagttcatgaacaagcctgtgaggatcttggttaagcgtgatgagcttactcttgaaggtatcaagcaattttatgttcaatgtcgataaggaggagtggaagctcgaaacactatgtgatctatatgagaccctagccatcactcagagtgtcatttttgttaacacccggcgcaaggttgactggctgacagacaagatgcgaggccgtgatcacacagtctcggctactcatggagatatggaccagaacactcgtgatatcattatgcgagaattcaggtccggctcttctcgtgttctcatcacaaccgatctcttggctcgtggtattgatgttcagcaagtttcccttgtcataaattatgatctgccgactcaacctgaaaactatcttcaccgtattggacgaagtggacggtttggaagaaagggtgttgctattaactttgtgacaagtgatgatgacagaatgctgtttgatatccagaagttctataatgtggtcgtcgaggagctgccatcgaatgtggccgatctcctttgatgagatttttttgtgatggtcgaggaaaatggtatcttattttgcttgtactatttgacgtattgatttcttttcattgctgtttagggtcgttaaagtttatgttcagagacatctctgacagtttaatctcacgtgggtcctccattattacaggttccacttgttatgaaaggattgtcaggtcgacttgttattttaaagccttgtttgcatgttgtgtttttctacatgttctgcaccattttctt

SEQ ID NO: 5156 - DNA, 742 bp, Solanum tuberosum
tcatgaacaagcctgtgagaattcttgtgaagcgtgatgagctcactcttgaaggtattaagcaattctatgtcaacgtcgataaggaagagtggaagctcgaaacactctgtgatctttacgagaccttggccatcacccagagtgtcatctttgttaacaccaggcgaaaggttgattggctcactgataaaatgcgtggccgtgatcacacagtatctgcaactcacggagacatggatcagaacactagagatatcattatgagggagttccgatctggctcatctcgtgtacttatcacaaccgatctccttgctcgtggtattgatgtccaacaagtctcccttgttattaactacgacctgcctactcaaccagaaaactacctgcatcgtattggtcgtagtggacgatttggaaggaagggtgttgctatcaactttgttaccaaggatgacgaaaggatgctttttgacattcaaaagttttacaacgttgtagttgaggagctcccagccaatgttgctgatctcctttgaggtgattttggctctgtgaggggaattgttccttccctacaggaagtagtctaatatatttattcagagtgaacaactgcaaattttgtctggtttttgttattttgtttttggaagtgtccaaataactttggatttggttgttgtttgaattttgtttatttgaactatttttctatggacgttaggcttttagttct

SEQ ID NO: 5157 - DNA, 805 bp, Pseudoroegneria spicata
  misc_feature (62)..(62): n is a, c, g, or t
  misc_feature (461)..(461): n is a, c, g, or t
  misc_feature (688)..(688): n is a, c, g, or t
agattacccgcaagttcatgaacaagcccgtgaggattcttgtcaagagagatgagcttacncttgagggtatcaagcaattctatgtcaatgtggagaaggaagagtggaagctggatacgctctgtgacctgtacgagaccttggcaattacccagagtgtcatctttgtgaacacccgccgcaaggtggactggctcaccgacaagatgaggggaagggaccacactgtttctgccacacacggagacatggatcagaacactagggacatcatcatgagggagttcagatctggttcttctcgtgtgctcatcaccaccgacctgctggcccgtggtatcgatgtgcagcaagtctcccttgtcatcaactacgacctgccgactcagcctgagaactacctccatcgcattggtcgtagtggtcggttcgggaggaagggagttgccatcaacttngtcacccgtgaagatgagaggatgctgttcgacatccagaagttctacaacgtggtcattgaggaactcccggccaatgtcgctgaccttctctagattatatcctaggaatgcagtaaggtgctcgataaagttcgtttttgttgaatatctcccaactctcagttttggagtggtaaggtctgggtctgtttgaatcgtggttaaggatggtgttttttcttgtnatgcaatgtccggaaatttttgtagtgcgtaggctttgccatctcctgggctagctgggatagagtgactctcatggagtattttacttttcgttgtgaagttagttttattgtcca

SEQ ID NO: 5158 - DNA, 1162 bp, Raphanus sativus
cgtgaggatcagcgcattctccaggccggtgtccatgtcgtcgttggaactccaggtcgtgtctttgacatgctccgaagacagtcacttcgctctgacagcatcaagatgtttgtcctcgatgaagctgacgaaatgctctcccgtggtttcaaggatcagatctacgacatattccagcttctcccaccaaagatccaggtcggagtgttctcagctactatgccaccagaggctctcgagatcacaaggaagttcatgagcaaaccggtgagaatcctggtgaagcgcgacgagctaactctcgaaggtatcaagcagttctacgtgaacgtggagaaagaagagtggaagctcgaaactctctgcgacctctacgagacgttagccatcactcagagtgtcatcttcgtcaacactcgtcgcaaggtggactggctcaccgacaaaatgaggagccgtgaccacactgtctcagcgactcacggagacatggaccagaacacgagagacatcatcatgagagagttcaggtctggttcttcccgtgttctcatcacgaccgatctcttggctcgtggtatcgatgtgcagcaagtctctctggtcatcaacttcgacctcccgactcagccggagaactaccttcaccgtatcgggagaagtggaaggtttgggaggaaaggtgtggcgatcaacttcgtgactcgtgacgatgagagaatgctttttgatattcagaaattctacaatgtggtcgttgaggagcttccctcaaacgtcgccgacctgctttgaagaagaagaagaagaacagaaaaaaccaccgttgttcgccgccggagaagaagtaaaaaggttacttgtttcgcaagcttcttgttttgatttttgacccatctttctctgtttctctctttgctcatcgacacctctttctcattttcgaacatatatgtctcatctgaacatgtttcttcttaaatctcatgcaatatttatttttactttcttgtttcatgcacaaagttttcataataagcgtagattttaatcagtatgcacatctttgttaaaatcagtattctaatcagtaagcacatctctttttttttatccttagtattttaatgtacaatatacaaacacaatacaattcttt

SEQ ID NO: 5159 - DNA, 1062 bp, Sorghum bicolor
aaggtcagcaacattggcaggcagctcctcaatcaccacattgtagaacttctggatgtcaaacagcatccgctcgtcgtcgcgggtcacaaagttgatggcaacacccttcctaccgaaacgaccactacgaccaatgcgatgcaggtagttctctggctgggtgggaagatcatagttgatgaccagggacacttgctgaacatcaataccacgagcaagcaggtcggtggtgatgagcacacgcgaggaaccagaccggaactccctcatgatgatgtctctagtgttctggtccatgtcaccgtgagtggcagagacagtgtggtccctgctcctcatcttgtcagtgagccagtccaccttgcggcgggtgttgacgaagatgacactctgggtgatggccagggtctcgtacaggtcacacagtgtgtccagcttccagtcttccttctccacattcacatagaactgcttgataccctcaagagtcagctcatctctcttcacaaggattctgacaggcttgttcatgaacttgcgggtgatctcaagggcctcagggggcatggtagcagagaagactccaacctgaatcttggctggaagaagttggaagatgtcgtaaatctgcattttcaccaaagaaaggaacatttcatcagcttcatcaagcacaaacatcttgatgttatcagggcggagggactgcctacgcagcatgtcaaaaacacgaccaggtgtaccaacaacaacatgcacaccactggcaagaatcctttgatcctcacggacagatgttcctcccacacatgcatggaccttaacacccaggtagtcaccaagtgcgcgcatgactttctcaatttgctgtgcaagctcacgggtgggagcaaggaccaaggcctggcattccaccaggccataatcaagctgctgcaagatcccagaacagaaagttgctgtttttcctgtaccagattgtgcttgctgaatgacatcaagccccttgcagaagggaacaattcctctctgctgaattgcagaaggcttctcaaaacc

SEQ ID NO: 5160 - DNA, 882 bp, Nicotiana tabacum
cagatttatgatattttccaactgctgccaccaaagattcaagtgggtgttttctctgccactatgccgcctgaggcccttgaaattactaggaagttcatgagcaagcctgtgaggattcttgtgaagcgtgatgagcttacgcttgaaggtatcaagcaattttatgtcaatgttgacaaggaagagtggaagcttgaaacgctttgcgatctttacgagaccttagccatcacccaaagtgtcatctttgttaataccaggcgtaaggttgattggctcactgataaaatgcgcagccgtgatcatacagtatctgcaactcacggagacatggatcagaacactagagatatcattatgcgagagttcagatcagggtcatctcgtgtgctcatcaccactgatcttttggcccgtggtattgatgtgcagcaagtttcccttgtgattaactatgaccttcctactcagccagagaactacctgcatcgtatcggtcgtagtggacgatttggaagaaagggtgttgctatcaactttgtcacaaaggatgacgaaaggatgctttttgacattcaaaagttttacaatgttgtaattgaggagttgccagccaatttggccgatcttctttgatgcggttttggttctgtgaggtgaatttcttctttacatgaagtaatttaatatcttattcttaggttagatagatttcaactgaacctataattgggaaatgcaagtgccatgatccgccatggaacctgtaattttccagtttggttggagtacctactatcaattttgtcggtgtgtctttgttttgtattgtaagtctaaaataactaagttttggatgtttcttgaatttttattgag

SEQ ID NO: 5161 - DNA, 1223 bp, Triticum aestivum
cttgggtgtgaaggttcatgcatgtgttggaggaacctcagttcgtgaggaccaaaggattcttgcaagtggagtgcatgtcgttgttggtactcctggtcgtgtgtttgacatgctccgcaggcagtctctgcgccctgacaacatcaagatgtttgtccttgatgaagctgatgagatgctttcccgtggtttcaaggatcagatttatgacatcttccagctgctcccagggaagattcaagttggtgtcttctctgctaccatgccccctgaagcccttgagattacccgcaagttcatgaataagccagtgaggattcttgtcaagagggacgagctcacccttgagggtatcaagcagttctatgtcaatgtggagaaggaagagtggaagctcgacacactgtgtgacctgtatgagactcttgccatcacccagagtgtcatctttgtgaacacccgccgcaaggtggactggctcaccgacaagatgaggggcagggaccacacagtctccgccactcatggagacatggaccagaacactagggacatcatcatgagagagttcagatcaggttcttcacgtgtgctcatcaccactgacctgcttgctcgtggtattgatgtccagcaagtgtccctggtcatcaactatgacctcccgacccagccagagaactacctgcatcgcatcggtcgtagtggtcggtttggaaggaagggtgtggccatcaactttgtgacccgtgaagatgagaggatgctgtttgacatccagaagttctacaacgtggtgattgaagagctcccagccaacgttgccgaccttctgtgatcgggcgggctgttgagaacatatggtaagggggtcctgacagggctttgtttttgttgaagtatcaccaactttcttgtctgtgggtgggggggttcaagtgataaatggtctgctggggttctactttaaagtcgtggtcgtggacaatttgggatttattaagccatgttttgggaatttttgtagttgctaggctgtggttctatgtgctgaggagggaggcgctgctgctcatgttgctgttgctggagtcctcactttatttgttaagactatgtaatgaccgaatgatgttatttgtttgtgtcatccttgactctttacctaccgcatgtaatcctgcaatcggtactagtaatgctatggttattaaaaactg

SEQ ID NO: 5162 - DNA, 1032 bp, Triticum aestivum
gttgcgcaggcaatccctccgcccagataacatcaagatgtttgtgttggatgaagctgatgagatgctttcacgtggtttcaaggatcagatctatgatatcttccagcttcttccatcaaagattcaggttggggtgttctctgctaccatgcctcctgaggcccttgagataacccgcaagttcatgaacaagcctgtgaggattcttgtcaagagagatgagcttacccttgagggtatcaagcaattctatgtcaacgtggagaaggaagagtggaagctggatacactctgtgacctgtatgagaccttggcaatcacccagagtgtcatctttgtgaacacccgccgcaaggtggactggctcaccgacaagatgaggggaagggatcacactgtctctgccacgcacggagacatggaccagaacactagggacatcatcatgagggagttcagatctggatcttctcgtgtgctcatcaccaccgacctgctggcccgtggtattgatgtgcagcaagtctcccttgtcatcaactacgacctgccgactcagcctgagaactacctccatcgcattggtcgtagtggtcggttcgggaggaagggagttgccatcaactttgtcacccgtgaagatgagaggatgctgttcgacatccagaagttctacaacgtggtcattgaggagctcccggccaatgtcgctgaccttctctagattatatcttaggaatgcagtaaggtgcttgataaagttcgtttttgttgaatatctcccaactctcagttttggagtggtaaggtctgggtctgtttgaatcgtggttaaaggatggtctgagttttttttctatgcaatgtccggaaatttttgtagtgcgtaggctgtgccatctcctgggctagctgggatagagtgacatttattttactttccgttgtgaagctattttgcccatgtttgagctagtatatttttccttagtatatgtcagatctttctatttaaactgaaaaaaaaaa

SEQ ID NO: 5163 - DNA, 728 bp, Triticum aestivum
  misc_feature (126)..(126): n is a, c, g, or t
acatggaccagaacactagagacatcatcatgagggagttccggtctggttcctcgcgtgtgctcatcaccacccgacctgcttgctcgtggtattgatgttcagcaagtgtccctggtcatcaantatgatcttcccacccagccagagaactacctgcatcgcattggtcgtagtggtcgtttcggtaggaagggtgttgccatcaactttgtgacccgcgacgacgagcggatgctgtttgacatccagaagttctacaatgtggtgattgaggagctgcctgccaatgttgctgaccttctgtgatcattttgaagaaaaactgaacaaaaaaaagggaggcgaggggaactgataaggcttggttttgttgaaatatcgcgggggaggaagtgatatggtcggtggggtttctatgttaaagtcgtggtcatggacaatttgtgtttttctttatgccatgttttgggaatttttgtagctgcctaggccttgtggtatgtgctgctgtgggggttcattagtatcaagaggaagacgctgctggcgctggagtgtttttctctttattagtactttgtttaaaactatgtatgaccgaatgatggtatttatttgtgtcatccttgactcttattctgctgcaaccagatgtatcgttccatgtgtttgcagcactttttttgctgctctgagtaaacctttttactcggttgagcttgtca

SEQ ID NO: 5164 - DNA, 431 bp, Musa acuminata
ggaccagaacaccagggacattataatgcgtgaattccgctcaggctcctctcgtgttctcatcaccaccgaccttcttgctcgtggtattgatgtccagcaggtctcgctggtcataaattatgatctaccaactcagccagagaactacctccaccgtattggacgaagtggacggtttggaagaaagggtgttgcaatcaactttgtcacacgtgatgacgagaggatgctttttgacatccagaagttctacaatgtcgtgatagaggagctgccttccaatgttgctgatctcatctaaagcgtgttatgtgatgctttatatttatggcttttgtaggtctgttttctttttgagtcagcatcaaacttttatctgttttcagcagtgagcttggactgttttctttgatagacaatttattgac

SEQ ID NO: 5165 - DNA, 1089 bp, Arabidopsis lyrata
ggttttgagaagccttctgctattcagcaaagaggaattgtccccttttgcaaaggtcttgatgtgattcagcaggcccagtctggtactgggaaaacagcgactttctgctctggtgtcttgcagcagctggacttctcccttgtccagtgtcaggctttggttctagctccaactagagagcttgctcagcaaattgagaaggtcatgagggccctcggtgattaccttggtgtcaaggttcacgcctgtgttggtggaaccagtgtccgtgaggatcagcgtatcctccaagctggtgtccatgttgttgttggaactccaggacgtgtctttgacatgttgaagaggcagtctctccgtgctgacaacatcaagatgtttgttcttgatgaagctgatgaaatgctctcccgtggtttcaaggaccaggtttgctggtttctgtgattttttcagatctatgacatattccagcttctcccaccaaagatccaagttggtgtgttctccgcaacaatgccaccagaagctcttgagatcacaaggaagttcatgagcaagccagtgagaatcttggtgaagcgtgatgagcttacccttgaaggtatcaagcagttctatgtcaatgtcgagaaagaagagtggaagctcgagacactctgtgatctctacgagactctggccatcactcagagtgtcatcttcgttaacaccaggcgtaaggttgattggctcacagacaaaatgagaagccgtgaccacacagtctcagcaactcacggagacatggaccagaacaccagagacatcatcatgagagagttcaggtctggttcctcccgtgttctcatcaccactgacctcttggctcgtggtattgatgtccaacaagtctctctggttatcaacttcgatctcccaactcagccagagaactacctccaccgtatcggaagaagtggaaggttcgggagaaagggtgtggcgatcaattttgtgacccacgatgatgagaggatgctgtttgatattcagaagttctataacgtggttgtcgaagagctgccttcgaacgtggccgatctg

SEQ ID NO: 5166 - DNA, 719 bp, Cicer arietinum
catttttgtgaacacaaggcgcaaagtggactggctcaccgacaagatgcgaagcaacgatcatacagtctcagccactcacggtgacatggaccagaacactagggatatcatcatgcgcgagttccggtctggctcttctcgagttctcattaccaccgaccttttggcacgtggtattgatgtgcaacaagtgtctttggtcataaactatgatctcccaactcaacctgaaaactatcttcaccgcataggtcgtagtggtcgatttggaaggaaaggtgttgctataaactttgtgaccatggatgataccagaatgctggctgatattcaaaaattctacaatgtgagtatagaggagctgccatcaaatgttgctgatttactctgatgagttaatttttgttctatgtaaaatcatctaggaatttgctcttggacaagtcccacctttttgaattttatttatttattttttttttttactcttttctacacttttttggattataatttattggtcctatcaaatttttaaatggacttctattcaaatttgttttaaaatttaattacagtagttcttttttttcgcaaacaaaaatttcatattaaaatatatttcttcagctctgttaaactttgctattataataaatgatatttatttcttattttgtgttatacattttgatatttcctctttttgaatcaac

SEQ ID NO: 5167 - DNA, 1058 bp, Cleome spinosa
attacctcggtgtcaaggttcatgcatgtgttggtggtactagtgtccgtgaggaccaacgtattctccaggctggtgtccatgtcgtcgttggaacacctggtcgtgtctttgacatgttacgcaggcaatccctccgccctgaccacatcaagatgtttgtccttgacgaggctgatgagatgctctcccgaggtttcaaagaccagatctatgacatcttccagcttctcccacccaagatccaggtcggcgtgttttcagccacaatgccaccagaagcactcgagatcacaaggaagttcatgaacaaacctgtgaggatcttggtgaagcgtgacgagctcacccttgagggtatcaagcagttttacgtcaatgttgagaaggaagagtggaagctcgaaacgctctgcgatctttacgagactctcgccattacccagagtgtcatctttgtgaatacccggcgcaaagtggactggctaaccgacaagatgagaagccgtgaccacacggtctcggccactcacggtgacatggaccagaacacccgagacatcatcatgcgggagttcaggtcgggatcttcccgtgttctgataacgaccgatctcttggcccgaggtatcgatgtacagcaagtctcactggtcataaacttcgacctcccgacccagccggagaattacctccaccgtatcggaagaagtggaaggttcgggagaaagggtgtggccataaactttgtgactcgggacgatgagagaatgctttatgatatccagaaattctacaacgttgtcgtggaggagcttccctcgaacgttgccgatcttctgtgagagagagagagttgcctggagaagaaggttgcttgcttcgcaaggttctgtttgattttgaccctactctcaagcggttctctttttcttattttattataaaatctagttaaaattttatttaaattttgtagtttttttccgggaagtcggtcttataaaaagaatatttggtgtttccccctaacgatcatatcactcttggtcatccgt

SEQ ID NO: 5168 - DNA, 729 bp, Cleome spinosa
cactagccatcacccagagcgtcatctttgtgaacacgagacgcaaggtcgattggctcacggaccagatgcgggcccgtgaccacactgtctcagccacccacggggacatggaccagaacacccgggacatcatcatgcgggagttccgctcgggatcctctcgcgttctcataaccacagacctgttggccagaggaatcgatgtccagcaagtttcactcgtcatcaactacgatctcccgactcagcccgagaattacctccacaggataggtcgtagcggacggttcgggaggaaaggagtggccatcaacttcgtgactcgagatgacgagagaatgcttgcagatatccagaagttctacaacgttgtgatcgaagagcttccggctaatgtggcggatttgatttgatgaagggtttcagtccaacgatcttcttgcaaaacccggaaaaaaaccaccgttgaaggtaatatctgccaaatgtgtctgtcactctatgtgtgtgtgtgtgtatgtatgtgtgaggttaaaagacggtctctaacataattaaagtgccggttatatccggttcggtacttgaaaccgatatatcgcttgaaatgtgttcttggctacgaaattttgtattagtagggtttggttttgcggtttcctgggcttaaccatttggttaagttccggttttaactgtgctatatggtggttatattatatatat

SEQ ID NO: 5169 - DNA, 926 bp, Unknown
  Sequence found in Organisms: Ipomoea nil, Ipomoea nil
ctctgctactatgccacctgaggctcttgaaatcacccgaaagtttatgaacaagcctgttaggattcttgtgaaacgtgatgagctcactctggaaggtatcaagcagttctatgtcaatgtcgacaaagaggagtggaagctcgatacactttgtgatctttatgagacactggccatcacccagagtgtcatctttgttaacaccaggcgaaaggttgattggctcaccgacaaaatgcgtagccgtgatcacacagtttctgcaactcacggggacatggaccagaacactagggacatcatcatgcgtgaatttcggtctggttcttccagagtgcttatcaccactgatctcttggctcgtggtattgatgtccaacaagtgtcacttgtgatcaactacgacctccctactcagccagaaaattacctccaccgtattggacgaagtggacgatttggaaggaagggtgtggctatcaactttgtcaccaaggatgacgaaaggatgctttttgacatacagaagttttataatgttctagtcgaagagttgccagcaaatgtcgctgatctcctgtgattgggtcaaaggcgagttgaattgttcctcaattgaagctctctactatttcatcacttatttcataggctagttgtgtactggacttggtgttgggaaattctggcctttgtatttcgatagggggttgcagtttcccaatttggtcacaagtccaaatctactactggaaattttgttggttttgtctttgtactgtaagtttcagaaaagaacaaaaaaaacccaggatttgaatgttgtttgaggtttatttattttgtttaaacacttatctttatttctgtttattgagggcatttgttttctcagtgtctaaagtttttcttgaagagagatt

SEQ ID NO: 5170 - DNA, 1046 bp, Lactuca sativa
ggtgtgttttccgctacaatgccacccgaagccctagaaatcacccggaaattcatgaacaaacccgtgagaattttggtgaaaagagacgaacttaccctcgaaggtatcaaacaattttacgtgaacgttgaaaaggaagaatggaaactcgaaacactctgtgacctttacgaaaccctagcaatcacccagagtgtcattttcgtaaatacgcgtcgaaaggttgactggttgaccgacaaaatgcgttcccgggaccacactgtgtccgccacccacggtgacatggaccaaaacacacgtgacatcatcatgcgggagtttcgatcgggatcttcacgcgtgttgatcactacagatcttttggcacgtgggattgatgtgcaacaggtgtcacttgttatcaattatgatcttccaacacagcctgagaattatcttcataggattgggcgaagtgggaggtttgggagaaagggtgtggccattaattttgtcactttggatgatgaacggatgcttgcggatattcagaagttttataatgttgtggtggaggagttgccttcgaatgttgcggatctcatataagattgtgaagtaagaaagaaaaaggtttagaggttgtttttgggatttactaatactatttactattattattattattattattgttattgttatcggttttgtttgttttaagttatgtttatgatgatggtggaagactttttgtgttataagatattatgcgaattggcaatgtgtttcttcttgttgtgttgccaatttttgcgacttgtgtttgtacttttgaaagtttcttttttacctttaaaaaaaaaaaataaaaaagaaacccccaaaatgggaaggggaaacccccccccccaaaattgttaaaatttttgaaaattccaaaaaaatatttttctcgccccgcttgggccccgtaaattctaaattccagggggtttatgcatggggccgcatttccaacacacggaatggggggcctttttacaaggtctagtccgacc

SEQ ID NO: 5171 - DNA, 823 bp, Pennisetum glaucum
acccgtcgaaaggtggactggctcactgacaagatgaggagcagggaccacactgtttctgccactcacggtgacatggaccagaacactagggacatcatcatgagggagttcaggtctggttcatcccgtgttctcatcaccaccgacctgcttgcccgtggtattgatgttcagcaggtgtccctggtcatcaactatgatctccccacccagcctgagaactaccttcatcgcattggtcgtagtggtcgtttcggtaggaagggtgttgccataaactttgtgacccgtgatgatgacaggatgctgtttgacatccagaggttctacaacgtggtgattgaggagctgccggccaatgttgctgaccttctgtgatcaagtttgaggaaaaacaaaacagaacaaaaaaaagtggtaaggggacctgataaggcttgtttttgttgaaatatcgccatgtgtgggttgggtggagtgacaaggtcggtggggtttctatgtttaagttgtggtcatggacaatttgtgatttttttcttatgccatgttttgggaatttttgtagctgcctaggcctgtggtatgttctactgtgggggttcattagcatggagggggagacgttgctggtgctggagtcttttcgttttagtatttttgtttaaaactatgtatgaccgaatgatggtatttatttgtgtcatccttgactcttgtattctgccgcaatcgtatgtatcctgcaatcagcactggtctttgttattctgtgcgagtaaaacctgtttactcttatactgtgcttgctgctgttgga

SEQ ID NO: 5172 - DNA, 602 bp, Cajanus cajan
tatttttgtgaacaccagacggaaggttgattggctgactgacaagatgcgaagccgcgatcacacagtctcagcaactcatggagacatggaccagaacactagggacattattatgcgagaattccgttctgggtcttcccgtgttttaataactactgatcttctagctcgtggtattgacgtgcagcaagtgtcattagttataaattatgatctcccaacacagcccgagaactatcttcatcgtattggtcgtagtggaaggtttggtaggaaaggtgttgccatcaactttgtcacaaaggacgatgaaagaatgctgggtgacatccagaagttctacaatgtgataattgaggagctgccttcaaatgttgcggaacttctgtgatgagattttttcttccatcatactagaggaaagttggtttctgagataagtgttatgtaatgttccccctttttgccccatttgttgtatttctgtttttaaaccttgtttgacctttttaataggtgtagtaaattaatttacattgtcagtcgtctgagtactcttaagtgataagtacttgcaatgtggaatccattattgtctt

SEQ ID NO: 5173 - DNA, 881 bp, Cajanus cajan
gcgggaatcacaaggaaatttatgaacaaacctgtgaggattctggtaaaacgtgatgagcttaccttggagggaattaagcaattctttgtcaatgtagataaggaggaatggaagctcgagacactatgtgatctttatgaaactttggcaatcactcagagtgttatctttgtgaacaccagacgcaaggtagattggctcacagacaaaatgcggggtcgtgatcacacagtttcagctactcatggagatatggaccaaaacacaagggatataattatgcgggaattccgttctgggtcctcccgtgttcttattaccacagatcttttggcccgtggtattgatgtccagcaagtctcacttgttataaattatgatctgccaactcagccagagaactatcttcatcgaattggtcgtagtggtcggtttgggagaaaaggtgttgctatcaattttgtgaccaaggatgatgaaaggatgctgttggacatccaaaagttttataatgtggtgatcgaggagctgccagccaatgtagctgatctcatttgatttggtctttgcttcattggtaatgctttaattatggaggccgcagtcattattttattgtcatggcccagggcctttctctagcaagatttgaacttaaccccaaaccagtggatttgaaatgggcattttgatctctaattttgggtctagcagaatgcgttgtcgcaattttgtttcgtttgtttgtatctgtcttgctaaaaattgttgaatgccggtttctctgtgttttgttttatacccgtgagggtggttgtgtaaatttaaaacttttctatctttacgttggaaatgtactggacttgttctcattgtca

SEQ ID NO: 5174 - DNA, 677 bp, Salvia sclarea
gcacgaggatcacgcagagcgtcatcttcgtcaacacgaggcgcaaggtcgactggctgactgacaagatgcgtggccgcgaccacaccgtctccgccacccacggtgacatggaccagaacacgagggacatcatcatgcgggagttcagatccggctcctcccgcgtcctcatcaccacggatctcctagcccgtggtatcgacgtgcagcaggtctccctggtcatcaactacgacctgccgacccagccggagaactacctccaccgtatcggacgaagtgggcggttcgggaggaagggtgtcgccattaactttgtgaccaaggacgacgagcgcatgctcttcgacatacaaaagttctacaacgtcacggtggaggagctcccggccaacgttgctgaccttctctaggagagagagagggatcgaggcgccgaggttaattttccttcgtttctgagtaacttatgatgcccttattttcctaggttagtttttaacgcgtggaagggagatttttagtgccattatttggaggggacttccatctcccaacgttattgcagctccaaactactacaaaatttttggtttttgtcttgtgttgtaattgtcaaaaaaaatttggatgatatttggctttcttattcgagtatttctaagttaaatctt

SEQ ID NO: 5175 - DNA, 831 bp, Salvia sclarea
accatgccaccggaggcccttgaaatcacaaggaagtttatgaacaagcccgtccgcattctcgtgaaacgggacgagctaacactcgagggtattaaacagttctatgtaaacgttgacaaggaggagtggaaactcgaaaccctctgtgatctctatgagaccttggccatcacccagagtgtcatcttcgttaacacgaggcgcaaggttgactggctcaccgacaaaatgcgcagccgtgatcacaccgtctctgccacccacggtgacatggaccagaacactagagatatcatcatgagggaattccgatccggctcttccagagtcctcatcaccaccgatctactggcccgtggcattgacgtccagcaagtctctctcgtcatcaactatgatctgccgactcaacctgagaactacctgcatcgtattggacgaagtgggcggctcgggagaaagggcgtggccataaactttgtcaccaaagatgacgaacgcatgctcttcgacatccagaagttctataacgtcgtagtcgaggagctgccggcgaacgttgcagacctcctgtgatgcagttttgaggcccagaggttaatgctgcttgtttcaagcaagttgcaatctcttatttcatatataggctagtttatatgtgtaatggatcatcaatgggggctaagttcaaactactgtttcacaaatttttggtttttagctcttatatgtattttattgtctaaaataacttcagtttgtatgaggtgatttaatgagcctttgtagttggaattgtatttgtgaggttgtgttcttgcctcgtgc

SEQ ID NO: 5176 - DNA, 664 bp, Solanum phureja
tgcacctgtattctttgtctccagatctatgatattttccagctcttgcctcctaagattcaggttggtgtcttctctgctactatgccccctgaggcacttgaaatcacaagaaaattcatgaacaaacctgtgaggattcttgtgaagcgtgatgagctgacgttagaaggtatcaagcagttctatgtgaatgtggacaaggaagaatggaagcttgaaaccctgtgtgacctgtatgaaacattagccattacccagagtgtgatctttgtgaatactcgtcgcaaagttgactggttgacagacaagatgcgaagcagagaccatacagtgtcagctacccatggtgacatggaccagaacactagagatattataatgcgtgaattccgttctgggtcctcgcgtgttctcatcaccactgatcttttggcgcgaggaatcgatgtccaacaagtctcgctggtcataaattatgatctcccgactcagcctgagaattatcttcatcgtattggacgcagtggaaggtttggtaggaagggtgtggccatcaactttgtaacaaaggatgatgagaggatgctgtctgatattcagagattttacaacgttgttattgaggagctgccagcaaatgttgctgatctcctgtaagaag

SEQ ID NO: 5177 - DNA, 627 bp, Musa acuminata
aggattcttgtgaaacgagatgagcttactttggagggtatcaaacaattctatgtcaatgttgagaaggaagaatggaagcttgagaccctctgtgacctctacgagacattggccatcacgcagagtgtgatttttgtcaatactcgacgtaaggtggactggcttactgacaaaatgaggagcagggaccatactgtctcagcaacccacggagatatggatcaaaatactagggacattataatgcgtgagttccgctctggctcgtcccgtgtactcatcaccactgatcttcttgctcgtggcattgatgtccagcaggtctccctggttataaactatgatctgccaacacagccagaggactatcttcatcgtattgggcgaagtggtcgttttggaagaaagggtgttgcaatcaactttgtcactgttgatgacgaaagaatgttgtttgatatccagaggttctacaatgtggtgattgaggagctgccatccaatgtcgcagacctaatctgatgttatttttgttaagctggatgtttaatctatatatgtcctgttagtttagtaataaactcgttgatggcatgtcttttgaccatcttgaactgtgataaa

SEQ ID NO: 5178 - DNA, 858 bp, Ocimum basilicum
tgttggatgaggctgatgaaatgctctcccggcgttttcgaggatcagatttacgacatcttccagttgctgcctcccaagattcaagtcggtgtattctctgctaccatgccaccagaggctcttgagatcacaaggaaattcatgaacaagcccgtccgcatcctcgtgaagcgcgatgagctaaccctcgaaggtatcaagcagttctatgtcaacgtcgacaaggaagaatggaagctcgaaaccctctgcgatctctacgagactttagccatcacacaaagtgtcatcttcgtcaacacgaggcgcaaggtggactggctgaccgacaaaatgcgcagccgtgaccacaccgtctctgccacccacggtgacatggaccagaacacgagagacataatcatgcgggaattcagatcaggctcatcccgtgtcctcatcaccaccgatctgttggcccgtggtatcgacgtgcagcaagtctctctagtcatcaactacgatcttccgactcagcccgagaactacctccatcgtatcggacgaagtgggcggttcgggaggaagggtgtggcaataaactttgtgaccaaggacgacgagcgcatgcttttcgacattcaaaagttctacaacgtgctagtggaggagctcccagccaatgttgcagaccttctctaaagaggtttttgttttatctgagggtaattttccttgtcttggggagtaactttatttatcttgttttgctagattagttttaacgtgtgattgggagattttaagtgccattatttggagaggacttccatctcccaacgttattgcagttttcaactaactattgagaaattt

SEQ ID NO: 5179 - DNA, 796 bp, Ocimum basilicum
tgttggatgaggctgatgaaatgctctcccggcgttttcgaggatcagatttacgacatcttccagttgctgcctcccaagattcaagtcggtgtattctctgctaccatgccaccagaggctcttgagatcacaaggaaattcatgaacaagcccgtccgcatcctcgtgaagcgcgatgagctaaccctcgaaggtatcaagcagttctatgtcaacgtcgacaaggaagaatggaagctcgaaaccctctgcgatctctacgagactttagccatcacacaaagtgtcatcttcgtcaacacgaggcgcaaggtggactggctgaccgacaaaatgcgcagccgtgaccacaccgtctctgccacccacggtgacatggaccagaacacgagagacataatcatgcgggaattcagatcaggctcatcccgtgtcctcatcaccaccgatctgttggcccgtggtatcgacgtgcagcaagtctctctagtcatcaactacgatcttccgactcagcccgagaactacctccatcgtatcggacgaagtgggcggttcgggaggaagggtgtggcaataaactttgtgaccaaggacgacgagcgcatgcttttcgacattcaaaagttctacaacgtgctagtggaggagctcccagccaatgttgcagaccttctctaaagaggtttttgttttatctgagggtaattttccttgtcttggggagtaactttatttatcttgttttgctagattagttttaacgtgtgattgggagattttaagtgccatt

SEQ ID NO: 5180 - DNA, 1491 bp, Centaurea maculosa
  misc_feature (227)..(227): n is a, c, g, or t
  misc_feature (284)..(284): n is a, c, g, or t
  misc_feature (419)..(419): n is a, c, g, or t
  misc_feature (422)..(422): n is a, c, g, or t
  misc_feature (440)..(440): n is a, c, g, or t
  misc_feature (455)..(455): n is a, c, g, or t
  misc_feature (527)..(527): n is a, c, g, or t
  misc_feature (617)..(617): n is a, c, g, or t
  misc_feature (640)..(640): n is a, c, g, or t
  misc_feature (824)..(824): n is a, c, g, or t
  misc_feature (874)..(874): n is a, c, g, or t
  misc_feature (891)..(891): n is a, c, g, or t
  misc_feature (910)..(910): n is a, c, g, or t
  misc_feature (912)..(913): n is a, c, g, or t
cggtccggattcccgggacttcctcaactcctacggccacccgaggagtttgagaaaaccctaaaaagcctccccaaatctctcttttcaatctttcctccaatcttcaaaattcagtcatggcaggcgtagcaccagaaggttctcagtttgatactcgtcaatttgactcaaaaatgaatgagctgctgtcgaccgacgggcaggacttttttacatcatatgangaggtttatgaaagttttgatgccatgggtttgcaagaaaatcttttaagaggcatntatgcttatggttttgaaaagccatcagcaattcagcagagaggtattgtcccattctgcaagggtcttgacgtaattcaacaagctcaatctggaacagggaagaccgcaaccttttgctctggtatccttcancanctcgactacaacgtggtngagtgtcaggccttngttctggcacccactcgtgaacttgcacagcaaatcgagaaagttatgcgagcacttggggactacctcggngtgaaggtccatgcttgtgttggtgggaccagtgttcgtgaagaccagcgcatcctctcggctggtgttcatgttgtcgttggtactccnggacgtgtctttgacatgctcangagcagtcacttcgtgctgattacattaagatgtttgtgttggatgaagccgatgaaatgctttccagaggtttcaaggatcagatctacgatatcttccaattgttgccatcaaaggtccaagtcggagtgttctccgccaccatgcctcccgagccctcgagatcacccgcagtcatgacanagtcagatctcgtcaaacgtgacgagctcaccctcgaagtatcaaacagntttacgtcacgtgagangagaatggaagctcgagancnnctgcgatctctacgaaaccctagccatcacccagagcgtcatctttgtcaacacccgacgaaaagtcgactggctgaccgacaagatgcgcagccgtgaccacaccgtctcggctacccacggagacatggaccagaacacccgtgacatcatcatgcgggagttccgatccggatcctcccgggtcctcatcaccaccgaccttttggcccgtggtatcgatgttcagcaggtctcgttggtcattaactacgaccttccgacccagccggagaactaccttcacaggattggtcgaagtgggcggttcggaaggaagggtgttgcgattaactttgtgacgttggatgacgaaaggatgcttgcggatattcagaagttttacaacgtggtggtggaggaactgccatcaaatgttgctgatctgatctgatcgtgatgatggattagaagagattttggttgggtggaaaaagaaaaaggttagtttttgaaatctgttatcggttttgtttgttttaagttattatgatgattattatgagtatgatgatgaaagactttttttttaaagatgt

SEQ ID NO: 5181 - DNA, 979 bp, Cichorium intybus
tcaacggatcctttccgccggcgttcatgtggttgttgggactcccggccgtgtttttgatatgctgcgaagacaatctcttcgtcccgattatatcaacatgtttgtgcttgatgaagctgatgaaatgctttctcgaggcttcaaagatcaggtgatattccatactcaattttagagaatttgttgaatgtgatctaagacggttattgttttttgcattcgattcagatctacgatatatttcagctcctaccttcaaaggttcaagtcggtgtattctccgccaccatgcctccggaagccctagaaatcacaaggaagttcatgaacaaacctgtccggattctggtgaaacgcgacgagctcactttagaaggtatcaaacaattctacgtcaacgtcgaaaaggaagaatggaagctcgaaacactctgcgatctgtacgaaactttagcgatcactcaaagcgtcatcttcgtgaacacgcgacggaaggtcgattggttgaccgacaaaatgcgcagtcgtgaccataccgtctccgccacgcacggagacatggaccagaacactagagacattattatgcgggaatttcgttctggatcgtcacgagtcctcatcaccaccgatctgttagctcgtggaatcggtgtgcagcaagtttcgcttgtgattaactacgatcttccgacgcagccggagaattatctccaccgtatcggacgtagcggaagatttgggcgaaagggtgttgcgatcaattttgtgaccagggaagatgagagaatgctttttgatattcagaagttttacaatgtcgttgtggaggagcttccatcaaatgttgcagatctgctctgaggttaggtattcttttttgatgttatttgttttttgttttcagtcagaagattttgggagagttctaatttttgtgcacatttttttgttatctaattcaatagtgaatcgg

SEQ ID NO: 5182 - DNA, 1692 bp, Cucumis melo
  misc_feature (85)..(85): n is a, c, g, or t
  misc_feature (189)..(189): n is a, c, g, or t
  misc_feature (192)..(192): n is a, c, g, or t
  misc_feature (321)..(321): n is a, c, g, or t
  misc_feature (385)..(385): n is a, c, g, or t
  misc_feature (479)..(479): n is a, c, g, or t
  misc_feature (495)..(495): n is a, c, g, or t
  misc_feature (582)..(582): n is a, c, g, or t
  misc_feature (1094)..(1094): n is a, c, g, or t
  misc_feature (1396)..(1396): n is a, c, g, or t
  misc_feature (1523)..(1523): n is a, c, g, or t
  misc_feature (1546)..(1546): n is a, c, g, or t
  misc_feature (1645)..(1645): n is a, c, g, or t
  misc_feature (1648)..(1648): n is a, c, g, or t
  misc_feature (1653)..(1653): n is a, c, g, or t
agtccttaagcattagcctccttttcaactccacggcgcagatccgaggagtttctcaatctctcgctatcttccaacgctttcnaatcttcttcaaatcctttcatctttcactgatctacagatatggctggtttggctcctgaaggttctcaatttgatgcacgtcagtatgacacaaaaatgaanganttactttcagctgatggacaagatttcttcacttcatacgatgaagtttatgacagttttgattctatgggcctgcaagaaaaccttctcagaggaatctatgcctatggttttgagaagccatctgcnattcaacaaaggggaattgttcctttttgcaaagggcttgatgtgatccaacaagcccagtctngaaccgggaagactgcaactttttgctctggcattttgcagcaacttgattatggtcttgtgcagtgccaggctttggtcttggcacccactanggaacttgcacaacanattgagaaggttatgcgagcccttggtgattatcttggtgtcaaggttcatgcttgtgttggtgggacgagtgtacgtgaagaccancgcattcttcaagctggtgttcatgtagttgttggtacacctggtcgtgtgtttgatatgttgcgtagacaatcacttcgccccgactacattcggatgtttgtattggatgaagctgatgaaatgctttctcgtatttaaggatcagatttatgatatcttccagcttctaccatccaagattcaggtaggggtgttctctgctacaatgcctcctgaagcccttgagatcaccagaaatttcatgaacaagcctgttagaattcttgttaaacgtgacgagctcaccttggaaggtatcaagcagttctatgtcaatgttgacaaggaagactggaagcttgagacactctgcgatctttacgagactttggccattacacagagtgtcatcttcgtcaatactcgacgtaaagttgattggctcaccgataggatgcgaaaacgtgaccacactgtatctgctacccatggtgacatggaccagaacacccgagatattattatgcgtnagttccgttcaggttcttctagggttctgattaccactgatctgttggcccgtggtattgatgtccagcaggtttctcttgttattaactatgatctgccgacacaaccggagaactaccttcatcgtattggacgaagtggacgatttggaagaaagggtgttgcgatcaactttgtaacgacagaggacgaaagaatgctatttgacattcagaagttctacaatgtgataattgaagagctgccagcaaatgttgctgatcttctgtgagagaagagagagaagagaagagaagagagngtaatattgtggtagactgaggcgtggttttctccttgaagaacttcaaagcttttttttattcgacctcttttttatcatctctctcttttttttttttttttttagtgtcttaaattaaaatatncttggaacctataatctgacctngggaaatggtgtggcctgcaccactgcaatatataagattgtcaaattacctttatggtaaattatgggcctttttgtttctttgttggggttttgtantgnatttnaggttttttttgttgccttatttccctttccaagttatt

SEQ ID NO: 5183 - DNA, 1021 bp, Arachis hypogaea
gcagacagtcacttcagccggatcacattaaaatgtttgtgttggatgaggccgatgaaatgctttcaaggggttttaaagaccagatctacgatatattccagttgttgccatcgaagattcaggttggagttttctctgccacaatgccccctgaggcccttgaaattactagaaagttcatgaacaaacctgtgaggatccttgtgaagcgcgacgagctcactttggagggtataaagcagttttatgtcaattgtgagagagaggaatggaagctcgacacactttgtgatctgtacgagacattagccattacccagagtgtcatttttgtcaacaccagaaggaaggtagattggttgacggacaagatgcgaagccgagaccacacggtgtcagccacccacggagacatggaccagaatacgagggacatcattatgcgggagttccgttctgggtcttcccgtgttctgataacaactgatcttctggcacgtggtattgatgttcagcaagtgtctctcgtaataaactatgatctccctacacagcccgagaactatctccaccgtattggtcgtagtggtcggtttggtagaaagggtgttgccatcaactttgtcacgaaggatgatgaaagaatgctgtttgacatccagaagttttataatgtgcaaatcgaggagctgcctgcaaatgttgctgaactcctctgatgagattgtcttccaacatgtctgagaaaagctagtttatgtttggttgtgttatgtaatgtttcttctcccccttccccaacccctctttttttcctcgttcggtatttcctttgaaacccttttttaatgggcctagtaagtttatttagattgtcagtcgtttggatatccaaagtgtaaggtacttgaaattagaaaccgattattgcccattttggtgtatggctgtgtcgcacgtttctgtaaggtaatttatctaatggtactttttgtggcatatgtttggccttttcttt

SEQ ID NO: 5184 - DNA, 657 bp, Saccharum officinarum
  misc_feature (14)..(14): n is a, c, g, or t
  misc_feature (524)..(524): n is a, c, g, or t
cgaagattcaggtnggtgttttctcagctaccatgccccctgaggccctcgagatcactcgcaagttcatgaacaagcctgtgaggattcttgtcaagagagatgagctcacccttgagggtatcaagcaattctatgtcaatgtggagaaggaagattggaagctcgacactctatgtgacctgtatgagaccctggctatcacccagagtgtcatctttgtgaacacccgccgcaaggtggactggctcacagacaagatgaggagcagggaccacactgtctcagccacgcacggtgatatggaccagaacactagggacatcatcatgagggagttcaggtccgggtcctcccgtgtgctcatcaccactgacctgctcgcccgtggtatcgatgtccagcaggtctcacttgtcatcaactatgacctgccgacccagcccgagaactatcttcaccgcattggtcgtagtggtcggttcggaaggaagggtgttgccatcaacttcgtcacccgtgangacgagcggatgctgtttgacatccagaggttctacaacgtgaccattgaggagctgccagccaacgtcgctgaccttctctagatgatgttctctagataatatggctgctaaaggttctggataaagaagt

SEQ ID NO: 5185 - DNA, 885 bp, Panicum virgatum
atgtgaatgtggagaaggaagattggaaactggacacactatgtgatctgtatgagaccctggccatcacccagagtgtcatcttcgtcaacacccgccgcaaggtggactggctcactgacaagatgaggagcagggaccatactgtttctgccactcatggtgatatggaccagaacactagggacatcatcatgagggagttccggtctggttcatcccgtgtgctcatcaccaccgacctgcttgcccgtggtattgatgttcagcaggtgtccctggtcatcaactacgatctccctacccagccagagaactacctgcatcgcattggtcgtagtggtcgtttcggtaggaagggtgttgccatcaactttgtcactcgtgacgacgagcggatgctgtttgacatccagaggttctacaatgtgctgattgaggagctgcctgccaatgttgctgaccttctgtgatcaagttgatgaaaaacagcaaaacaaaaaattcggtaagggggacctgataaggcttgtttttgttgaaatattgccacatgtggggagggggtgatatggtcggtggcgtttctagtcgtggtcatggtttcatggacaatttgtgatttttccttatgccatgttttggtaatttttgtagctgcctaggccttgtggtatgtgctgctggggggggggggggtcattagtatggagagggagacgctgctggagtctttttcgatttagtcttttgtttaaaactatgtatgaccctatgatggtattatttgtgtcatccttgacttatattctgccataactgcatgtatcctgcaatcagcctgcagcacttttgtctttgttccgagtaaaatctgtttactct

SEQ ID NO: 5186 - DNA, 1008 bp, Zamia vazquezii
  misc_feature (858)..(858): n is a, c, g, or t
gatctatgatatttttcagcttcttccaacgaagattcaagttggtgtcttttcagctacaatgcctcctgaggcccttgaaatcacaagaaagttcatgcataagcctgttaggattttggtgaagagggacgagttgacacttgagggtataaagcagttttatgtcaatgttgacaaggaggactggaagcttgatactctctgtgacttgtatgagactctggctatcacacaaagtgtcatttttgttaataccagacggaaggttgattggctaactgacaagatgagggctcgagaccacacagtctcagctactcatggagacatggatcaaaacaccagggatattatcatgagggaatttcgatctggttcttcacgtgttctgatcacaactgaccttcttgctcgaggtattgatgtgcagcaagtgtctcttgttatcaactacgatcttccaactcaaccagagaactacctccaccgtattggtagaagtggcaggtttggaaggaagggtgtggccatcaattttgttacgagggatgatgaaagaatgttgcaagatattcagaggttctacaacgtgactattgaggagcttccctcaaatgttgctgaccttctttgatgctctctgcttgctatttgtgagaaaggtctgtggaggatgagtatcgtttcattatcagacaattctttaagtttattttgcctcaaaacaaatgaggtgtttctgagctttgtttactaaggtatatttggggactgtaagtcacagatttctgagcatggagtttgtgctgggtggtaacagtcttttttgttcacccatctagagacttgtttttncccccttcctttttttcctagtttttccttattggcgtttggcatagaaagtgtaagtgggacagacaacaggaattttcttgttgcctatgtgggttactatattgcattctggaaacagttaaatatgggatgcagtccttgcaaaaa

SEQ ID NO: 5187 - DNA, 320 bp, Eschscholzia californica
catggatcagaacacaagagatattatcatgcgtgaattccgatctggatcctcacgtgtccttatcaccactgatcttctggcccgtggtattgatgtccagcaagtttctcttgtcataaactacgatcttccgacacagccagaaaactatctccatcgtatcggacgtagtggtcggtttggaaggaagggtgttgctattaacttcgttactaatgatgatgaaaggatgctttctgatattcagaggttttacaatgttgtcgttgaggagcttccatcaaacgttgccgatctcctctgaggatatcgacaat

SEQ ID NO: 5188 - DNA, 753 bp, Ocimum basilicum
gccacccatggtgacatggaccagaatacaagagacatcatcatgagagaattcagatctggttcttccagagttctcatcaccaccgatctgttggcccgtggtatcgatgtccagcaagtctcccttgtcatcaactatgatttgccaactcagcccgagaattaccttcaccgtattggacgaagtgggcggttcggcaggaagggtgtggccataaattttgtcaccaaagatgatgaacgtatgctttttgacattcagaagttctacaacgttttagttgaggagctgccagcaaatgttgcagatctcctgtaaaatgcagtcttgaggcccagagtttgtatgaggtggtttgatgagtctttgaagttggaatttattttggtgtttacaaatgcgaatgcaggaatggggattgaagctctatggatcgtcgcgccgccccgtcgaagcccaactgctaaggttatttcttgttctctatttttgccatttcaactatggaattccttttggagtggccttttattttgatgttgggttgaagaccctacaacactattagtttagcctttttctataagtgtgccgacttccttttctttagagaaaaatttgcgtagctttgattttcaggctggtagcctttcctttttttggtacagcaatgttcttggatgttagtttggagaagattgtgtaggattgcttttagggacctaacactgaattttgcttggttgaaat

SEQ ID NO: 5189 - DNA, 1207 bp, Brachypodium distachyon
  misc_feature (101)..(101): n is a, c, g, or t
atgactcccgaccagccagagaactacctgcatcgcatcggtcgtagtgggttcggtacgggaggaagggtgtggccatcaactttgtgacccgtgaagantagaggatgctgtttgacatccagaagttctacaacgttggctgggagctcttcaatcaccacgttgtagaacttctggatgtcaaacagcatcctctcatcttcacgggtcacaaagttgatggcaacacccttcctaccaaaacgaccactacgaccgatgcgatggaggtagttctctggctgggtcggaagatcatagttgatgaccagggacacttgctgcacatcaataccacgagcaagcaggtcggtggtaatgagcacacgggaagaaccagatctgaactccctcatgatgatgtccctagtgttttggtccatgtcaccatgagtggcagaaactgtgtggtccctgcccctcatcttatcagtgagccagtccaccttgcggcgggtgttcacaaagatgacactctgggtgatggcaagggtctcgtacaggtcacagagtgtgtcgagcttccactcttccttctccacattgacatagaactgcttgataccctcaagggtaagctcatccctcttcacaaggatcctcacaggcttgttcatgaacttacgagtgatctcaagggcctcagggggcattgtagcagagaagactccaacctgaatctttccggggagcagctggaagatagtgtttacctgatccttgaaacctcgggaaagcatctcatcagcttcatccaggacaaacatcttgatgtgatcagggcgcagagactgcctacgcaacatgtcgaagacacgaccaggtgttccaacaacaacatgcaccccacttgcaagaattctttgatcctcacgaacagaagttcctccaacacatgcatgaactttcacacccaagtagtcaccaagtgcacgcataaccttctcaatctgctgcgcaagctcacgggtgggagcaagtaccaaggcctggcactcaaccaaaccatagtcaagctgttgcaggattccagagcagaaggtagcagtctttcctgttccagattgtgcttgctgaataacatcaagccccttgcagaaaggaacaattcccctctgctggatggcagaaggcttctcaaaacctattgaacaaaagacagaca

SEQ ID NO: 5190 - DNA, 653 bp, Cicer arietinum
gtggtatcaacgcagagtgtcatttttgtgaacacaaggcgcaaggtggactggctcactgacaaaatgcgagggaatgaccacactgtctcagccacccatggagacatggaccaaaacactcgtgatatcatcatgcgtgaatttcgctcaggctcttctcgagttctcattaccactgaccttttggcccgtggtattgatgttcaacaagtgtctttggtgataaactatgatcttcctactcaacctgaaaattatcttcatcgcatagggcgaagtggtcgttttggtagaaaaggtgttgcaataaactttgtcacattggatgatgcaagaatgctttctgatattcagaagttctacaatgtgaccgtagaggagttgccttcaaatgttgctgatctactctgatgaattaatttttgttctctgttaattcatcagggctttttagtttttgacaagtgctattttatgcctactcttcttttgcaatttttacccattagagttcaaagacatctgactctatttataatggattctatgaattttgtttaattgcttaattagtgggttttttttgtgatctgtatttcttttatttcatcaacagaaatataaatcctacttgttcagttataaaaaaa

SEQ ID NO: 5191 - DNA, 965 bp, Gerbera hybrid cultivar
agtgttcgtgaagatcagcgtatcctctcggctggcgtccatgttgttgtcggcacacctgggcgtgtctttgacatgctttcaagaggattcaaggatcagatctatgatatcttccagttactaccatcaaaagtccaagtcggcgtgttctctgcaacaatgcctcccgaagccctagaaatcacacgcaaattcatgaacaaacccgtaagaatccttgtcaaacgcgatgaactaaccctagaaggcatcaaacaattctacgtcaacgtcgaaaaagaggaatggaaacttgaaacactctgcgacctctacgaaaccctagccatcacccaaagtgtcatcttcgtcaacacacgacgaaaagtcgactggctaaccgacaaaatgcgtagccgtgaccacacggtctcagccacccatggagacatggaccagaacacccgtgacattattatgcgcgagttccgatccgggtcgtcgcgggtcctcatcacgaccgatcttttggcccgtgggattgacgtgcaacaagtttcacttgtgataaattatgaccttccgactcagccagaaaactatcttcatcgtattggacgaagtggacggtttgggcgaaaaggtgttgcgattaattttgtgacggctgatgatgaacgaatgcttgcggatattcaaaagttttataatgtcatggtggaggagctgccgtcaaatgttgcagatctgatttagtgttttgggtttgtttggaggaagaaaggttagacttcgttttttggaaactatcggttttgatttgtgtttttatttttaagtttatggaggtggttggatcggtgttataagattatggaaatgcaatttggcaacagggtgtttctgtttctggtgttgccattttgtgttttaagtcatgtttgtactctacctaaagtttatctttttactccagatgtgta

SEQ ID NO: 5192 - DNA, 1162 bp, Lotus japonicus
gcaggctttggttttggcaccaacaagggagctggcacaacagattgagaaggtcatgcgagcacttggtgattaccttggtgttaaggttcatgcttgtgttggtgggacaagtgttcgtgaggatcagcgcattctccaagctggtgtccacacagttgttggcactccagggcgtgtgtttgacatgctgcggaggcagtctcttcgccctgatagcataaagatgtttgttttggatgaggctgatgaaatgctttcacgtggtttcaaggatcagatctatgacatcttccagctgctgccaggcaaaattcaggttggagtgttctctgctacgatgccacctgaagcacttgagattaccaggaagttcatgaacaagccagtgagaatcctggtaaagcgtgacgaactgaccctggagggtatcaagcagttctatgtcaatgttgagaaggaggagtggaagctggagacactatgcgacctctatgagaccttagctatcacccagagtgtcatctttgtgaacaccaggcgcaaggtggactggctcactgacaagatgcggagcaatgatcacaccgtctcagccacccacggtgacatggaccagaacaccagggacatcatcatgcgtgaattccggtccggctcctctcgagttctcatcaccactgacctcctggcccgtggtattgacgtgcagcaagtgtctctagtcataaactatgacctcccaactcagcctgaaaactatctccatcgtattggtaggagtgggcgtttcggaagaaaaggtgttgctataaactttgtgacattggatgattccaggatgctgtctgatattcagaagttctacaatgtgactgtggaggagctgccatccaatgttgctgatctgctctgatgagttaaatttttgctctctgttaagtcatcggggatttttctgctggacaagtgctattttaagttattcaggtcttctttttaatatattttactcatgagattaaagacatccatctgatgctatttgtagtggattctttaaaatttgtttgattagttatcaggattctgtttaagcctgcatgtattttcatttgtctcctttctatttcttgttatttttgtggcataaaatattttt

SEQ ID NO: 5193 - DNA, 731 bp, Tropaeolum majus
tagaaacactctgtgatctttatgagactctagccatcactcagagtgtcattttcgttaacacacgacgaaaagttgattggcttacggacaagatgagaagtcgtgaccacacagtctcagccactcatggtgacatggaccaaaatactcgtgatatcatcatgcgggaattccgttctggctcttctcgtgttcttatcaccactgatctccttgctcgaggtattgatgtgcaacaagtgtcacttgtcataaactatgatctgccaacacagccagaaaattatcttcatcgtattggacgaagtggacgttttggaagaaaaggtgtttcgattaactttgtaacaaccgaagacgatagaatgctggctgatatccagaagttctataatgtgataatcgaggaactgccatcaaatgttgctgatctcctctgaagatattcatttttaattttttaaggagttttgttatggaaaaggtgtttttttgttcttgtagtgctacttagtttgtttgcagaattggtgtagtgttttaagttaatgttgtcagaacacacaatccctgctgtctgaaaaattacacaaaagttgcaatagctaatcttttacaatcgtcttctttatttaaaagtttttgtgtagtttgaacacgtaatccatgcagtgtaaaaaacataccacaagaataaagtgtgttgttggtgagtcaattgacaatac

SEQ ID NO: 5194 - DNA, 760 bp, Avena sativa
gcagttttacgtcaatgtcgacaaggaagagtggaagctagagacactatgcgacctctacgagacactggctatcactcagagtgtcattttcgtgaacacaaggcgcaaagtggactggctcaccgacaagatgcgaagcagagaccataccgtctcggccactcatggtgacatggaccagaacactagggatatcatcatgcgtgagtttcggtctggctcttctcgtgttctcattaccaccgacctcctggcccgtggtatcgatgtgcagcaagtgtctttggtgatcaactatgatctcccaactcagcctgaaaactatctccaccgtatcggtcgtagtggtcgatttggaagaaaaggagtttccataaactttgtgacattggatgatgctagaatgctggctgatattcagaaattctacaatgtgactatagaggagctcccatccaatgttgctgatttgctctgatgagttaagttttgttctctgttaagtcatctgggatttttcttttggacaagttctatcttgttaacttttgattattattttttttaattttaaattttagagatcaaacatgtgatctgatactatttgtattgggatttttatcaaatttgtttgattaattaaattagttaagagaagtttgcatgtatttattcttatctcctctaaatttcttttgtacagtatcatatccactttgatttctaactatatgattattaggatcatactcct

SEQ ID NO: 5195 - DNA, 1331 bp, Orobanche aegyptiaca
agcaaagaggtattgtgcccttctgcaagggcctggacgtcattcaacaggctcaatccggaaccggaaaaactgcaaccttctgctctgggattctccagcagttagactacaacgtagttgaatgccaggctctggttctggcacccacccgtgagctcgctcagcaaatcgagaaggttatgcgtgcactcggagattatctcggtgttaaggtgcacgcttgcgtcggaggtaccagtgtccgtgaggatcagcgtattctttccagtggggttcatgtcgtggtcggtacacctggacgtgtgtttgacatgttgaggaggcagtcacttcgtcccgattacatcaagatgtttgtcttggatgaagctgatgaaatgctctccaggggattcaaagaccagatttacgacattttccagttgctgcctcctaagatccaagtcggcgtgttttcggccactatgccacctgaagccctcgagatcacccgaaaattcatgaacaagcccgttcgcatcctcgtgaagcgagacgaattaaccctcgagggtatcaagcagttctacgtcaacgtcgacaaggaagagtggaaactcgagaccctctgcgacctttacgagaccttagccatcacccagagcgtcatcttcgtcaacacccgacgcaaggtcgactggctcaccgacaagatgcgcagccgtgaccacaccgtctccgccactcacggtgacatggaccagaacacgcgtgacatcatcatgcgcgaattccgatcgggctcgtctcgggtcctcatcaccaccgatctcctggcccgtggtatcgacgttcagcaggtttccctcgtgatcaattacgatctcccgacgcagcccgagaactatctgcatcgtatcggaaggagcggaaggttcgggaggaagggcgtggcgattaatttcgtgaccaaggatgatgatcgtatgcttttcgacatacagaagttttataatgttatggtggaggagcttccggcaaacgtggccgatttgctctgagtgacggtggggtttttgttccgtcgaggtttcgtattaaaggttgtttctcgagtaagttattatcgcgtcttgttttttctttaggtttagtttaagtggctacttgtgaactttatttaatctttaaattaaattgggagatcataagagaactttcgtgtttcaaattgaaattcctgtttgaaaacttttactgttgcagagtttctgtctggggtttgttggttgtattgtaatcgtttgagaataactgctgtttggatgatgttgaaattttggatgtta

SEQ ID NO: 5196 - DNA, 550 bp, Pisum sativum
agcgcaaagtggactggctcaccgactacatgcgaagcagagatcatacagtctcggccactcacggtgacatggaccagaacactagggacatcatcatgcgtgagtttcggtctggctcttctcgtgttctcattaccactgacctcctggcccgtggtatcgatgtgcagcaggtgtctttggtcatcaactatgatctcccaactcaacctgaaaactatctccaccgcattggtcgtagtggacgatttggaagaaaaggtgtttctattaactttgtgacattggatgatgctagaatgctggctgatattcagaaattctacaatgtgactatagaggagctgccatccaatgttgctgatttgctctgatgagttcagttttgttctctgttaagtcatcttggatttttctcttttggacaagttctatctttttttacttttgatttaatttttttactcattagagatcaaacatgtgatctgatgctatttgtattgggattttatcaattttgtttgattaattaattagttaagag

SEQ ID NO: 5197 - DNA, 1213 bp, Physcomitrella patens
aactttccgcgacttacagaagatccgcaacattagatggaagctcctcaatcacagtgttgtagaacctctgaatatcctggagcatgcgctcatcctccttcgtcacaaaattgatggccactcccttacgcccgaatcgcccactgcgaccgatacggtgaaggtaattctccggctgggttggcaggtcgtagtttatcaccaaagacacctgctgcacatcaatgccacgcgccaacaggtccgttgtgatcaacacccgggaagatcctgagcggaactcacgcatgatgatatcccgggtgttctggtccatgtctccgacatcgttcaccaacaaccaacacgtcatccgctgttgcttaccgcgcatcttgtcagtcaaccagtccaccttccggcgggtgttgatgaagatcacactctgggtgatcgccaaagtttcgtacaggtcgcacagggtgtccaacttccactcctcgcggtctacattcacgtagaactgcttgatgccctccagagtcaattcgtctctcttcaccaagatcttcaccggcttgttcatgaacttccttgtgatctcgagggcttcaggaggcatggtagcagagaaaacacccacttgaagcttctggggcagcagctgaaagatgtcgtaaatctgcacgtattggacatcactgcaacatctcatcggcctcatccagcacaaagcacttgatggagtccgcgcgcagtgcgttcctgcgcaacatgtcgtacacacgcccaggtgtaccgaccacaacgtgaacaccggcctgcaaaatcctctggtcctctctcacactggtccctcccacgcacgcgtgtaccttcacctgcaggtagtcgccaagggcgcgcatcaccttttcgatctgctgtgccaactcgcgggtgggtgccagcaccaaagcttggcactccaaaagctggtagtccaactgctgcaagataccagagcaaaatgtcgcggtcttgcctgtgccggactgggcttgttggataacatccagaccctttgtgaaagggacaattccacgctgctggatggcggacggcttctcgaaaccgtaggcgtatatacccctgagaaggttctcgtgaagacccatgacgtcaaacgtctcgtggacctcttcccaagtagaaatgaaatcatctccctcgccgctcaagctgagctcaa

SEQ ID NO: 5198 - DNA, 636 bp, Cajanus cajan
tatgtcaatgttgataaagaggactggaagcttgacacactctgtgatctttatgagacattggctattactcagagtgtcatttttgtgaacaccagaagaaaggttgattggctgactgacaagatgcgaagccgagatcacacagtttcagcaacccatggagacatggatcagaataccagggacattattatgcgtgaattccgttttgggtcctcccgtgttttaataactactgatcttttggctcgtggtattgatgtccagcaagtgtctttggttataaattacgatcttccaacacagcctgagaactatctccatcgtattggacgtagtgggaggtttggtaggaaaggtgttgctatcaactttgtcacaaaggatgatgaaaaaatgctgtatgacatccagaagttttacaacgtggtaattgaggagctgccttcaaatgttgctgaactcctttgatgagattttttgttctatcatattagagggaagttggtttttgaggtaagtgttatgtaatgtttcttttcctttttgccccttttgttgtatttctgctcgtaaaccttgtttgacttttttaataggggtagtaatttaatttacagtcagttgtctgga

SEQ ID NO: 5199 - DNA, 761 bp, Phaseolus coccineus
gccacctgaggccctggagattaccagaaagttcatgaataggccagtgagaatcctggtaaagcgtgatgaattgacccttgagggtatcaagcagttttatgtgaatgttgacaaggaagaatggaaactggagacattatgtgacctttatgagactttggctatcacccagagtgtcatctttgtgaacacaaggcgcaaggtggactggctcacagacaagatgcgaagcaatgatcacacagtctcagccactcatggagacatggaccaaaacactcgtgatatcatcatgcgtgaatttcgctctggctcttctcgagttctaatcaccactgaccttttggctcgtggtatagatgtacagcaagtgtctttggttataaactatgatctgccaacccaacctgaaaattatcttcaccgcatagggcgaagtggccgttttggaagaaaaggtgttgccataaactttgtgacattcgatgattccagaatgctatctgatattcagaagttctacaacgtcactgtagaggagttgccctcaaatgttgctgatttgctctgatgggttaatttttatgctttgttaagtcatcagagctattacttttttgacaattattattttgtgtttttttctctttttcaatttttaccggtagagttcaaagaccctttactttatttataatggattctataaaatttgtttatttgcttcattagtaggttgcccaaagacaccttttttg

SEQ ID NO: 5200 - DNA, 934 bp, Trifolium pratense
ctttcacgtggtttcaaggaccagatctacgacatcttccagctgctgccacccaaaattcaggttggagttttctctgctacaatgccaccagaagccttggagatcacaaggaagttcatgaataagccagtcagaatcctggttaagcgtgatgaattgacccttgagggtatcaagcagttttatgtgaatgttgacaaggaagagtggaaactagagacattatgtgacctttatgagactcttgctatcactcagagtgtcatttttgtcaacacgaggcgcaaggtggactggctcaccgataaaatgagaggaagagaccatacagtctcagccacccatggagacatggaccaaaacactcgtgatatcatcatgcgtgaattccgctctggctcttcacgagtgctcataacaactgacctgttggctcgtggtattgatgttcagcaagtgtctctggttataaactatgatttgcctacccaacctgaaaattatcttcatcgtattggtcgtagtgggcgtttcggaagaaaaggtgttgctatcaactttgtcacattggatgatgcaagaatgctgtcagatattcagaagttctataatgtgatcgtagaggaattgccttcaaatgttgccgatttactctgatgagttaatttttgttcttttttaattcatcagggctttttagttttttgacattttctgctcctttctcttttacaatttttgcccattagagttcaaagacatctgactctatttatattggattctatgaattttgtttaattacttgattagtagggtgcttcagactttttttatttgatctgtttaattgtttcttttggattctatgaaccttacctatcatcagttatgaatttgtgtctagattttaagacactatttaaaaaaa

SEQ ID NO: 5201 - DNA, 1316 bp, Cynara scolymus
  misc_feature (594)..(594): n is a, c, g, or t
  misc_feature (649)..(649): n is a, c, g, or t
  misc_feature (653)..(653): n is a, c, g, or t
  misc_feature (698)..(698): n is a, c, g, or t
  misc_feature (762)..(763): n is a, c, g, or t
tatgatagatttgatgctatgcgtctgcaagaaaatcctttgagaggcatttatgcatatggttttgaaaaaccatcagcaattcagcagaggggaattgtccctttctgcaagggtcttgacgtaatccaacaagctcaatctgtaacagggaagactgcaaccttttgctctggtatccttcaacaactcgactacaatgtcgtcgagtgtcaggccttggttctggcacctacccgtgaacttgcacagcaaattgaaaaagttatgcgagcacttggggactatcttggtgtgaaggtccatgcttgtgttggtggaaccagcgttcgtgaagaccagcgcattctctcggctggtgtccatgttgttgttggtactcctggtcgtgtctttgacatgctcaggaggcagtcacttcgtgctgattacatcaagatgtttgtgttggatgaagctgatgaaatgctttccagaggtttcaaggatcagatttacgatatcttccagttgttgccgtcaaaggttcaagttggagtgttctctgcaacaatgcctccagaagcccttgagatcacaaggaagttcatgaancaacccgtgagaattctcgtcagcgcgatgaactcactctcgaaggtatcaaacngttntacgtgaacgtcgaaaaggaagaatggaagctcgaaaccctctgngatctctacgaaaccttagccataaccaaagtgtcatctttgtcaacacccgaaggaaggtcgnntggctaaccgacacatgcgtagccgtgaccacaccgtctccgccactcacggagacatggaccagaacacccgagacatcatcatgcgtgaattccgttccgggtcgtctcgcgttctcatcacaaccgatcttttggctcgtggtatcgacgtccaacaggtgtcgctcgtgatcaactacgaccttccaacacagcctgagaactacctgcatcgtatcggtcgaagtggtcggttcggaagaaagggtgtggctataaattttgtgacattggatgatgaaaggatgcttgcagatattcagaagttttacaatgtgatggtggaggagctgccatcaaatgttgctgatctgatctgatctgatctgctctgctctgctctgctgaattagaaagagattttgggatgaaaaaaggttagtttttgaaatctattatcggttttgtttgtttaagttattattattatgatgatgaaagactttttttgagagatattatgctgaggtggcaattgcaattgccaggtgtcagttcatgtttgtacccg

SEQ ID NO: 5202 - DNA, 1424 bp, Allium cepa
  misc_feature (1147)..(1147): n is a, c, g, or t
caaaaaagcattctcctctccttcctcaaaagaagaagaggattcagtttcttgattcgatctattatctcccgtaatcttcaatctttatttataactaaagaaaatggcaggaatggcagaagagggttctcaatttgatgctaaaaaatttgattcaaaaatgaatgacctgcttacagcagatgggcaggatttctttacgtcctatgatgaggtttatgatagcttcgattccatgggtcttcaggaaaatctactgagaggaatttatgcttatgggttcgagaaaccttctgcaattcaacagagaggaattgttccattctgcaagggacttgatgttattcaacaggctcaatcaggaactggaaaaactgcaaccttttgttctggaattttgcaacaacttgattacagcttgattgaatgtcaagctttagttcttgctccaactcgtgagcttgcacagcaaattgaaaaggtcatgagagctctaggagattaccttggtgtgaaagttcatgcttgtgttggaggaactagtgtccgtgaggatcaaaggattctctctagtggagtacatgtggttgttggcacaccaggtcgtgtttttgatatgttgaggaggcagtctctacgtccagattatattaaaatgtttgtgttggatgaggcagatgagatgctttcacgtggttttaaagaccagatatacgacatcttccaacttctcccagcaaaagtacaagtcggcgtcttctctgccaccatgcctccagaagccctagaaataacccgcaagttcatgaataaacccgtccgcatcctggtgaagcgggacgagctaaccctcgaaggcatcaagcaattctacgtgaacgtggaaaaggaagagtggaaacttgaaaccctgtgcgatctgtacgagaccctagccatcacccagagcgtcatattcgtgaacacccggcgcaaggtcgactggctcactgacaaaatgcgcagccgcgaccacaccgtctcagccacccatggcgacatggaccagaatacccgtgacatcatcatgcgcgagttcaggtccggttcctccagggttctcatcaccaccgacctccttgccgaaggcatcgatgtgcagcangtcagtttggtcattaactacgacctgcccacacagcctgagaatacctgcaccgtatcggacgtagtggtaggtttgggaggaagggtgtggctatcaattttgttacgcttgacgatgagagaatgctttttgatattcagaagttttacaacgttgtcgtggaggagctgcctagtaatggtgccgatctcctttgaatattggtttcttccttttccctctttttataagccgggtttatttgcagacatttgcaaatttttgtagcctttgg

SEQ ID NO: 5203 - DNA, 949 bp, Ananas comosus
atgttcgtattggatgaggctgatgagatgctctcacgcggttttaaggaccagatctacgacatatttcagctcctcccctcgaagatccaagtcggggtcttctctgcgactacgccccctgaagccctagaaatcacacgtaaattcatgaacaagcctgtcagaatccttgtgaagcgtgatgagctaacgctagagggtatcaagcaattccacgtcaacgtcgaaaaggaagactggaagctcgaaaccctctgcgacctctatgagaccctagccatcacccagagtgtgattttcgtgaatacccgccgcaaggtggattggctcaccgacaaaatgcgcagcagagaccacactgtttccgccactcacggtgatatggatcagaacactagggatatcatcatgcgcgaattcagatcaggctcttctcgtgttctaatcactaccgatcttcttgcgagaggtatcgatgtgcagcaagtctcgctggttataaattacgacctgcccactcagccagagaattacctgcaccggattggtcgaagtggtcgatttgggaggaagggtgttgcgattaatctcgtgacccgcgacgacgagcggatgctgtttgacatccagaggttttacaatgtgtgatcgaggagctgccggccaatgttgctgatcttctctagtactccaaatttgcggtatctgtcgttctaataggaggaaatcgtatgaggaaatcgtttattaggttgggtttttctttcccttttgaattatcctcaacatcgaatttgctgttttggattatttaatggtgatttgggactgagttattgtttatccccccatatttgctaattctggtcgcagtaagattgtgtcgttgtaccggataaattttaacttatatgtttgttataagtcggtatgttcgattagtttt

SEQ ID NO: 5204 - DNA, 901 bp, Ananas comosus
  misc_feature (112)..(112): n is a, c, g, or t
  misc_feature (116)..(116): n is a, c, g, or t
  misc_feature (351)..(351): n is a, c, g, or t
  misc_feature (592)..(592): n is a, c, g, or t
  misc_feature (867)..(867): n is a, c, g, or t
atgttcgtattggatgaggctgatgagatgctctcacgcggttttaaggaccagatctacgacatatttcagctcctcccctcgaagatccaagtcggggtcttctctgcgnctangccccctgaagccctagaaatcacacgtaaattcatgaacaagcctgtcagaatccttgtgaagcgtgatgagctaacgctagagggtatcaagcaattccacgtcaacgtcgaaaaggaagactggaagctcgaaaccctctgcgacctctatgagaccctagccatcacccagagtgtgattttcgtgaatacccgccgcaaggtggattggctcaccgacaaaatgcgcagnagagaccacactgtttccgccactcacggtgatatggatcagaacactagggatatcatcatgcgcgaattcagatcaggctcttctcgtgttctaatcactaccgatcttcttgcgagaggtatcgatgtgcagcaagtctcgctggttataaattacgacctgcccactcagccagagaattacctgcaccggattggtcgaagtggtcgatttgggaggaagggtgttgcgattaatntcgtgacccgcgacgacgagcggatgctgtttgacatccagaggttttacaatgtgtgatcgaggagctgccggccaatgttgctgatcttctctagtactccaaatttgcggtatctgtcgttctaataggaggaaatcgtatgaggaaatcgtttattaggttgggtttttctttcccttttgaattatcctcaacatcgaatttgctgttttggattatttaatggtgatttgggactgagttattgtttatccccccatatttgctaattntggtcgcagtaagattgtgtcgttgtaccggata

SEQ ID NO: 5205 - DNA, 931 bp, Helianthus annuus
  misc_feature (769)..(769): n is a, c, g, or t
  misc_feature (772)..(772): n is a, c, g, or t
  misc_feature (822)..(822): n is a, c, g, or t
tgttggtacccgggattcggcctgatggcctgtagccggggtccacgtcgttgttggtacacccggccgtgttttcgacatgttgcgtagacagtcccttcgttctgataacatcaaaatgtttgttcttgatgaagctgatgaaatgctttcacgaggttttaaagatcagatctatgatatcttccagttgttgccgtcaaaggttcaagtcggagtgttttcggcaaccatgccaccggaagctttagaaatcactagaaagttcatgaacaaaccggtgaggattctcgtaaagcgtgacgagctcactttggaaggtatcaaacaattctacgtgaacgtggagaaagaagagtggaagctcgaaaccctttgtgacctttacgagacactagcaatcacgcaaagtgtcatctttgtgaacacacgaaggaaggttgactggttgaccgacaagatgagaagccgtgaccacaccgtctcagccacacacggtgacatggaccagaacacacgtgacatcatcatgcgtgagttccggtccggctcttctcgtgttctcatcaccactgatttgctggcgcgtggtattgatgttcaacaagtttcacttgttataaactatgatcttccgacccaaccggaaaattaccttcatcgtatcgggcgtagtgggcgatttggaagaaaaggtgtggcgattaactttgtgacacttgacgatgagaagatgcttggtgacatccagaagttttacaatgttgtngtngaagagctgccgtccaacgttgctgatctgatttgatctgatttcgaagntttttgaatttgatccgtgttttgttttgtttaagttattaaaagatcgtatcttttgggagtaggatttgaaatcatggttgtacccttagtcttaatttcttggact

SEQ ID NO: 5206 - DNA, 518 bp, Ocimum basilicum
gcaccccgtagaactaaccctcgagggtatcaaacagttctatgtcccttttgacaaggaagaatggaagctggagacactctgcgatctctacgagactctggccatcactcagagcgtcatcttcgtcaacaccagacgaaaggtcgactggctgaccgacaagatgagaagccgggaccacacggtctcagccacccacggagacatggaccagaacacccgtgacatcatcatgcgtgaattccgatcgggctcgtctagagtcctcatcaccaccgacctcttggctcgtggaatcgatgtgcagcaggtatctcttgttataaactatgaccttccgactcagccggaaaattatctgcatcgtatcggaaggagtgggaggtttggaaggaaaggtgttgctatcaatttcatgacaatggaagatgagaagatgcttgctgatattcagaagttttataatgttgtgattgaggaactcccagctaatgttgctgatcttctttagggag

SEQ ID NO: 5207 - DNA, 876 bp, Solanum melongena
ctcctaagattcaggttggtgtcttctctgctactatgcctcctgaggcacttgaaatcactagaaaattcatgaacaaacctgtgaggattcttgtgaagcgtgatgagctaaccttagaaggtatcaagcaattctatgtgaatgtggacaaagaagaatggaagctggaaaccctgtgcgacctgtatgaaacattagccattacacagagtgtgatctttgtgaatactcgtcgcaaagttgactggttgacagacaagatgcgaagcagagaccatacagtgtcagctacacatggtgacatggaccagaccactagagatataataatgcgtgaattccgttctgggtcctcccgtgttctcatcaccactgatcttttggcccgaggaatcgatgtccaacaagtctccctggtcataaattatgatctccccactcagcctgagaattatcttcatcgtattggacgcagtggaaggtttggtaggaagggtgtggccatcaactttgtaacaagggatgatgagaggatgctatctgatattcagaggttctacaacgttttaattgaggagctgccagcaaatgttgctgatctcctgtaagaagcttttttcctacttcagtggccagaaggagcgggctctctctcttcctttcactccaccctgttttcgtttaaattctgtgtaatgtctaatttaggggtccttgtgtctaaattatgagctggtgagtaatgcaagttggcgttgtgtaatccattatttttatatcatacgacggtagctattactagcttttgacctcaaagggttgtatctgcaatacgatgtaagagtgttataaaatcattcagtttagcttacg

SEQ ID NO: 5208 - DNA, 572 bp, Ipomoea batatas
tggctcaccgacaaaatgggtagccgtgatcacacagtttttgcaactcacggagacatgacccaggacactagggacatcatcatgcgtgaatttcggtctggttcttccagagtgctcatcaccaccgatctcttggctcgtggtattgatgtccaacaactgtcacttgtgatcaactacgacctccctactcagccagaaaattacctccaccgtattggacgaagtgggcgatttggaaggaagggtgtggctatcaacttcgtcacgaaggatgatgaaaggatgctttttgacatacagaagttttacaatgttgtagtcgaagagttgccagcaaacgttgctgatctcctgtgatggggttttgggtcaaagacaagttgaattgttcctcaattgaagctctctactatttgatctcttatttcataggctagttgtgtactggactttttgttgggaaattctggcctttgtatttcgatagggggttgcagtttcccaatttggtcacaagtccaaatctactacttgaaattttgttggttttgtctttgtactgtaag

SEQ ID NO: 5209 - DNA, 1226 bp, Medicago truncatula
aaacaaaattcatagaatccattataaatagagtcagatgtctttgaactctaatgggtaaaaattgtaaaagaaaataagcggaaaatagcacttgtcaaaaactaaaaagcccccccgatgacttaacaaagaacaaaaattaattcatcagagtagatcggcaacatttgaaggcaattcctctacgatcacattatagaacttctgaatatcagccagcattcttgcatcttccaatgtgacaaagttgatagcaacaccttttcttccaaaacgcccacttcgcccaatacgatggagatagttttcaggttgggtaggcaaatcataatttatgaccagagacacttgctgaacatcaataccacgggccaaaaggtcagtggtaatgagaactcgagaagagccagagcggaattcacgcatgatgatatcacgagtgttttggtccatgtctccatgggtggctgagacagtatggtctctgcctcgcatcttgtcagtgagccagtccaccttgcgccttgtgttcacaaaaatgacactctgagtgatagccagagtctcgtaaaggtcacacaatgtctctagtttccactcttccttgtcaacattcacgtagaactgcttgataccctcaagggtcaattcatcacgctttaccagaattctcactggcttattcatgaacttccttgtgatctccagagcctctggaggcattgtagcagagaacactccaacctgaattttgggtggcagcaactggaagatgtcgtagatctgcatttttcaaacatataagaacatcagctgttatttaaaacaagatcaattcatctgagactgtcttcgcagcatgtcaaacacacgtccaggagtaccaacaacaacatggacaccagtttggagaatacgctgatcctcacgaacactagtgccaccaacacaagcatgaaccttaacaccaaggtagtcaccaagtgctctcataaccttctcaatctgctgtgccagctcccttgttggggccaaaaccaaagcctggcactgaaccaaaccataatcaagctgctgcaaaattccagaacagaacgtcgctgtctttccggttcctgactgagcctgctgaatcacatcgagacccttgatgaaaggaacaattcccctttgctgtattgcagatggcttctcaaaaccttaagcacaagaacagaacatca

SEQ ID NO: 5210 - DNA, 1221 bp, Physcomitrella patens
aactatccccgacctacagaagatccgcgacattcgacgggagctcctcaaccacggtgttgtagaacctctggatgtcctggagcatgcgctcgtcctccttcgtcacaaagtttatcgctactcccttgcgcccgaaccgcccactgcgaccgatacggtgaaggtagttctccggctgagttggcaggtcgtagttgatcaccaaagacacctgctgcacgtcgataccccgcgccaacaggtccgttgtgatcaaaactcgggaagaccccgaacggaactctcgcatgatgatgtcccgggtgttctgatccatgtctccgtgagtggccgacacggtgtggtcacgggcttccaccttccgccgggtgttgatgaagatcacgctctgggtgatcgccaatgtctcgtacaggtcgcacagggtgtccaacttccactcctcgcggtccacgttcacgtagaactgcttgataccctccagcgtcaactcgtccctcttcaccaggatcttcaccggcttgttcatgaacttcctcgtgatctcgagggcttccgggggcatggtggcggagaacacgcccacttgaagcttctggggcagcagctggaagatgtcgtaaatctgcacgtcatggacaccgcaccagcaacgacaacaacaccgcacctggtccttgaaaccccgagaaagcatctcatcggcctcgtccagcacgaagcacttgatggaatccgcgcgcagcgcattcctgcgcaacatgtcgtacacacgcccgggtgttcccaccaccacgtgcacacccgcctgcaaaatcctctggtcctccctcacactggttcctcccacgcacgcgtgcaccttcacctgaaggtagtcgcccagtgcgcgcatcaccttctcgatctgctgggccagctcacgggtgggtgccaacaccaaggcttggcactccaaaagctggtagtccaactgctgcaggatgcctgagcaaaacgtcgcggtcttacccgtaccggactgggcttgctggatcacgtccaaccccttcgtgaacggcacgattccgcgctgctggatggccgacggcttctcgaaaccgtacgcataaatgcccctcagaaggttctcgtgaagacccatcacgtcgaacgtctcgtggacctcctcccatgtggaaatgaagtcctctccctcgccgcccaagctgagataca

SEQ ID NO: 5211 - DNA, 1241 bp, Tragopogon dubius
ttttgatgccatgggcttacaagaaaacctattgagaggcatctatgcatacggttttgagaaaccatctgccattcaacaaaggggaattgtacccttcaccaagggtttggatgtcattcaacaagctcaatctggaacaggaaagacagcaactttttgctcaggtatcctccaacaacttgactacaatgtggtggaatgtcaggccttggttctagccccaacccgcgaacttgctcagcagattgaaaaagtcatgcgtgcccttggagactaccttggtgtcaaagtccatgcgtgtgtgggtgggaccagtgtccgtgaagaccaacgtatactttcagctggtgtccatgttgttgtggggaccctgggcgtgtgtttgacatgctgcgcagacagtctttacggtctgattacatcaaaatgtttgtgcttgatgaagctgatgaaatgctctctcgtggttttaaggatcagatttacgatatcttccagttactaccatcaaaagttcaagtaggagtcttttccgcaacaatgccacccgaagcactcgagatcacaagaaaattcatgaacaaaccagtccgaatcctagtcaaacgagacgagctcactctagaaggaatcaaacagttctacgtaaacgtcgaaaaagaagactggaaactcgaaaccctctgcgacctctacgagaccctagcaatcacccaaagcgtcatcttcgtcaacacccgccgcaaagtcgactggttgaccgacaaaatgagaagccgggaccacaccgtatccgccacacacggtgacatggaccagaacacaagagacataatcatgcgcgagtttcggtccggctcatcgcgtgtcctcatcaccactgatcttttggcccgtggaatcgacgttcaacaggtttcacttgtgatcaattatgatcttccaacccagccggaaaactacctccaccgtatcggaagaagtgggcggtttgggagaaagggtgttgcgattaactttgtgacattggaggatgagaagatgctttcggatattcagaagttttacaatgtggttgtggaggagttgccatcaaatgttgctgatttgatttgaaaagattttgttgagggaggtgagggtgtcatgacttttttgcccaaatagggtgtggatggattaacatttagcttattttagatgaatctttatctagtttctttattcaagtttactgg

SEQ ID NO: 5212 - DNA, 940 bp, Amborella trichopoda
  misc_feature (216)..(216): n is a, c, g, or t
  misc_feature (262)..(263): n is a, c, g, or t
  misc_feature (292)..(292): n is a, c, g, or t
  misc_feature (312)..(312): n is a, c, g, or t
  misc_feature (728)..(728): n is a, c, g, or t
  misc_feature (786)..(786): n is a, c, g, or t
  misc_feature (811)..(811): n is a, c, g, or t
  misc_feature (816)..(816): n is a, c, g, or t
  misc_feature (819)..(819): n is a, c, g, or t
  misc_feature (824)..(824): n is a, c, g, or t
  misc_feature (840)..(840): n is a, c, g, or t
  misc_feature (852)..(852): n is a, c, g, or t
acaatgccccctgaggcccttgagatcactcgcaagttcatgaacaagcctgttcgaatccttgtaaagcgtgacgagctcacccttgagggtatcaagcaattctatgtgaacgtagagagggaggagtggaaactcgacaccctttgcgaccgcaacgagaccctagctatcagccagagtgtgatttttgtcaacactcgccgcaaggtcgantggctcaccgacaagatgcgcagtcgtgaccacactgtgtctgccnnccacggagacatggaccaaaacaccaggnacgtcatcatgcgagagttnaggtctggatcatctcgtgtcctcatcaccactgatctcctggcccgtggtatcgatgtgcagcaggtgtcccttgttataaactatgatctccctactcaacctgagaactaccttcaccgtattggtcgtagtggtcggtttgggaggaagggtgtggccattaactttgtcactcgtgatgatgagaggatgctcttggacatccagaggttctacaatgtggtcattgaggagctcccctcgaatgttgctgatctgctttaaggaagtcgagaacggtatttgggcaattggtaagttgggctgttttttctctctatactaattattgttgtggctgggtcttgatcttttgggttgatattacatgtaagaggtggtaacagactatttcaactgtttgtaagagtggngcatgcatggttagtatatgctttgcatggtagcgtgtatttgcagggaaacccattnttgcaaattttgcagaagctttttnttttnttnttttnttttttaggttatatnttaatttgtttnttatgggagccatgtactctagattggtactcttttgggcatggttttttcatgttttccgtgaaaatagaatgttttttgaagtcca

SEQ ID NO: 5213 - DNA, 607 bp, Ocimum basilicum
gcaccccgtagaactaaccctcgagggtatcaaacagttctatgtcccttttgacaaggaagaatggaagctggagacactctgcgatctctacgagactctggccatcactcagagcgtcatcttcgtcaacaccagacgaaaggtcgactggctgaccgacaagatgagaagccgggaccacacggtctcagccacccacggagacatggaccagaacacccgtgacatcatcatgcgtgaattccgatcgggctcgtctagagtcctcatcaccaccgacctcttggctcgtggaatcgatgtgcagcaggtatctcttgttataaactatgaccttccgactcagccggaaaattatctgcatcgtatcggaaggagtgggaggtttggaaggaaaggtgttgctatcaatttcatgacaatggaagatgagaagatgcttgctgatattcagaagttttataatgttgtgattgaggaactcccagctaatgttgctgatcttctttagggagtttttgggatttttttttttattttcttttttgccttttttttggtgggttttgaggagtgagtttttagggggtgcccttcggatttt

SEQ ID NO: 5214 - DNA, 1596 bp, Beta vulgaris
  misc_feature (380)..(380): n is a, c, g, or t
  misc_feature (708)..(709): n is a, c, g, or t
  misc_feature (712)..(712): n is a, c, g, or t
  misc_feature (734)..(734): n is a, c, g, or t
  misc_feature (762)..(762): n is a, c, g, or t
  misc_feature (784)..(784): n is a, c, g, or t
gcacgagggtttaagagtttctccacgcctctttacactttcgttttttcaatctcgtttcacttcaaatcaacctaattcaatcatggctggagtagctcctgaaggctcacaatacgatgctcgtcagtatgataacaagatgagtgaattgctttctgaggaaggaagtgactttttcacttcatatgatgaggtgtatgagagctttgataagatgggtttgctagagaaccttctcaggggaatctatgcttatggttttgaaaaaccctctgctattcaacaaaggggaattgttcctttctgcaagggtcttgatgtcatccagcaagctcaatctggtactggaaagactgctactttttgttctggaattntgcagcagctggattatgaaaacttggaatgtcaagctcttgtccttgctccaactagggagcttgcacaacagattgagaaggtaatgagggccctgggtgattacctgggtgttaaggttcatgcttgtgttggaggaacaagtgtacgcgaagatcaaagaatcctcgctgcaggtgttcatgtggttgttggtacaccaggacgtgtctttgacatgctgcgtagacaatctctgcgtgccaatagcattaaaatgtttgttcttgatgaagctgatgagatgctttctcgaggttttaaggatcagatctatgacatcttccnncanttaccccaaagatccaggtggnagtattttctgctacaatgccacctgangcccttgaaattactagaaagntcatgaacaagcctgtacgtattcttgtgaagcgagatgagctaacccttgagggtatcaagcagttctacgtgaatgtcgacaaggaagaatggaagcttgacactctttgtgatctttatgaaaccctggcaatcacccaaagtgtgatatttgtgaacacaaggaggaaggttgactggttgaccgaccaaatgagggcccgtgatcacaccgtttcagccactcatggagacatggaccagaacactagggacatcattatgcgtgaatttcgttccgggtcatcccgtgtccttattaccaccgaccttctggctcgtggtatagatgtgcagcaagtttctttggtgatcaactatgatttgccgactcaaccagagaactaccttcacaggataggacgtagtggacgttttggaaggaagggtgtcgccattaattttgtgaccagtactgatgataggatgctcttcgatatccagaaattctacaatgtgacgattgaggagctccctgccaatgttgcggatctaatctgatgactataagttgtcaactttgtttttgttttgaggtaagatgatttgtctgtccagctagtaaaaatatggacgattactgtgtgttttgtctttcttttttttctattctgggaacatcacttaattgtgttgtggatgccccaggttaaaattttgtaggtgggttagagacaagtttaaattatactcttatcgtatttggctcaaggaacgtgtcgcctgttggcatatttactgcccattctagcatgattttggttttgctgt

SEQ ID NO: 5215 - DNA, 718 bp, Brassica napus
ggagatcacgaggaagtttatgagcaaaccggtgaggattctcgtcaagcgcgacgagctgactctcgaaggtatcaagcagttttacgtcaacgttgacaaagaagagtggaagctcgagacgctgtgtgatctctacgagacgctggctattacgcagagtgttatctttgtgaacactaggcgtaaggttgattggttgactgataaaatgaggagccgtgaccatacggtgtcggcgacgcatggagatatggatcagaacacgagagacatcatcatgagagagttcaggtcgggatcttcgcgtgtgctgatcaccactgatcttcttgcgcgtggtatcgatgttcagcaagtgtctctggtgattaactttgacctgccgactcaaccggagaattacctgcaccgtatcgggagaagtgggaggtttgggaggaagggagtggcgattaactttatgacgacggatgatgagaggatgatgtctgatattcagaagttttacaatgtggttgttgaggagttgcctaacaatgttgctgatcttctctgagtctttttttttttttttttttactgttgcggcggcttggtaatttctttctttttttaccctccttttttggtaaaatgagatgaaaactcatctcatgacttcttttgttttgttggcactttaagattttcggtttaatgttacgacttctttgct

SEQ ID NO: 5216 - DNA, 717 bp, Brassica napus
ggagatcacgaggaagtttatgagcaaaccggtgaggattctcgtcaagcgcgacgagctgactctcgaaggtatcaagcagttttacgtcaacgttgacaaagaagagtggaagctcgagacgctgtgtgatctctacgagacgctggctattacgcagagtgttatctttgtgaacactaggcgtaaggttgattggttgactgataaaatgaggagccgtgaccatatggtgtcggcgacgcatggagatatggatcagaacacgagagacatcatcatgagagagttcaggtcgggatcttcgcgtgtgctgatcaccactgatcttcttgcgcgtggtatcgatgttcagcaagtgtctctggtgattaactttgacctgccgactcaaccggagaattacctgcaccgtatcgggagaagtgggaggtttgggaggaagggagtggcgattaactttatgacgacggatgatgagaggatgatgtctgatattcagaagttttacaatgtggttgttgaggagttgcctaacaatgttgctgatcttctctgagtctttttttttttttttttactgttgcggcggcttggtaatttctttctttttttaccctccttttttggtaaaatgagatgaaaactcatctcatgacttcttttgttttgttggcactttaagattttcggtttaatgttacgacttctttgcta

SEQ ID NO: 5217 - DNA, 1377 bp, Cichorium intybus
gcgggcacaaatgacgaattgctttcactgatggacaagacttcttcacatcatacgatgaagtctatgacagttttgatgccatgggtttacaagaaaacctcttaagaggcatttacgcatacggttttgagaaaccatctgcaattcaacaaaggggaattgtcccattcaccaaggggttagatgtaattcaacaagctcaatctggaaaggaaagacagcaactttttgctctggtgtccttcaacaacttgactacaatgctgtggaatgtcaggccttggttttagcacctacccgtgaacttgctcaacagattgaaaaagtcatgcgtgcccttggtgactaccttggtgtcaaagtccacgcgtgtgtaggtgggaccagtgtacgcgaagatcaacgcatcctctcagctggggtccacgttgttgttgggacacctggacgcgtgttcgacatgcttcgtaggcagtctttacggtctgactacattaagatgtttgttcttgatgaagccgatgaaatgctctcacgtggtttcaaagatcagatttatgacatcttccagttgctgccaccaaaggtccaagtcggagtattttccgcaacaatgccaccagaagccctcgaaatcacaagaaaattcatgaacaaaccagtcagaattctagtaaaaagagacgaattaaccctcgaaggtatcaaacaattctacgtgaacgttgaaaaagaagactggaaactcgaaaccctctgtgatctttacgaaactttagcaatcactcaaagtgtcatcttcgtcaacactcgccgcaaagttgactggttgaccgacaaaatgagaagccgggaccacacggtctccgccacacacggtgacatggaccaaaacacgcgagacataatcatgcgtgagtttcgatccggatcctcgcgtgtcttaatcactacagatcttttggccaggggtattgatgtccaacaagtttctcttgttatcaactatgaccttccaacccaaccggaaaattacttgcataggattggaagaagtggaaggtttggaagaaaaggtgttgcgattaattttgtgactttggaagatgaaaagatgctttcggatattcagaagttttacaatgtggttgttgaagagctgccttcaaatgttgctgatttgatttgaaaagattttgttgggtgagaatgatagtttttggggggtttaacattagattgtttagatgaattccgtctgtttttgttaattcgagtatactgggtatgcgggtctatctgttgtttatggtttcagttttatttaaattagacgaaagaattttgatcatggatgattaacatttagcttta

SEQ ID NO: 5218 - DNA, 729 bp, Taraxacum officinale
  misc_feature (337)..(337): n is a, c, g, or t
  misc_feature (723)..(723): n is a, c, g, or t
gcggggtcagtcggggtcttttctgcactatgccaccagaagccctagaaatcaccagaaagttcatgaacaaacccgtaagaattctcgtgaaaagagacgaattaacccttgaaggtatcaaacaattctacgtgaatgttgaaaaagaagactggaaactggaaacactttgtgatcttttgaactttggcaatcactcaaagtgtcatttttgtcaacactcgccggaaagttgactggttgaccgacaaaatgagaagccgggaccacacagtctcagccacccatggtgacatggaccagaacactagagatataatcatgagggagtttnggtctggatcttcacgtgtcttaatcactacagaccttttggccaggggtattgatgtccaacaggtgtcacttgttatcaactatgaccttcctacacagcctgagaattatttgcataggattggaagaagtggaaggtttgggagaaagggagttgccattaattttgtgacattggaagatgagaagatgttgtcggatattcagaagttttacaatgtggtggttgaggagttgccttcaaatgttgctgatttgatttgatttggaaatggttttttttgtctgttgagagagatgctttttgggtatggattaattaacctttagtttattttagatgaatgctatctgttttctttattcaagtattctgtttttttnggggtt

SEQ ID NO: 5219 - DNA, 1025 bp, Petunia hybrida
agtgtccgtgaggatcaacgcatcctttcaagtggggttcacgttgttgtgggaactcctgggcgtgtatttgacatgttaagaagacagtccctacgccctgatcacattaaaatgtttgtattggacgaggctgatgaaatgctttccaggggtttcaaggatcagatctatgatattttccagctcttgcctcctaagattcaggttggtgttttctctgccacaatgcctcctgaggcccttgagatcacaaggaagttcatgaacaaacctgtgagaatccttgtgaagcgtgatgaactcaccttagaaggtatcaagcagttttatgtgaatgtggaaaaggaagaatggaagcttgagaccctttgcgatctgtatgagaccttagcaatcacacagagtgtgatatttgtgaatactcgtcgcaaggttgactggttgacagacaagatgagaagcagagaccatactgtctcagccactcatggtgacatggaccagaacactagggatataataatgcgtgaattccgatctggttcctctcgtgttctcatcaccactgatcttttggccagaggaattgatgtccaacaagtttcccttgtcataaattatgatctacctactcaacctgagaattaccttcatcgcattggacgtagtggccggtttggtaggaagggtgttgctatcaactttgcgaccaaggatgatgagagaatgctgtccgacattcaaaggttttacaacgtggtggttgaggagctgccagcaaatgtcgctgatctcctgtgaacagctttttcttgcttagactctaatcattatcggatggcaggcgattgtttgctttggccatctccacaatttcccctcttttcttgtttatctttattttaatccttttctttgtttaatttgctagtcctagtctctaaggttctaaactcttgagtaacgcccattaacatgtgtagtccatcaactcatgtagtggtggggttttgcttgttttt

SEQ ID NO: 5220 - DNA, 1470 bp, Helianthus annuus
  misc_feature (1017)..(1017): n is a, c, g, or t
aacgaacgattgaactccacaaaaccctaaaaagcttccgcaaactccaattttcagatcaatctcttcaaattacaagtcatggcttccgaaggtaatcagtttgatgctggccagtttgattcgaaaatgaacgagctgctttcatccgatggacaggatttttttacatcatatgacgaggtttatgatagtttcgacgccatgggtttgcaagaaaacctattgaggggcatttatgcatacggtttcgagaaaccatccgcaattcaacaaaggggaattgtccccttcaccaagggtctagacgtaattcaacaagctcaatccggaaccggaaaaaccgcaaccttttgctccggtattcttcaacaactcgactacaaaaccgtcgaatgccaggccttagttctagccccgactcgtgaacttgcacaacaaattgaaaaagttatgcgagcccttggtgactacctcggtgttaaggtacacgcttgtgttggtgggaccagtgttcgtgaggaccaacgtatactctcagctggggtccacgttgttgttggtacacctggacgtgtgttcgacatgcttaggagacagtcgttacgttctgactacattaaaatgtttgtgttggatgaagctgatgaaatgctttcaagaggtttcaaggatcagatttacgatatcttccagctattgccatcaaaggttcaggtcggagtattttctgcaacaatgccacccgaggcactcgagatcacaagaaaattcatgaacaaacccgtaagaattctcgtaaagcgtgatgaactcacgttagaaggtatcaaacaattctacgttaatgtcgaaaaagaggagtggaaactcgaaaccctctgcgacctttacgaaaccctagcaatcacccaaagcgtgatcttcgtcaacacccgccggaaagttgactggttgaccgacaaaatgagaagccgtgaccataccgtgtcagctacacacggtgacatggaccanaacacacgtgacatcatcatgcgtgagtttcggtctgggtcatcgcgtgtgttgatcacaaccgatcttttggcgcgtggaattgacgtacagtaagtttcgcttgttatcaattatgatttaccgactcagccggaaaattatcttcacagaattgggcgtagcgggcggtttggtagaaaaggtgttgcgattaattttgtgacgttggatgatgagcgaatgcttgcggatattcagaagttttataatgtggtcgttgaggaactgccgtcaaatgtcgctgatcttatttaaactcgattcgccaagagaggttggagtctgtaacctttcttcctttttgatgtttcttgctgttcaagttaatttttagagagttatgttttatcagtttatgagatacaagtttaattgttaggtttatatctagtggacaaagtgtattgattc

SEQ ID NO: 5221 - DNA, 1325 bp, Triphysaria pusilla
  misc_feature (1292)..(1292): n is a, c, g, or t
  misc_feature (1312)..(1312): n is a, c, g, or t
gcagaggggaattgttccattctgcaaaggactcgatgttatccagcaggctcagtctggaacgggaaaaactgctacattctgctctggtattttgcagcagcttgattatggtttgactcagtgtcaggctttggttttggcacccactagggagttggctcagcagatcgagaaggttatgcgtgcccttggtgactaccttggcgtcaaggttcatgcttgtgttggtggaaccagtgttcgtgaggaccaacgtatcctttctgctggtgtccatgttgttgttggaacccctggtcgtgtgtttgacatgttgcgcaggcaatctcttcgctctgacagcattaagatgtttgttctggatgaggctgatgagatgctttctcgtggttttaaggatcagatttacgacatcttccagctcctccctgccaaggtccaagttggtgtgttctctgcaacaatgccacccgaggcccttgaaatcactcgcaagttcatgaacaagcctgtccgcatcctggtcaagcgtgacgagctcaccctcgagggtatcaagcagttttacgtcaatgtcgagaaggaggaatggaagctcgagacactctgtgacctttacgagactctggccatcacccagagtgtcatcttcgtcaacaccagaagaaaggtcgactggctgaccgacaacatgcgtacccgtgaccacactgtctctgccacccacggtgacatggaccagaatacccgtgacatcatcatgcgtgagtttcgctcgggctcgtcccgtgtcctcattactaccgacttgctggcccgtggtatcgatgtgcagcaagtttcgcttgtgatcaactttgacctgccgactcagccggagaactatctgcatcgtattggtaggagtgggaggtttgggagaaagggtgtggcaattaacttcatgacgactcaggatgagaagatgctgcaggatatacagaagttctataatgtcgtggttgaggagctgccgtcgaatgttgccgatctgctttgaggagttgtttctgttagggttttgttatggtaaatggggccacaatggagtttttaattttttttattttaatttttgttgctagataatttatggtattctgttttattgttgttgatttttattttgcggagattactatctttgttccaccacttgtgaaagtggagaatttgcttatttcattagtggtggccaatattacatactaatgcaattttgtatgtaacgtattttggattttggcccnagttttggttttaaattctnatttagttatcga

SEQ ID NO: 5222 - DNA, 776 bp, Juglans hindsii x Juglans regia
  misc_feature (320)..(320): n is a, c, g, or t
  misc_feature (359)..(359): n is a, c, g, or t
  misc_feature (419)..(419): n is a, c, g, or t
  misc_feature (443)..(443): n is a, c, g, or t
  misc_feature (511)..(511): n is a, c, g, or t
  misc_feature (530)..(530): n is a, c, g, or t
  misc_feature (542)..(542): n is a, c, g, or t
  misc_feature (570)..(570): n is a, c, g, or t
  misc_feature (572)..(572): n is a, c, g, or t
  misc_feature (580)..(581): n is a, c, g, or t
  misc_feature (694)..(694): n is a, c, g, or t
agggcaagcccgtgagaatcttggtaaagcgtgatgaactcacccttgagggtatcaagcagttctatgtcaatgttgataaggaagaatggaagcttgagacactctgtgatctctatgagacactggccatcacccaaagtgtcatttttgtgaacacacgacgcaaggttgactggctcactgacaagatgcgaagccgtgaccacactgtgtcagccacccatggtgacatggaccagaacactcgcgatataattatgcgtgagttccgctctggttcttcacgtgttctcatcaccactgatctgttggctcgnggtattgatgtgcagcaagtgtccctagtcataaacttngaccttcctactcaaccagaaaactaccttcatcgtattggtcgaagtggacggtttggnagaaagggtgttgccataaatttngttacaaaggatgatgaaagaatgctgtatgacattcagaagttctataatgtggtcatcgaggagcngccaaataatattgctganctcctgtgatgngcctttttggtttggttgaggcataggngnttttcctnntaacgagtactaattaaggtttttagtttcattctctcttcctccctcttatctagtctcctaagttaatgctcccaaacatatctgaccgtttaatgaattgggtttagggntgtgcattattgcaatataaagactcgaagtgaagttgccagtttcggagtaaaaggattcttgaaattttgttttgtttat

SEQ ID NO: 5223 - DNA, 306 bp, Solanum lycopersicum
cactagagacatcatcatgagggagttccggtctggctcctcccgtgtgctcatcaccactgacctgcttgctcgtggtattgatgttcagcaggtgtccctggtcatcaactatgatcttcccacccagccagagaactacctgcatcgtattggtcgtagtggtcgttttggtaggaagggtgttgccatcaactttgtgacccgcgacgacgaacgtatgctgtttgacattcagaagttctacaacgtgttgattgaggagctgcctgccaatgttgctgaccttctgtgatcaatttcaag

SEQ ID NO: 5224 - DNA, 1270 bp, Solanum phureja
tctttcttgtcatggcgggtgcagctcctgatggatcccaatttgatgctcgtcaatttgattcaaaaatgacagagttgctaaatgctgaagggcaagagttttttacctcatatgacgaggcttatgatacttttgatgctatggaattgaaggagaagctcctgagaggcatttatgcatacggttttgagaagccctcagcaatccagcaaaggggaattgtacctttttgcaaaggtcttgatgtgattcagcaggctcagtctggaacgggaaagactgctactttttgttctggagttctgcaacaactggactatgaactgttagattgtcaagccttggtcttggcacctactcgtgagcttgcacaacaaattgagaaggtcatgcaagcacttggagactatcttaaagtcaaggttcatgcttgtgtgggaggtaccagtgtccgtgaggatcaaaggatcctttcaagtggggttcatgttgttgtgggaacacctggacgtgtatttgacatgttgagaagacagtctctccgccctgatcacattaagatgtttgtattggatgaggctgatgaaatgctctccagagggttcaaggatcagatctatgatattttccagctattgcctcctaagattcaggttggtgttttctctgccacaatgcctcctgaggcccttgagatcacaaggaagttcatgaataaacctgtgaggattcttgtgaaacgggatgaactgaccttagaaggtatcaaacagttttatgtgaatgtggaaaaggaagaatggaagcttgagaccctttgcgatctatatgaaaccttagccatcacatagagtgtgatttttgtgaatactcgtcgcaaagttgacttgttaacagaccagatgcaaagcagagaccatacagtctcagctacccatggtgacatggaccagaacactagggatattataatgtgtgaattccgtactggttcctctcgtgttctcatcaccactgatcttttagccagaggaattgatgttcaacaagtctccctcgtcataaactatgatctccccactcaacctgaaaattaccttcatcgtattggacgtagtggacggtttggtaggaagggtgttgcaatcaattttgcaaccaaggatgatgagagaatgctttctgacattcagaggttttacaacgtggtgattgaggagcttccagcaaatgtcgctgatctcctataagcttcctgctctgatgg

SEQ ID NO: 5225 - DNA, 469 bp, Antirrhinum majus
cacgaaggaaagtcgactggcttaccgacaaaatgaggagcagagacccactgtttcagccactcatggagacatggaccagaatactcgtgacattatcatgcgtgaattccgttctggctcgtctcgtgttctgatcaccactgaccttttggctcgtggtattgatgttcagcaagtttctcttgtcatcaactacgatcttccaactcagcccgagaattatctgcatcgtattggaagaagtggaaggtttggaagaaagggagtttccattaacttcctgacaaaggaggatgagaagatgcttcaagatattcagaagttttacaatgttgtggttgaagagctcccgtccaacgtcgctgatcttctttgaagtgggtcttgttcctaggtttcgatttcagtaagaggggtctgtagaagtatattttgccgggcaatgtctattactttcttgattagg

SEQ ID NO: 5226 - DNA, 1135 bp, Trifolium pratense
  misc_feature (538)..(538): n is a, c, g, or t
  misc_feature (592)..(592): n is a, c, g, or t
  misc_feature (626)..(626): n is a, c, g, or t
  misc_feature (796)..(796): n is a, c, g, or t
  misc_feature (906)..(906): n is a, c, g, or t
tggtactcctggtcgtgtgtttgatatgttgcgtagacagtctcttcacccggataacatcaagatgtttgtgttggatgaggctgatgagatgctttctcgagggttcaaagatcagatctacgatatatttcaactgctgccaaataagattcaggtgggagttttctctgctacaatgcctcctgaggcacttgagatcacaagaaagtttatgaacaaacctgtgaggatccttgtgaagcgtgatgagctgaccttggagggtattaagcagttttacgtcaatgttgacaaagaggaatggaagctggacacactctgtgatctttacgagacactagccatcactcagagtgtcatttttgttaacaccagaagaaaagttgattggttgactgacaagatgcgaagccgagaccatactgtctcagctactcatggagacatggatcagaataccagagacattattatgcgtgaattccgttctgggtcttctcgtgttttaataactaccgatctcttggcacgtggnattgatgtccaacaagtgtctttggttattaattttgatctccctacacagccngagaactatctccatcgtattggtcgtagtgganggtttggtagaaaaggtgttgccattaacttcgtcacaaaggatgatgaaacaatgctgcatgatatccagaagttttacaatgtgatagttgaggagctgccatcaaatgttgctgagcttctctgatgagattttgtcctccatatattagacaaaaattagtacctntggtaagtgttatgtagtatttggccctgccccttctttttggttttatttccgcttttgaactttctttgatagtcttggtaatttatgtttcattgtcaagttgtctnagttattcaaggggataggtgctttgcattgtggatttccattattggccaattggtgtttgacactcgttgcacatttctagaaggcaatttttctagtgtgcattttaacttgaactttaaacacattgttttttttttcttcttttcttttctttctagtgtgcattttaagtatttgagatgatatgtgatgtgtggtatactagcattagcctcgttgagattt

SEQ ID NO: 5227 - DNA, 749 bp, Cynara scolymus
  misc_feature (743)..(743): n is a, c, g, or t
ttgccgtcaaggttcaggttggagttttctctgcccgatgccaccagaggctctcgagatcaccaggaagttcatgaacaaaccggtgaggattcttgtgaagcgtgatgaactcaccttagaaggtattaagcagttctacgtgaacgttgaaaaagaagaatggaagctcgagactctttgcgacctttacgagactttagcaatcacccagagtgtcatcttcgtgaacacccgaaggaaggtcgactggctgaccgataatatgagaagccgtgaccacacagtctcggccacacacggagacatggaccagaacacacgagacatcatcatgcgggaattccgttctggttcttcccgtgttctcatcaccacggatctgttggcacgtggtatcgatgtccaacaagtttcactcgtgataaactacgatctgccgacacagcctgaaaactacctccaccgtatcggacgaagtggtcggtttggaagaaagggggtggcgattaatttcgtgaagttggatgatgagaagatgctggcggatatccagaaattttacaatgtgacggtggaggagctgccgtcgaacgttgctgatctgatctgatctgatctgaaattgaatttggtatgttgttttttgtttaagttaaggttttaacggtagagactgcgcccatgtttgtaccttaattcctggaatcgttattcgtttcaattctatcttttactatgcnttcacc

SEQ ID NO: 5228 - DNA, 780 bp, Adiantum capillus-veneris
ggattggaagcttgatactctctgtgatctatatgagactcttgcgatcactcagagtgtcatttttgtcaacactcgccgtatgggtgattggcttacggacaaaatgagagcaagagatcatacagttgcggcgactcatggagacatggaccaaaataccagagatattattatgagggagttccgatctggatcttctcgagtgctcataaccacagatcttcttgctcgagggattgacgtgcagcaggtttcccttgttatcaattatgatttgcctacccaacctgaaaactatctccacagaattgggcggggtggccgctttggtagaaagggagtggcaatcaactttgttaccaaagaagatgaaaggatgctgaaagacattcaaaggttttacaatgttgtggtagaggaactaccatctaatgttgcagatctcatataggagatatgtgcagtggtcaagggctggggtctttttcccgattttatgcaggctcctggccaagattttgtttgggctagaaggaataatggtttcttgagcaaatgcaagttttcgtcagtcacattattgggagtcaattatatctagtattttgtgcaattatccttcttgatggttcgggtctgtcactgcccattgccttctttatcatcaatggcagacttgtatgttgagctggaaagtgccctgttttggagttttggtttgtatttctggatttacctgacttccatgggggcgcgatttggattccgcttttttcc

SEQ ID NO: 5229 - DNA, 877 bp, Raphanus sativus
gatttacgacatcttccagcttcttccttctaaggtccaggtcggtgtgttctccgcaaccatgccgcctgaagctctcgagatcacgaggaagttcatgaacaaaccggtcaggatccttgtcaagcgggacgagctgacactcgaaggtatcaagcagttctacgtgaacgttgacaaggaagagtggaagctcgagacgctttgcgatctctacgagacgctggccatcactcagagcgtcatctttgtgaacacgaggcgtaaggttgattggttgaccgataaaatgaggagccgtgaccatactgtctcggccacgcacggggatatggatcagaacacgagagacatcatcatgcgcgagttcaggtctggttcttcgcgtgtgctcataaccactgacctccttgcacgtggtatcgatgttcagcaggtgtctctggtcattaactttgacctgccgacgcagcctgagaactaccttcaccgtattggaagaagtgggaggtttgggaggaagggagtggcgatcaacttcatgacaagtgatgatgagaggatgatgtctgatattcagaagttttacaatgtggtcgttgaagagttgccaaacaatgttgctgatcttctctgagtcctcctgttgtggcagcatggtaacttctttctttctttttttaccgagaaactgctgaattttactacgttttgtttccagtttactttagagtttttggcaaaatgagaagagaactcatctcatggctttattgttttgttggcattatgttataactttcttgttacgtgactctcaagtttctatttctctaaaacaatgttttatttaatttacttggtggagtttgggcga

SEQ ID NO: 5230 - DNA, 740 bp, Raphanus sativus
aagttcatgaacaaaccggtcaggatccttgtcaagcgtgacgagctgacactcgaaggtatcaagcagttctacgtgaacgttgacaaggaagagtggaagctcgagacgctttgcgatctctacgagacgctggccatcactcagagcgtcatctttgtgaacactaggcgtaaggttgattggttgaccgataaaatgaggagccgtgaccatactgtgtcggccacgcacggggacatggaccagaacacgagggacatcatcatgcgcgagttcaggtctggttcttcgcgtgtgctcataaccactgaccttcttgcacgtggtatcgatgttcagcaggtgtctctggtcattaactttgacctgccgacgcagcctgagaactaccttcaccgtattggaagaagtgggaggtttgggaggaagggagtggcgatcaacttcatgacaagtgatgatgagaggatgatgtctgatattcagaagttttacaatgtggtcgttgaagagttgccaaacaatgttgctgatcttctctgagtcctcctgttgtgtggcagagcatggtaacttctttctttctttttactgcagttttactatgtttttgtttccagcttactttagagtttttggcaaaatgagaagagaactcatctcatggctttattgttttgttggcattatgttataactttcttgttacgtgattctcaagtttctatttctctaaa

SEQ ID NO: 5231 - DNA, 644 bp, Thellungiella halophila
cagcgactcacggagacatggaccagaacacgagagacgtcatcatgagagagttcaggtcgggatcgtcgcgtgtgctcatcacaactgatctcttggctcgtggaatcgatgtgcagcaagtgtctctggttatcaactacgatctgccgacacagccggagaattacctccaccgtatcggaagaagtggaaggtttgggaggaaaggtgtggcgatcaacttcgtgacacgagacgacgagaggatgctgtttgatattcagaagttctataatgttgttgttgaagagcttccttccaacgttgcggatctgctttgaagagccaagtgccatccatctcaatccaattgctgctattcttcttgcttaaaggttgcggatctgctttgaagagccaagtgccatccatctcaatccaattgctgctattcttcttgcttaaaggatcccatcctcccttggtctaacacccagtttttttttttggtttttaatgttttaaaaatttgttaaaaaaagcctatgatctattatctttttttttttgggttaaagaacaaaccttttgattatctattattatctaaacttattttgcattctaaactatcccatatttaatacttcttttattttttt

SEQ ID NO: 5232 - DNA, 1084 bp, Persea americana
aatttatgaaccgtcccgtcagaattttggtgaagcgagatgagctgactctagaggggatcaaacagttttatgttcaggtcgacaaagaggaatggaagctggagactctttgtgacctttatgagactctggccatcacccagagtgtcatctttgtcaacactcgccgtaaggttgattggttgactgataagatgcgaagccgtgatcacacagtgtctgcaacccatggtgatatggaccaaaacactagagacatcataatgcgtgaatttcgttctggatcttctcgtgtgctcatcaccactgatctgttagctcgtggtattgatgtccagcaggtctctcttgtcataaactttgacctgccgacacagccagagaactatctccatcgtattgggcgtagtgggcggtttggaaggaagggcgtcgcgatcaatttttgacacgtgaggatgaaaggatgctggcagatatccagaggttttataatgtgctggtagaagagctgccatcaaatgtggcagacctcctctaatgaggttttgttttttccctccttttccaatctgagttggttttttcaggtgtttactgctattaatggctttgaagatgtgagtacttctattatcttattgtcaaattgatccaactatcgagttatattgcgggtttcacatttgcaatgttagattccagcggtgccattttaggcgatggggcattcatggagatgcatccattacaaattttgttcgagttgtattttatgcttttaatattttggtagttttaattcatatcatgattgttcaagtttttcaactttcttatccaactggtgttcaagtgtgtgccataatagtgtttaatgtgtggagggtctgttgttattattattaatttttcttttttgttaaacggctgtgaaatgtgtatatcaaagaccaatattgataatgtgtgctcaagggcaactaaaagtaaagataagacttaaatatgatgatttatggaaataacaaatctctcttacatatccagatttaacaagcttggacagattgcatggtag

SEQ ID NO: 5233 - DNA, 1785 bp, Medicago truncatula
ggtatcactttacactctcgtacactactctctttcgttttcatccctcaactccgcggcgtagatccggggagtttttgggaaaccctaaatccgttcactaactccgttactttttccgttcctccactctcaagttatggctggacttgcacccgaggggtcacaattcgatgctgggaaatttgatcaaaaaatgaatgacttgattgcagctgatggagatgagttctggacttcttacgatgaggtttatgatagttttgatgctatgggtttggcagagaatctcctcaggggaatttatgcatatggttttgaaaagccatctgccattcagcaaaggggcatagttcccttctgcaagggacttgatgttattcaacaggctcagtctggaaccgggaaaacagcaactttctgctctggtgttctccagcaacttgattacaatgtgactcagtgccaggccttggttttagctccaactcgtgaactcgctcagcagattgagaaggttatgcgtgcgcttggagactatctaggtgttaaggtgcatgcttgtgttggaggtacaagtgttcgtgaagaccaacgtattctatcaactggtgttcatgttgtggttggtactcctggtcgtgtgtttgatatgctgcgcagacagtctcttcacccagattacatcaagatgtttgtgttggatgagctgatgaaatgctttctcgaggtttcaagatcagatctatgatatcttcagctgctgccggtagattcagtagagtttctctgctacaatgcctcctgaggcacttgagatcacaaggaagtttatgaacaaacctgtgaggatccttgtgaagcgtgatgagctcaccttagagggtattaagcagttttatgtcaatgttgagaaagaggagtggaagctggacacactctgtgatctttatgagacattagccatcactcagagtgtcatttttgtgaacaccaggaggaaagttgattggttgactgacaaaatgcgaagccgagaccatacagtctcagctactcacggagacatggatcaaaataccagggacattattatgcgtgaattccgttctgggtcttctcgtgttttaataactaccgatctgttggctcgtggtattgatgtccaacaagtgtctctggttataaattttgatctccctacgcagcctgagaactatctccatcgtattggtcgtagtggaaggtttggtagaaaaggtgttgccattaactttgtcacgaaggaagatgaaggaatgctgcgagatatccagaagttttacaatgtgttagttgaggagctgccatcaaatgttgctgagcttctctgatgagattttgtcctccatatattagacggaaattagtacttttggcatgtgttatgagtatttactttacaccctccccttttggttttatttctgcttttgaactttgtctgtttgatagtcttggtaatttatgttgcattttgaagttgtctgaatatccaaggggtaggtacttgcattgttgaattcattattggccaaattggtgttagacactcttgcttatttctagaaggcaatttttctagagtgagttttaacgttatttgtttatttgtttaaaaaaaaaaaaaaaaaactcgagggggggcccggcacccaattcgccctatagtgagtcgtattacaattcactggccgtcgttttacaacgtcccgactgggaaaaccctggcgttacccaacttaa

SEQ ID NO: 5234 - DNA, 633 bp, Solanum phureja
tatccatgtgtctatattggcagatatatgatattttccaaatgctgcctaccaaagttcaagtaggagtgttttctgcgaccatgccaccagaagcccttgacatcacaagaaagttcatgaataagcctgtgagaatcctggttaaacgcgatgaattgacactcgagggtatcaaacagttctatgtcaatgttgataaggaggaatggaagcttgagacgctctgtgatctatacgagacacttgccatcactcagagcgttatctttgtgaacactaggcgcaaggtcgattggttaacggacaaaatgagaagccgtgaccacacggtttcagctacacatggagatatggaccagaacactagagacataatcatgcgtgagtttcgttctggttcttcccgtgtccttatcacaactgatctgttggcccgtggtatcgatgtacaacaagtatcccttgttatcaactatgatctcccaactcagccggagaattatctccatcgtattggaagaagtggaaggtttggaaggaaaggagttgcaatcaactttgtgacaacagacgacgaaagaatgttgtttgatattcaaaaattctacaatgtggtcatcgaagaactcc

SEQ ID NO: 5235 - DNA, 633 bp, Solanum lycopersicum
tatccatgtgtctatattggcagatatatgatattttccagatgctgcctaccaaagttcaagtcggagtgttttctgcgaccatgccaccagaagcccttgacatcacaagaaagttcatgaataagcctgtgagaatcttggttaaacgtgatgaattgacacttgagggtatcaaacagttctacgtcaatgtagataaggaggaatggaagcttgagacgctctgtgatctatacgagacacttgccatcactcagagtgttatctttgtgaacactaggcgcaaggtcgattggttgacggacaaaatgcgaagccgtgaccacacggtttcagctacacatggagatatggaccagaacactagagacataatcatgcgtgagtttcgctctggttcttcccgtgtccttatcacaactgatctgttggctcgtggtatcgatgtacaacaagtatcccttgttatcaactatgatctcccaactcagccggagaattatctccatcgtattggaagaagtggaaggtttggaaggaaaggagttgcgatcaactttgtgacaacagacgacgaaagaatgttgtttgatattcaaaaattctacaatgtggtcatcgaagaactcc

SEQ ID NO: 5236 - DNA, 4744 bp, Brachypodium distachyon
aatataagcacccgcatcttcctcttcctctctctcttgctccaccaaaccctcgctcgctcgtcgtcctcctcgccgcgaaaaaaagtcccccccccacccccccaccgcccaccgaccaaaaggatcgaatccgagactacaatctcggattcgctcgagatcaaccaaccaacaacacgcagcagcaacccggatccgttcgtctccttcaacccgctcgcttcagtcatggcaggaatggcaccagagggttcccagtttgatgctaagcattacgacaccaagatgaccgagctcctgaaccaaggtgaaaccgaggagtttttcacttcgtatgatgaagttcatgaaagttttgatgacatgagcctccaagagaacctgcttagaggcatctacgcttatggttttgagaagccatcggccattcagcaaagaggaattgttcccttctgcaaggggcttgacgttattcagcaagctcaatctggaacaggaaaaactgctaccttctgttctggaatcttacagcagcttgactatggattggtcgagtgccaggcattggtccttgctccgacccgtgagcttgcacagcagattgagaaggttatgcgtgctcttggtgactacttaggtgtcaaggtgcatgcatgtgttggtggaacatctgttcgtgaggaccaaaggatccttgccagtggtgtgcatgttgttgtgggcacgcctggtcgtgtgttcgatatgctgcgcaggtcatctctccgcccagatcacatcaagatgtttgtgctggatgaagctgatgagatgctttcacgtggtttcaaggatcagatctatgatatcttccagctccttccatcaaagattcaggttggagtgttttctgctaccatgcctcctgaggcccttgagattacccgcaagttcatgaacaaacctgtgaggattcttgtgaagagagatgagcttacccttgagggtatcaagcaattctatgtgaatgtggagaaggaagagtggaagctggatactctctgtgacctgtacgagaccttggcaattacccagagtgttatctttgtgaacacccgccgcaaggtggactggctcactgacaagatgaggggaagggatcacaccgtctctgccacacacggagacatggaccagaacactagggacatcatcatgagggagttcagatctgggtcttctcgtgtgcttatcaccactgacctgcttgcccgtggtattgatgtccagcaagtctcccttgtcatcaactatgacctgcccactcagcctgagaactacctccaccgcatcggacgtagtggtcggtttgggaggaagggagttgccatcaactttgtcacccgtgaagacgagaggatgctcttcgacatccagaagttctacaatgtggtcatcgaggagctcccggccaacaccccttcttggaggaggggcaacgaacaaccaaacttggagcggaaaaaaagatcacccggttgttgtgttcccgtcttccggcttgcaagcaaagcggagatccccttcgacccgcacagccaactagccaaggcaggcggctccgtgctctctcgctctagtctcgctcccccgaaccctagccacagcccagctcgacccgtcgcgtcgaagatcctcagccatgtcgccgcccgagaaccccaacggcggtgccgccgcggcgccctcggagcccgcgcagccgcccaagccctcctcctcgtcgacttccaaggggaagggtaagaaggacgagaagaaggacgacgatctgtcggaggaggacttggcgctcaaggagcagctcgagctctacgtggtgcgggcgcaggacacggatcccggcgtgcagaagctcgccctcgagagcatgaggcaggagattcgttcagctaccagctcgatgacgtccgtccccaagcccctgaagttcctccgcccacactatggaaccctaaaatcgtactttgaaagcatgcaagagcctgagctaaagaagtacatggctgacatactatcggtgttggccttgacaatggctgtcgaaggagaaagagagagccttaagtaccgtttgttgggttctgaaggggacattggttcctggggtcatgaatatgtgaggaatcttgcaggtgaaattgctcaggaattccaaaagcgccagggtgatgagatgccaattgatgccttgatggaactagtgcagcaaattgcctcatttcacatgaagcacaatgctgagcctgaagctgtggatcttctgatggaggttgaagaccttgatttgctggttgagcatgttgactcaacaaactacaaaagagcttgcttgtatcttaccagttcatttaaatatcttcctggccctgatgatgcattagcacttgatatagcatataccatttacatgaagtttagggaccttacaaatgcgttgcgcattgccctgcttcttgataacaagtccgcacagtatgtgaagcaggtctacacggcgactgatgatctttcactcaagaagcaattctcttacatcatcgcacgccatggtttggccatggagattgatgatgagatagctgcggatgaaaatgataaggaaattttgcaagaaatagttaataacagtaagctgagtgaggggtacctcactcttgctcgtgatattgaagttatggaggcaaaatctccggaggatatatataaggtccatttaattgatggtcgtggtgccagttccagtcttgattctgcaagacagaatttggccgctacatttgtcaatgcgtttgttaatgctggatttggccaggataagctgatgactgctccatctgattcatccagtagcgggtcttctggaaactggttatttaaaaataaggaacatggaaaagccagtgcagcagctagcctgggaatgattctcctgtgggatactgattctgggcttgctcagctcgacaagtacttgcacagtaatgatactcatgttgttgctggagctttgctcggcattggagttgtcagctgtggtgtgaagaatgaatgtgaccctgcacttgctattctcttggagtatattaacaaggacgacccaaacataaggattggggcaatcttagggcttggtattgcatatgctggttctcagaaagatgagctaagagtgcaactatcgatggtattgggagaaccccaagcaacacttgaggtcttggtcttcacagccgtcgccttgggattggtgtttgttggttcttgtaatgaagagattgcacagtccatcatatttttcttaatggagcgtagtgaagccgagcttgcagaaccaattatacgcttgctccctgttgcgcttggccttctatttcttggaaaacaggagaatgttgaggctaccgctgaggttgctaaaacatttgatgagaaaatcaggaagtattgtgacgtaacacttatgtcccttgcatacgctggaacagggaatgtacttaaggttcagaaactactaggtatttgctcacagcatcttgagaaaggcgaaacacaccaaggaccagctgtccttggaattgctcttattgccatgtctgaagaattaggagctgaaatggctgtacgatcacttgagcgtctcttacagtatggcgagcagaatattagacgagctgtccctcttgctcttggtatactctgcatttcgaatcccaaggttaatgttatggacacactgagcagattgagccacgacgcagacgcagatgtttcaatggctgcgataatctcattgggtttgattggtgctggtacaaataatgccagaatagctggtatgcttcgtaatctttcgagttattactacaaagaagctgctcatctattctgtgtaagaattgctcaagggcttgttcaccttgggaagggtttgttgacgttgtctccataccattccgaccgatttcttctttccccgatggcacttggaggaattgtcactgttttgcatgcctgccttgatatgaagtccaccattttagggaaatatcactacattctttacattattgtcttggctatgcagcccaggatgcttttaacggtggatgaagatctgaagcctcttcctgttccagtgcgggttgggcaagcagttgatgtggttggccaggcaggaagacccaagacaattactggctttcagacacatacaactcctgtcttgcttgcagctggagagcgagcagaactggcgactgagaagtacctccccctgacatcgacattggagggctttgtaattctgagaaagaaccctgaataccatgaggaatgagggaagttcctaggcttgatctgatgcaagttttggggctcaccagcatggaaggactcggaggtctggttgtcgtcgttgatcatattttgctcttccatctctcaacttcctcggcacttgctggtggttcattcacatagactttttatttcgtccaccaaagttgtagctcgaactgcaagcgtcgtgtttggttgagtgaatgaccagcacgccacttctacccaaactggggggaccaagtaggagttcagttgcagttttatttcttccttaagcttatttgtatatgtgtcttaagtatgtgcactgaaaattacatctttagaactaaatacggtgtgcactttaacctttctg

SEQ ID NO: 5237 - DNA, 4218 bp, Brachypodium distachyon
cagtcatggcaggaatggcaccagagggttcccagtttgatgctaagcattacgacaccaagatgaccgagctcctgaaccaaggtgaaaccgaggagtttttcacttcgtatgatgaagttcatgaaagttttgatgacatgagcctccaagagaacctgcttagaggcatctacgcttatggttttgagaagccatcggccattcagcaaagaggaattgttcccttctgcaaggggcttgacgttattcagcaagctcaatctggaacaggaaaaactgctaccttctgttctggaatcttacagcagcttgactatggattggtcgagtgccaggcattggtccttgctccgacccgtgagcttgcacagcagattgagaaggttatgcgtgctcttggtgactacttaggtgtcaaggtgcatgcatgtgttggtggaacatctgttcgtgaggaccaaaggatccttgccagtggtgtgcatgttgttgtgggcacgcctggtcgtgtgttcgatatgctgcgcaggtcatctctccgcccagatcacatcaagatgtttgtgctggatgaagctgatgagatgctttcacgtggtttcaaggatcagatctatgatatcttccagctccttccatcaaagattcaggttggagtgttttctgctaccatgcctcctgaggcccttgagattacccgcaagttcatgaacaaacctgtgaggattcttgtgaagagagatgagcttacccttgagggtatcaagcaattctatgtgaatgtggagaaggaagagtggaagctggatactctctgtgacctgtacgagaccttggcaattacccagagtgttatctttgtgaacacccgccgcaaggtggactggctcactgacaagatgaggggaagggatcacaccgtctctgccacacacggagacatggaccagaacactagggacatcatcatgagggagttcagatctgggtcttctcgtgtgcttatcaccactgacctgcttgcccgtggtattgatgtccagcaagtctcccttgtcatcaactatgacctgcccactcagcctgagaactacctccaccgcatcggacgtagtggtcggtttgggaggaagggagttgccatcaactttgtcacccgtgaagacgagaggatgctcttcgacatccagaagttctacaatgtggtcatcgaggagctcccggccaacaccccttcttggaggaggggcaacgaacaaccaaacttggagcggaaaaaaagatcacccggttgttgtgttcccgtcttccggcttgcaagcaaagcggagatccccttcgacccgcacagccaactagccaaggcaggcggctccgtgctctctcgctctagtctcgctcccccgaaccctagccacagcccagctcgacccgtcgcgtcgaagatcctcagccatgtcgccgcccgagaaccccaacggcggtgccgccgcggcgccctcggagcccgcgcagccgcccaagccctcctcctcgtcgacttccaaggggaagggtaagaaggacgagaagaaggacgacgatctgtcggaggaggacttggcgctcaaggagcagctcgagctctacgtggtgcgggcgcaggacacggatcccggcgtgcagaagctcgccctcgagagcatgaggcaggagattcgttcagctaccagctcgatgacgtccgtccccaagcccctgaagttcctccgcccacactatggaaccctaaaatcgtactttgaaagcatgcaagagcctgagctaaagaagtacatggctgacatactatcggtgttggccttgacaatggctgtcgaaggagaaagagagagccttaagtaccgtttgttgggttctgaaggggacattggttcctggggtcatgaatatgtgaggaatcttgcaggtgaaattgctcaggaattccaaaagcgccagggtgatgagatgccaattgatgccttgatggaactagtgcagcaaattgcctcatttcacatgaagcacaatgctgagcctgaagctgtggatcttctgatggaggttgaagaccttgatttgctggttgagcatgttgactcaacaaactacaaaagagcttgcttgtatcttaccagttcatttaaatatcttcctggccctgatgatgcattagcacttgatatagcatataccatttacatgaagtttagggaccttacaaatgcgttgcgcattgccctgcttcttgataacaagtccgcacagtatgtgaagcaggtctacacggcgactgatgatctttcactcaagaagcaattctcttacatcatcgcacgccatggtttggccatggagattgatgatgagatagctgcggatgaaaatgataaggaaattttgcaagaaatagttaataacagtaagctgagtgaggggtacctcactcttgctcgtgatattgaagttatggaggcaaaatctccggaggatatatataaggtccatttaattgatggtcgtggtgccagttccagtcttgattctgcaagacagaatttggccgctacatttgtcaatgcgtttgttaatgctggatttggccaggataagctgatgactgctccatctgattcatccagtagcgggtcttctggaaactggttatttaaaaataaggaacatggaaaagccagtgcagcagctagcctgggaatgattctcctgtgggatactgattctgggcttgctcagctcgacaagtacttgcacagtaatgatactcatgttgttgctggagctttgctcggcattggagttgtcagctgtggtgtgaagaatgaatgtgaccctgcacttgctattctcttggagtatattaacaaggacgacccaaacataaggattggggcaatcttagggcttggtattgcatatgctggttctcagaaagatgagctaagagtgcaactatcgatggtattgggagaaccccaagcaacacttgaggtcttggtcttcacagccgtcgccttgggattggtgtttgttggttcttgtaatgaagagattgcacagtccatcatatttttcttaatggagcgtagtgaagccgagcttgcagaaccaattatacgcttgctccctgttgcgcttggccttctatttcttggaaaacaggagaatgttgaggctaccgctgaggttgctaaaacatttgatgagaaaatcaggaagtattgtgacgtaacacttatgtcccttgcatacgctggaacagggaatgtacttaaggttcagaaactactaggtatttgctcacagcatcttgagaaaggcgaaacacaccaaggaccagctgtccttggaattgctcttattgccatgtctgaagaattaggagctgaaatggctgtacgatcacttgagcgtctcttacagtatggcgagcagaatattagacgagctgtccctcttgctcttggtatactctgcatttcgaatcccaaggttaatgttatggacacactgagcagattgagccacgacgcagacgcagatgtttcaatggctgcgataatctcattgggtttgattggtgctggtacaaataatgccagaatagctggtatgcttcgtaatctttcgagttattactacaaagaagctgctcatctattctgtgtaagaattgctcaagggcttgttcaccttgggaagggtttgttgacgttgtctccataccattccgaccgatttcttctttccccgatggcacttggaggaattgtcactgttttgcatgcctgccttgatatgaagtccaccattttagggaaatatcactacattctttacattattgtcttggctatgcagcccaggatgcttttaacggtggatgaagatctgaagcctcttcctgttccagtgcgggttgggcaagcagttgatgtggttggccaggcaggaagacccaagacaattactggctttcagacacatacaactcctgtcttgcttgcagctggagagcgagcagaactggcgactgagaagtacctccccctgacatcgacattggagggctttgtaattctgagaaagaaccctgaataccatgaggaatgagggaagttcctaggcttgatctgatgcaagttttggggctcaccagcatggaaggactcggag

SEQ ID NO: 5238 - DNA, 1380 bp, Lactuca sativa
cggggattttctcacaaataacgcacacatattcctcaactcccggcgtcgatccgaggagtttgagaaaaccctaatcaaaagcttctactctctccctcaatctcttcaacacaaccagtcatggcgggcatagcaccagaaggatcccaattcgatgcaagacaatttgactccaagatgagcgagttgctttcagctgatggacaagacttctttacatcatatgatgaagtctatgacagtttcgatgccatgggtctccaagaaaatctcctgagaggcatatacgcatacggttttgaaaaaccatcggccatccaacaaaggggaatcgtccccttcaccaagggcttggatgtaattcaacaagcccaatcaggaactggaaaaacagccactttctgctctggaatcctccaacaacttgactacaatgtagtggaatgccaagctttggttttagccccaacacgtgaacttgcacaacaaattgaaaaagtgatgcgggccctcggtgattacttaggtgtgaaggtccacgcgtgtgtgggtgggaccagtgtccgtgaagaccaacgcatcctttcagccggggtccacgtggttgttgggacacctggacgcgtgtttgacatgctacgcaggcaatcccttcgtgctgattacatcaaaatgtttgttcttgatgaagctgatgaaatgctttcaagaggttttaaagatcagatatacgatattttccagctgttgccctcgaaggttcaggtgggggtgttctcggccaccatgccgccagaggctctggagatcacgagaaaattcatgaacaaaccggtgaggattctggtcaaacgtgacgagttgactttggaggaatcaaacagttttatgtgaatgttgagaaaaaagattggaagctggagactttgtgtgatctgtatgagacgttagcgatcactcagagtgtgatttttgtgaacacgaggaggaaggttgactggttgaccgataagatgaggagccgtgatcacacggtgtcagccacacacggtgacatggaccagaacacgagggatataatcatgcgggagtttcgttcggggtcttctcgtgttttgattactactgatttgttggcacgtgggattgatgtgcaacaggtgtctttggttattaattatgatctgccaacacagcctgagaattatcttcataggattggtcgaagtgcgaggtttgggagaaaaggtgtcgccattaattttgtgactttggaggatgagaagatgcttgcggatattcagaaagtttataatgttgtcgtggaagagctgccgtcaaatgttgctgatttgatttgaggattttggttggttt

SEQ ID NO: 5239 - DNA, 1177 bp, Nuphar advena
tgtcaggccttagttcttgctccaactcgtgagttggcacaacagattgaaaaggttatgcgagcccttggtgactacttgggtgtcaaggtccatgcatgtgttggtggtacaagtgtacgtgaggatcagcgtatcctttccagtggggttcatgttgttgtagggactcctggccgtgtttatgacatgctgcgacgacagtctcttcgacctgacaacattagaatgtttgtacttgatgaggctgatgaaatgctttcccgtggcttcaaggaccagatatacgatatatttcaactgcttccttcaaaggttcaggttggtgtcttctcagccactatgccacctgaagcattagaaatcaccagaaagtttatgaacaagccagtgaggatattggtgaagagagatgagctgaccctggagggaatcaagcaattttatgtgaatgttgataaagaggaatggaaacttgatactctttgtgatttgtatgagacactggcaatcacacaaagtgtcatttttgtgaacaccaggcgcaaagtcgactggcttacagacaatatgaggagccgagatcatacagtttctgcaactcatggagacatggatcagaatacccgtgacatcattatgagggaatttcgttctgggtcttctcgtgtcctgattaccacagatctcctggctcgagggattgacgtccagcaggtttctctggtgatcaactatgatctccctacccagccagagaactatctccaccgaattggtcgaagtggtagattcggaaggaagggtgttgccataaactttatcactcatgatgatgacaggatgctcgcagacatacagaggttctacaatgtcatcatcgaggagctgcccgccaatgttgctgatcttatttgattcagtgaagacgatctggatgggagtcgttagcttgttactcttggctcttgattataggcttttatgtctgtttttgcaacctttttaagtattgggtattgagtaggcatgaactggcacatacgtgtttttttttagtcattactgttattgttatatgctggatccttcatgtttcctgttcctttctggttttttctttttttttgaagggatactgatgcaattgaatgcaaggttttgttttatttgcaat

SEQ ID NO: 5240 - DNA, 1209 bp, Triphysaria pusilla
  misc_feature (621)..(621): n is a, c, g, or t
  misc_feature (669)..(669): n is a, c, g, or t
  misc_feature (681)..(681): n is a, c, g, or t
  misc_feature (693)..(693): n is a, c, g, or t
  misc_feature (726)..(726): n is a, c, g, or t
  misc_feature (885)..(885): n is a, c, g, or t
  misc_feature (906)..(906): n is a, c, g, or t
  misc_feature (909)..(909): n is a, c, g, or t
  misc_feature (939)..(939): n is a, c, g, or t
  misc_feature (984)..(984): n is a, c, g, or t
  misc_feature (1017)..(1018): n is a, c, g, or t
  misc_feature (1021)..(1021): n is a, c, g, or t
  misc_feature (1034)..(1034): n is a, c, g, or t
  misc_feature (1057)..(1057): n is a, c, g, or t
  misc_feature (1091)..(1091): n is a, c, g, or t
  misc_feature (1137)..(1137): n is a, c, g, or t
gacgttatccagcaagctcagtctggaactggaaaaactgccactttctgctctggcattctgcagcagcttgattacagcttgactcagtgtcaggccttggttttggcacccactagggaactggctcagcagatcgagaaggtcatgcgtgccctcggggacttccttggcgtcaaggttcatgcttgtgttggtgggaccagtgttcgtgaggaccagcgtattctttcagccggagtccatgttgttgttggaacccctggccgtgtgtttgacatgttacgtaggcaatcccttcgttctgacaacatcaagatgtttgtcctggatgaggctgatgagatgctttcgcgtggttttaaggatcagatttacgacatcttccagctgcttcccgccaaggtccaagttggcgtgttctcagcaacaatgccacccgaagccctcgatatcaccagaaagttcatgaacaagccagtccgcatccttgtcaaacgtgatgagctaaccctcgagggtatcaagcagttttacgtcaatgtcgagaaggaagaatggaagctcgaaaccctctgcgacctttacgagacattagcaatcacccagagtgtcatcttngtcaacaccagacgaaaggtcgactggctgaccgacaacatgcgcacnagggaccacacngtctcagccacncacggtgacatggaccagaacactcgtgacatnatcatgcgtgagttccgatcgggctcgtcccgagtcctcatcaccacagatttgctggcccgtggtatcgatgtgcagcaagtttcgcttgtgatcaattttgatttgccgactcagcctgagaactatttgcatcgtattggtaggagtgggaggttngggagaaagggagtggcgatnaantttatgacggttgaggatcagaagatgctncaggatattcagaagttttataatgtggtggttgaggagttgccntcgaatgtggctgatcttctttgaggatatttnnatngtataaatgaggnacaagtggtttttttatttaatntttatttttgttgctagataatgtttttcagttngtttttattttgggagattgttatgttacacacttgtgaaaggtgngcaatatgatatactaattcaattttggatgtaggtatgtaacgtattttggtttttggcctaattttggtt

SEQ ID NO: 5241 - DNA, 470 bp, Zinnia violacea
tcagccacacacggtgacatggaccagaacacacgtgacatcatcatgcgtgagtttcgttctggttcttctcgtgttctcatcaccactgatttgcatggcacgtggtattgatgttcaacaagtttcacttgtgataaactatgatcttcctacccaaccagaaaactaccttcatcgtatcgggcgtagtggacggtttggaagaaaaggtatggcgattaactttgtgactcatgatgatgaaaagatgctcggggttatccagaagttctacaatgttgttgttgaggagctaccgtccaatgttgctgacctgatctgattcggaagagtttgttatgaatttgagtcttgttttattttatttcgtttaagttattgaacgatcggatctttttggagtaggatttggagttatgtttgtaccgttagcttaattttctggactaggttgctcttttcgattc

SEQ ID NO: 5242 - DNA, 518 bp, Panax ginseng
gacattatcatgcgtgaattccgttctgggtcttcccgtgtcctcatcactactgatcttttggcccgtggtattgatgtccagcaagtttcgcttgttatcaattatgatcttcctactcagcctgagaactatctccaccgtattggacgtagtgggcgattcggaaggaagggtgttgccatcaattttgtaacaaaggatgatgagaggatgctgtttgacatccagaagttctataatgtggtggttgaggagctgccatcaaatgttgctgaactcctgtaaacgagattttgtcctactgttgttaagtgagaaaaggtaactggtttccatttgcttattgtgcttttttacccctatttaataggtctagtgtttactttaaagacattggtttattacctttttatagagtgacatgcctgcaatgtgactacgggtagttttaatagttatgtggcaaggatctgttgcgaattttgttgcaactaatgtttaaagggaaaaagaat

SEQ ID NO: 5243 - DNA, 537 bp, Cicer arietinum
gcggggattctcgtgaagcgtgacgagctcaccttggaaggtattaagcagttctatgttaacgttgagaaggaggaatggaagctggacacactccgtgatctttatgagaccctagccatcactcagagtgtcatttttgtgaacaccagaaggaaagttgattggttgactgacaagatgcgaagccgagaccatacagtctcagcaactcacggagacatggatcagaataccagggacattattatgcgtgaatttcgttctgggtcttcccgtgttttaataactaccgatctcttggcacgtggtattgatgtccaacaagtgtctctggttattaattttgatctccctacacagcctgagaactatctccaccgtattggtcgtagtggaaggtttggtagaaaaggtgttgctattaactttatcactaaggaagatgaaaagatgctgtctgatatccagaagttttacaatgtgatagttgaggagttgccatcaaatgttgcggagctcctctgatgagatttt

SEQ ID NO: 5244 - DNA, 382 bp, Gerbera hybrid cultivar
cagaacacaagagacatcatcatgcgtgaattccgttctggatcctcacgcgttgtcatcactactgatctcttggcacgtggtattgatgttcagcaagtttcccttgttataaactacgaccttcctacccagcctgaaaactacctccatcgaatcggccgtagtggacgctttgtaagaaagggtgtcgctatcaattttgtcacgttggatgacgagaggatgcttgcggacatccagaaattgtacaatgtcgtatgtagaggagctgccatccaatgttgccgatctcatttgaaacattaagttgctattattaattcatcctttcatcatgtttgtgccttaaccctttcaatttgtatggattagtttattc

SEQ ID NO: 5245 - DNA, 617 bp, Brassica oleracea
gacgtggacaaagaagagtggaaattcgaaactctctgtgacctctacgagacattagccatcactcagagtgtcattttcgtcaacactcgtcgcaaagttgactggctcacagaaaaaatgagaagccgtgaccacacagtctcagccactcacggagatatggaccaaaacacgagagacatcatcatgagagagttcaggtctggttcttctcgtgttctcatcacaaccgatctcttggctcgtggtattgacgtgcagcaagtgtctctggtcatcaactttgaccttccaactcagccagcgaattaccttcaccgtatcggaagaagtggaaggtttgggaggaaaggtgcggctattaactttgtgactcgtgatgatgagaaaatgcttgctgatatccagaagttttacaatatggttgttgaggagcttccatcaaacctagctgatctgctttgaacccttgtttcgctgatgaagaataaaaggttacttgttttgcaaggttcttgtttggttttctatccatctgtcttctcttaaagtatattttaccaactctttggaacatatgtctcgtctgactaatcttcatcttagagtctggc

SEQ ID NO: 5246 - DNA, 356 bp, Jatropha curcas
attcgagagatattatcatgcgcgaatttcgatctgggtcatctcgtgttctaatcaccactgatcttttggcccgtggtattgatgtccagcaagtctcccttgttataaattatgatctcccaactcagccagagaactatctccatcgtatcggacgtggtggacggtttgggaggaagggtgttgcaattaattttgtaacgaaggatgacgacaggatgctgtttgacatccaaaggttctacaatgtggtgattgaggagctgccatcacatgttgctgatctcctctaaatgagattttgtcttctcattgttagtagagagaaagagagagggcaattcccccccatt

SEQ ID NO: 5247 - DNA, 877 bp, Brassica napus
  misc_feature (305)..(305): n is a, c, g, or t
  misc_feature (359)..(359): n is a, c, g, or t
  misc_feature (362)..(362): n is a, c, g, or t
  misc_feature (684)..(684): n is a, c, g, or t
  misc_feature (689)..(689): n is a, c, g, or t
  misc_feature (696)..(696): n is a, c, g, or t
tccgcccaaagaacccacctagcaaattggttataacgtttttttttctgtgtggtgaatttgcagatctatgacatattccagcttctcccaccaaagattcaggtgggagtgttctcagctacaatgccaccagaagctctcgagatcacaaagaagttcatgagcaaaccagtgagaatcctgtgaaacgtgacgagctaacgctcgaaggtatcaggcagttttacgtgaacgtggagaaagaagagtataagctcgaaactctctgtgacctctacgatactttaaacatcactcagggngtcatcttcgtcaacacacgtcgcaaggtggactggctcacagaccaaatgagnagncgtgaccacacggtctcggccactcacggagacatggaccaaaacacgagagacattatcatgagagagttcaggtctggttcttctcgtgttcttatcacaaccgatctcttggctcgtggtatcgatgtgcagcaagtgtctcttgtcatcaactttgacctcccaacacagcctgagaactaccttcaccgtataggtagaagtggaaggtttgggaggaaaggtacggcgattaactttgtgactcgtgatgatgagagaatgcttactgatattcagaaattctacaatgttgctgttgaggagcttccatcaaaantcgangacctgntttgaagaaagaaaagaaaaccacgccgttgttagctggtaaagaataaaaaggttacttgtctcgcaagcttcttatttgatttttgacccatgtctcttagaattatacaccaactctttggaacatatgtcttatctgagtatttttcattttaatctcatgcaatattttttttaac

SEQ ID NO: 5248 - DNA, 523 bp, Manihot esculenta
  misc_feature (54)..(55): n is a, c, g, or t
aagagatatcataatgcgtgaatttcgatctgggtcatctcgtgttctaatcannactgatcttttggctcgtggcattgatgtccagcaggtgtcccttgttataaattatgatcttcctacccagccagagaactatctccaccgaattggacgtggtggacggttcgggaggaaaggtgttgctatcaattttgtgacaaaggatgatgacaggatgctgtttgacatccagaggttctataatgtggtgattgaggagctgccatcaaatgttgctgatcttctctaatgaggtttttgtattccattattagtagagagacaaatccctggaatttgttgtgttcttttttaaattcttgttttataggtctagttctagcatctatctaaatttgactgcctatcagtaagtgatatttgattctcaaatcttaaatttagcaatgctgctaaatatggcattgtggatttttgttgcacatgttctgataatggagatatgatggattatcatgct

SEQ ID NO: 5249 - DNA, 750 bp, Mesostigma viride
cccgaggcgctggagatcacgcgcaagttcatgagcaagccggtcaagatcctggtcaagcgcgacgagctgaccctggagggtatcaagcagttctacgtgaacgtggaccgcgaggactggaagctggacacgctgtgcgacctgtacgagacgctggccatcacgcagtcggtcatcttctgcaacacccgccggaaggtggactggctcacggacaagatgcgtgtgcgcgaccacaccgtgtcggccacgcacggtgacatggaccagaacacgcgtgacatcatcatgcgcgagttccggtcgggctcctcccgcgtgctcattaccacggatctgcttgctcgcggtattgacgtccagcaggtctccctggtcatcaactacgacctgccgctccagccagagaactacctgcaccgcatcgggcgctcgggccggtttggtcgtaagggtgtggccatcaactttgtgaccaaggatgacgagcggcttgtccaggacatccagcggttctacaacaccacgattgaggagctgccgaacaacgttgccgacttgatctaaatctggtctgaagggaaggatgagagccggcggtgtgcctgtgcgctggtttctgaggcaggacggccgcttggctgcttgaatttcggggcagagccccttttgggactgctgactggaagacgagcaatcctttataattattgcgttgcttggaagagtggactcacccccttgtaa

SEQ ID NO: 5250 - DNA, 532 bp, Antirrhinum majus
tctgccacccatggtgacatggatcagaatacccgagacattattatgagagaatttagatctggttcctcacgtgttctcatcactactgacctccttgcccgtggtattgatgttcaacaagtttctcttgtcataaactatgatttgccgacacaacctgagaattacttgcatcgtattggacgaagtggtcgatttgggaggaaaggtgttgctatcaactttgtcacaaaagatgatgatcgcatgctcgttgacattcaaaagttctataatgttgtggtcgaggagcttccggctaatgttgctgatcttctttaaggcggcactgattttctgaggttaatgtttattctgttactaggatagtttgatgtgtaatgaactttgtggttgggagattaacgacccgtgatttgcagaatggtcgtttgatcttctaattggattatagctccgaactactgttgccaaattcttggtttgctttttgtgtcgtaattgtccaaaataacttaagatttggctt

SEQ ID NO: 5251 - DNA, 1023 bp, Arabidopsis lyrata
gggaagctcctcaacaacaacattgtagaatttctgaatatcaaacagcattctctcatcatcacgagtaatgaagttaatggccacaccctttctcccgaaccttccacttcttccgatacggtgaaggtaattctctggctgagttgggaggtcaaagtttatgaccagagagacttgctgcacatcgataccacgagccaagagatcagtcgtgattagaacacgagaagaaccagacctgaattctctcatgatgatgtctcttgtgttttggtccatgtctccgtgagttgctgagactgtgtggtcacggcttctcattttgtctgtgagccagtcgaccttgcgacgagtgttgacgaagatgacactctgagtgatggctagagtctcatagagatcgcagagagtctcaagcttccactcttctttctccacgttcacgtagaattgcttgataccttcaagtgtgagctcatcacgtttcaccaagattctcactggtttgctcatgaatttccttgtgatctccagagcttccggtggcatcgttgctgagaacactccaacctgaatctttgattcaaacttggtaaagtaaaggcaaacctgatccttgaaaccacgggagagcatttcatcagcttcatcaaggacaaacatcttgatgcagtcagggcgaagagattgtcttcgaagcatgtcaaacacacgaccgggagttccaacgacaacatgaacaccagcctggagaatgcgctgatcctcacggacgctggttccaccaacacaggcatgaactttgacgccttggtaatcaccaagggcacgcatgaccttctcaatctgctgagcaagctctctggtgggagccaaaacgagagcctggcactggacaagggtatagtcaagctgctgcaagacaccagagcagaaagtggcggtttttccagtaccagactgtgcctgctggatcacatcaagacccttgcaaaagggtacaatccctctttgctgaat

SEQ ID NO: 5252 - DNA, 1054 bp, Glycine max
cagctcctctacagtcacattgtagaacttctgaatatcagacagcatcctggaatcatctgtcgtgacaaagtttatagcaactccttttcttccaaatcgaccactacgtcctatgcggtggagatagttttcaggttgggttggcagatcatagtttatgaccagagacacttgctgcacatcgataccacgggccagaaggtccgtggtaatgagaactcgagaagagccggaccggaattcacgcatgataatatcacgtgtgttttggtccatgtcaccatgggtggcagagactgtgtggtcattgcttcgcatcttgtcagtgagccagtccaccttgcgcctggtattcacaaaaatgacactctgagtgatagccagagtctcataaaggtcacataatgtctccagcttccactcttccttgtcaacattgacataaaactgctttataccctccagggtcagttcatcacgctttaccaggattctcactggcttattcatgaacttccttgtaatttcaagggcttctggcggcattgtagcagagaacactccaacctgaattttggatggcagcagctggaagatgtcatagatctgcaacaccaaccaaaattttcacaatcatttcatcagcctcatccaaaacaaacatctttatgcaatctgggcgaagagactgcctccgcagcatgtcaaacactcgcccaggagtgccaacaacagtatggacaccagcttggagaatgcgctgatcctcacgaacacttgtcccaccaacacaagcatggaccttaactcccaagtaatcaccaagagctcgcataactttctcgatctgctgtgctagctcccttgttggtgccaaaaccaaagcctggcactgaaccaatccataatcaagctgctgcaaaattccagaacaaaatgttgctgtctttcctgttccagactgagcctgttgaatcacatccagtcctttgcagaaaggaacaattcccctttgctgtatagcagaaggcctctcaaaaccttaaaaaca

SEQ ID NO: 5253 - DNA, 308 bp, Rhizophora mangle
cagctactcatggagatatggatcagaatactcgtgacatcattatgcgggaattccgatctggctcttctcgtgtccttatcaccaccgatcttttagctcgtggtattgatgtgcagcaggtttcccttgtcataaactatgacttgccaactcagcctgaaaactaccttcatcgaattgggcgaggtggacggtttggaagaaagggtgtagccattaactttatgacgaaagatgacgaaaggatgctttttgatatccagaagttctacaatgtggtcgtcgaggagctgccttccaacgtt

SEQ ID NO: 5254 - DNA, 588 bp, Theobroma cacao
  misc_feature (40)..(40): n is a, c, g, or t
  misc_feature (68)..(68): n is a, c, g, or t
  misc_feature (111)..(111): n is a, c, g, or t
  misc_feature (115)..(115): n is a, c, g, or t
  misc_feature (130)..(130): n is a, c, g, or t
  misc_feature (153)..(153): n is a, c, g, or t
  misc_feature (162)..(162): n is a, c, g, or t
  misc_feature (238)..(238): n is a, c, g, or t
  misc_feature (244)..(244): n is a, c, g, or t
  misc_feature (341)..(341): n is a, c, g, or t
  misc_feature (343)..(343): n is a, c, g, or t
  misc_feature (361)..(361): n is a, c, g, or t
  misc_feature (521)..(521): n is a, c, g, or t
  misc_feature (561)..(561): n is a, c, g, or t
  misc_feature (587)..(587): n is a, c, g, or t
tttttgtgaacacccgacccaaggttgactggctgacagncaaaatgcggagcagagaccatacagtntctgccacccatggagatatggaccagaatacaagagacatcntcangcgtgaatttcgttntgggtcatctcgtgttctcatcnccaccgatnttcttgctcgtggtattgatgtccagcaagtctctcttgttataaactatgatctgcctactcaacctgagaactncctccnccgtattggacgaagtggacgttttgggaggaagggtgttgcaatcaactttgtgatcagggatgatgaaaggatgttgtttgacatccagaagttntntaatgtgattattgaggngctgccagcgaatgttgctgatctcctttgatgagattttgcccatcattgttagtggagattggagccagttggaagctgtttagcaagtttatttctctccctctcttttccccccttgttttaaagtcttattttatagccataggcttatttggtntcgtgggcaattattgttgcatgtttgataatttaggttnttatatggggtttaatttttcttggna

SEQ ID NO: 5255 - DNA, 503 bp, Senecio madagascariensis
tcgagcggccgcccgggcaggtcttaccttagaaggtattaagcagttctatgtcaatgttgaaaaagaagaatggaagctagaaaccctctgtgatctttacgagactttagcaatcactcaaagtgtcatcttcgtcaacacccgtcgaaaggttgactggttgaccgacaaaatgagaagccgtgaccacacagtctcggccacacacggagacatggaccagaacacacgtgacatcatcatgcgtgagttccgctccggctcttctcgtgttctcatcactactgatttgttggcacgtggtattgatgttcaacaagtttcacttgttatcaactatgatcttcccacccagccagaaaactaccttcaccgtattggtcgtagtggaagattcggaagaaagggtgtggctattaactttgtgacgttggatgatgaaaagatgcttggtgatatccagaagttctacaatgtggttgttgaggagacctcggccg

SEQ ID NO: 5256 - DNA, 1054 bp, Glycine max
cagctcctctacagtcacattgtagaacttctgaatatcagacagcattctggcatcatccgtcgtgacaaagtttatagaaactccttttcttccaaaccgaccactacgccctatgcggtggagatagttttcaggttgggttggcagatcataatttatgaccagagacacctgctgtacatcaattccacgggcaagaaggtcagtggtaatgagaactcgggaagagccggaccggaattcacgcatgatgatatcacgggtattttggtccatgtcaccgtgggtggcagagactgtgtgatcattgcttcgcatcttgtcagtgagccagtccaccttgcgcctggtattcacaaaaatgacactctgggtgatagccagagtctcataaaggtcgcataatgtctccagcttccactcttccttgtcaacattgacataaaactgcttgataccctccagggtcagttcatcacgctttaccaggattctcactggcttattcatgaactttcttgtaatctcaagggcttctggtggcattgtagcagagaacactccaacctgaattttggatggcagcagctgaaagatgtcatagatctgcaacaccaaccaaaattttcacaatcatttcatcagcctcatccaaaacaaacatctttatgcaatctgggcgaagagactgcctccgcagcatgtcaaacacacgcccaggagtgccaacaacagtatggacaccagcttggagaatgcgctgatcctcacgaacacttgtcccaccaacacaagcatgaaccttaactcccaggtaatcaccaagagctcgcataactttctcaatctgctgtgctagctcccttgttggtgccaaaaccaaagcctggcactgaaccaatccataatcaagctgctgcaaaattccagaacaaaatgttgctgtctttcctgttccagactgagcctgttgaatcacatccagacctttgcagaaaggaacaattcccctttgctggattgcagaaggcctctcaaaaccttaagaaca

SEQ ID NO: 5257 - DNA, 533 bp, Salvia sclarea
ctactagaccttggctgtcactcaacatcatcatgcgcgaattccgatccggctcctcccgtgtcctcatcaccaccgacctcctcgcccgtggtatcgacgtgcagcaggtgtcccttgtcatcaattacgacctccccacccagccggagaactacctccaccgtatcggacgaagtgggcggttcgggaggaagggtgtggcgatcaacttcgtgaccaaggacgacgagcgcatgctcttcgacatccaaaagttctacaacgtgacggtggaggagctcccggccaacgttgccgatcttctctagatggagaagaaggggttttgaggcgcaagaggttaaattttcctttgtttggagtaacttatgcccttattttcctaggttagtttttaactgtgtggtggggagattttaagtgccattatttggaggggactaacatctcccaacgttgttgcagtcccaaaactttattacaaaattttggttttgtctgtgtgttcgcagtgagtgacaggctagtag

SEQ ID NO: 5258 - DNA, 603 bp, Actinidia deliciosa
  misc_feature (327)..(327): n is a, c, g, or t
  misc_feature (342)..(342): n is a, c, g, or t
  misc_feature (523)..(523): n is a, c, g, or t
cgtgatcacactgtctctgccactcatggagacatggatcagaacaccagagatatcatcatgcgggagttccggtctggttcgtcgcgtgtgctcatcaccactgatcttttggcccgtggtattgatgtccagcaggtctctctagtgatcaattttgacctaccgacccagccggagaactacctgcatcgaattggacgtagtggacggtttgggaggaagggtgttgccatcaactttgtgacaaaagacgatgagagaatgctgtttgacatccagaagttctataacgtggtggtcgaggagctcccagcaaacgttgcngatctcctttgaggngtgttttgatttggtgaagtaaattgtttcacttggtagttatttacggcttagtttttaggttttattgccgtggttaaacatgtatgagaccgcaattttgagatttgggccttatgattttcatgtatcgggaatcatttggtgcaaattttcttggttcgtttttgtattttatggntctaaaataacttgcaaaactggatgttgtttgaaattatatcatatttggttctgcagttggcttctaaaaaaaaaaaa

SEQ ID NO: 5259 - DNA, 562 bp, Lactuca sativa
accacacagtgtcagccactcatggtgacatggaccagaacacgcgtgacataatcatgcgggagtttcgttcaggatcttcacgtgtcttgatcactacagaccttttggccaggggtattgatgtccaacaggtttcacttgttatcaactatgaccttcctacccaaccagaaaactaccttcacaggattggaagaagtggaaggtttggaagaaagggtgttgccattaactttgtgacattggaggatgagaagatgctttctgatattcagaagttttacaatgtggttgttgaggagctgccttcaaatgttgctgatttgatttgaaaagattttgttggttgagaaggagatcgatactttttggggtatggtatggattattagttaactttagcttatattagatgaatcctatctctattttctttgttccagaatcctgcttttccgggtttatgtgttgtttatgatccgttgtttaatttagacaagaattttgatcgtggtgatatttgatttaacgttttcaaatctatgacatgattgctgca

SEQ ID NO: 5260 - DNA, 559 bp, Lactuca sativa
accacacagtgtcagccactcatggtgacatggaccagaacacgcgtgacataatcatgcgggagtttcgttcaggatcttcacgtgtcttgatcactacagaccttttggccaggggtattgatgtccaacaggtttcacttgttatcaactatgaccttcctacccaaccagaaaactaccttcacaggattggaagaagtggaaggtttggaagaaagggtgttgccattaactttgtgacattggaggatgagaagatgctttctgatattcagaagttttacaatgtggttgttgaggagctgccttcaaatgttgctgatttgatttgaaaagattttgttggttgagaaggagatcgatactttttggggtatggtatggattattagttaactttagcttatattagatgaatcctatctattttctttgttccagaatcctgcttttccgggtttatgtgttgtttatgatccgttgtttaatttagacaagaattttgatcgtggtgatatttgatttaatgttttcaaatctatgacatgattggtgc

SEQ ID NO: 5261 - DNA, 673 bp, Ricinus communis
tttcttcttcttctggctgtcagatctacgacattttccagtttctgccagcaaaagttcaggttggtgtgttctctgccaccatgccaccagaagctctggatatcacaaggaagttcatgaacaagcctgtcaggatcttggtcaagcgtgacgagcttacccttgagggtataaagcagtattatgtccacgttgacaaggacgaatggaaacttgaaacactctgcgatctctacgagacactacccatcgctcagagtgtcatttttgtcaacacgaggcgcaaggttgattggctcactgacaaaatgcgaagccgtgatcacacagtctcagcaacacatggggatatggatcagaacgctagcgatgttattatgagggaatttcgttccggttcttctcgtgttctcatcgccactgatctcttggctcgtggcattgatgtgcagcaagtctctcttgtcataaactatgatctgacgactcaacctgagaactatcttcatcgcattggtagaggtggcaggttcggaagaaaaggcgttgccatcaattttgtgactaaggaagatgatagaatgctgtttgagattcagaagttctataatatggtcatccaggagctgccagcaaacgttgctgatctccagttatgagaagtttttgg

SEQ ID NO: 5262 - DNA, 540 bp, Adiantum capillus-veneris
ggaaatgaccagaaaattcatgaacaagcctgtgcgaattcttgtgaagagggacgagtcgactttggaaggtatcaagcagttctacgtggatgttaacaaggaggattggaagctcgatacgctgtgcgatttatatgaaactcttgcgatcacgcagagtgtcatatttgtaaacaccagaaggaaggtcgactggcttactgacaaaatgcgagctagggaccacaccgtttctgccactcacggggacatggatcaaaatacaagagacgtgatcgtgcgtgagtttagatctgggtcttcccgtgtactgattactactgatcttttggcaaggggtattgatgttcagcaggtatcattggtgatcagttatgatctgcctactcagcctgagaactacctgcatcgtatcggtcgtggtggtcgatttggaaggaagggtgtggctatcaactttgttacaaaagatgatgagaggatgttgcaggacattcagaggttctacaatgtggttgttgaagagctcccttcgaa

SEQ ID NO: 5263 - DNA, 821 bp, Cryptomeria japonica
  misc_feature (85)..(85): n is a, c, g, or t
  misc_feature (94)..(94): n is a, c, g, or t
  misc_feature (112)..(112): n is a, c, g, or t
  misc_feature (813)..(814): n is a, c, g, or t
  misc_feature (817)..(817): n is a, c, g, or t
gcttgatacactctgtgatctctatgagactcttgccattactcaaagtgttatctttgtgaataccagacgaaaggtttgattnggctggacntgataaagattgagagcntcgttgatcatactgtgtcagctaccaccatggtgaccttggatccggattacccagggccatttattatgagggagttccgttcaggatcttcacgtgttctgatcacgaccgacttgttggctcgtggcattgatgtgcaacaagtatcattggttatcaactatgatcttcccactcagccagagaactacctccacagaattggtcgtagtggaagatttggaaggaaaggtgtggcaatcaactttgttactagggatgatgagagaatgttagcagacattcaaaggttctataatgtgactatcgaagaacttccttccaatgttgctgatcttctgtgaggttttgtgcaaggattttcgaagaagtgtctgagaaaatatctaattatcattttattgtcagacgattctttattttacctcagaacaagtgagctatttaagtagttaacttaggattatatggatctcaggtttctgagtatttgattaggttttgggtggtaaaaaaaaatatatttacccacagggacttgacttttagagttttctgaatattgatattttcaaagaagttcctagggttaaagacaacaggaatttcttggatttctattggttctctgtatcgtttagtcttttgcactgttattatgtatgggatgcaatccttcaaaattttgtatccttgannaancaca

SEQ ID NO: 5264 - DNA, 402 bp, Lactuca sativa
accacacagtgtcagctacacacggtgacatggaccagaacacgcgtgacataatcatgcgggagtttcggtctggatcctcacgtgtcttaatcactacagaccttttggccaggggtattgatgtccaacaggtttcacttgttatcaattatgaccttcctacccaacctgaaaactaccttcataggattggaagaagtgggagatttggaagaaaaggtgttgcgattaattttgtgacattggatgatgccaagatgttatcggatgttcagaagttttataatgtggttgttgaggagttgccttcaaatgttgctgatttgatttgaatttctgacaaggtgtatgtatagccttgctttctttttggattctaattggtgttcttttgaagtt

SEQ ID NO: 5265 - DNA, 698 bp, Festuca arundinacea
gcacgaggaagatgaggggcagggatcacacagtttctgctactcacggagacatggaccagaatactagggacatcatcatgagggagttcagatctggttcttcacgtgtgctcatcaccactgacctgcttgctcgtggtattgatgtccagcaagtgtccctggtcatcaactacgatcttcctacccagccagagaactacctccatcgtatcggtcgtagtggtcggttcggaaggaagggtgttgccatcaattttgtgacccgtgaagatgagcgtatgctgtttgacatccagaagttctacaatgttgtgattgaagagctcccagccaacgttgccgacctcctgtagatcaaagctctccagaacatatggtaaggagcctgacagggctctgtttttgttgaaacgtcaccaactttctttcttgggggggaagtgataaatggtcgggggttctactttaaggtcgtggttatggacaatttcggatttattatgccttgttttgggaatttttgtagttgctaggctgtgctatgtgctgctgtgtttaagcttgaggatgaagctactgttggagtcctcactttattatttgttaagaagactatgtaatgaccgaatgatgttatttgtttgtgtcatccttgactcatcaccgcatctaatccgttaatgggttctatt

SEQ ID NO: 5266 - DNA, 391 bp, Festuca arundinacea
  misc_feature (4)..(4): n is a, c, g, or t
  misc_feature (66)..(66): n is a, c, g, or t
  misc_feature (69)..(69): n is a, c, g, or t
  misc_feature (78)..(78): n is a, c, g, or t
  misc_feature (129)..(129): n is a, c, g, or t
  misc_feature (201)..(201): n is a, c, g, or t
  misc_feature (246)..(246): n is a, c, g, or t
atcnttgtgaacacccgccgcaaggtggactggctcactgacaagatgaggggaagggaccacacngtntctgccacncacggagacatggaccagaacactagggacatcatcatgagggagttcagntctgggtcttcccgtgtgctcatcaccaccgacctgctggctcgtggtattgatgtccagcaagtctccctngtcatcaactatgacctgccgactcagcctgagaactacctccancgcattggtcgtagtggtcggttcgggaggaagggagttgccatcaactttgtcacacgtgaggatgagaggatgctgttcgacatccagaagttctataacgtggtcattgaggagctccctgccaatgttgctgaccttctct

SEQ ID NO: 5267 - DNA, 533 bp, Zingiber officinale
gaatactcggcgaaaggttgattggctcactgacaagatgaggagcagggatcacactgtctcagccacacacggagacatggaccagaacactagggacatcattatgcgtgagttccgctccggatcctctcgtgtgctaattacaactgatctcctagctcgcggtattgatgtccagcaagtttccctcgtcataaactatgacctaccaacacaaccagagaactatttgcatcgtattggacgtagtgggcgatttgggagaaagggtgttgccataaacttcgtcacccgggatgatgagaggatgcttttcgatattcagaggttttacaatgttgtgattgaggagctgccttccaatgtcgccgatctcatctaaggcattgcctctcatgtgttatgagatttaagcattttatgctttgtaggattatggtggtgttctaggtgagtatcgacttcatctactttttgtggtaatgttcgaaccattctgacttttacttattacaaactttaattgtttt

SEQ ID NO: 5268 - DNA, 415 bp, Zingiber officinale
tttcgttcaggatcctcccgcgtgctcatcacgacagacctcctggctcgcggcattgatgtccagcaagtctcgcttgttataaactatgacctaccgacgcaaccggagaactatctccatcgtattggacgaagtgggcggtttgggagaaagggggttgctataaactttgtatcccgtgacgacgagaggatgctttttgatatccagaagttctataatgtggtgattgaggagctgccttctaatgttgcggacctcatctaaaccatctcctttcttgtgttgtgagatgtaaacattttatgcttttgtaggattgtgttggtgttctaacggtatcaacttcatctaatttttgtggtaatgtttgaaccattagacttttatttattacgaacttcaattgttt

SEQ ID NO: 5269 - DNA, 580 bp, Lactuca sativa
ctcgggaccacacagtgtcagccactcatggtgacatggatcagaacacgcgtgacataatcatgcgggagtttcgttcaggatcttcacgtgtcttgatcactacagaccttttggccaggggtattgatgtccaacaggtttcacttgttatcaactatgaccttcctacccaaccagaaaactaccttcacaggattggaagaagtggaaggtttggaagaaagggtgttgccattaactttgtgaccttggaggatgagaagatgctttctgatattcagaagttttacaatgtggttgttgaggagctgccttcaaatgttgctgatttgatttgaaaagattttgttggttgagaaggagatcgatactttttggggtatggtatggattattagttaactttagcttatattagatggatcctatctattttctttgttcctgaatcctgcttttccgggtttgtgttgtttatgatccgttgtttaatttagacaagaattttgatcgtggtgatatttgatttaatgttttcaaatctatgacatgattggtgcatgattttgactaaaaa

SEQ ID NO: 5270 - DNA, 812 bp, Cicer arietinum
gtgaggattcttgtgaagcgtaatgagggcaaacaggaaaaaaataaggaatttaacgcaaatggtgaaaaagagaaaaggaatggacaaccttgtagattaagcagtggtatcaacgcagagtgttattttttgtgaacaccagacggaaggttgattggctgactgacaagatgcgaagccgtgatcacacagtctcagcaactcatggagacatggaccagaacactagggacattattatgcgagaattccgttctgggtcttcccgtgttttaataactactgatcttctagctcgtggtattgacgtgcagcaagtgtcattagttataaattatgatctcccaacacagcccgagaactatcttcatcgtattggtcgtagtggaaggtttggtaggaaaggtgttgccatcaactttgtcacaaaggacgatgaaagaatgctgggtgacatccagaagttctacaatgtgataattgaggagctgccttcaaatgttgcggaacttctgtgatgagattttttcttccatcatactagaggaaagttggtttctgagataagtgttatgtaatgttccccctttttgccccatttgttgtatttctgtttttaaaccttgtttgacctttttaataggtgtagtaatttaatttacattgtcagtcgtctgagtactcttaagtgataagtacttgcaatgtggaatccattattgtctgaattggtgtgttgattgtttatcgctgtggcatctttctaacaaccaaggttttcaatttaagttttagttattctaatccta

SEQ ID NO: 5271 - DNA, 1295 bp, Beta vulgaris
cgggtagaagagccaaagagagataaaactggacatcagaaaatcggaggaggacgaagaggacatagagagcataaaagggtaagcgagatacggacaggagaatttgaaaggatgacatgtaggatacgagtagcaaaggatgagggaagagaggcgcataacgggtgggatagcgagaaattcaatagtagaatcggaagaaggagaaaaaggacgataaaaataagagaaaaaaggagcagaaaaaatgaagaaagagcaggaggaaaaaacgaagcaacaatagaggcaataactcagtagtaggataagttggaaaggtatggcggaacagagtgtcaacagaggatgcaggaaggtggaaggaagaacaggcgcagagggccaaagaggctaaacagcgggtggagaagaggggaaggagctagaaacaaaggataaccgggagatggagacagggcgtgaaggactttttgcatgaggaaagcgataagaatggcagggcgcaaaggaagacccagtgagggagctgtttcgcaaaaggcgtaccagaataaaaagggaggaatgttgagcgattaacggcagagaagccctaggaatgaacgggagatcaagaacaatggtgtgagggttgttgataagcgggagaaccgggtcgaggaaggattcaaacaggtctaggtgaatgccaaccagggagggaccagaagctagacattctttgtgaccgttaggaaaccttgcgcttcacgcaaagggtcatctttgtgaaccccaggaggaaggtcgactggttgaccgaccaaatgagagcccgtgatcacaccgtgtcacccacacatggagacatggaccaaaacactagagatatcattatgcgtgagttccgctctggatcttcccgtgtcctcattaccaccgaccttctcgctcgtggtattgacgtgcagcaagtctctttggtcatcaactacgatttgccaactcaaccagagaactaccttcacaggataggtcgtagtggtcgttttggaaggaagggtgttgccatcaattttgtgaccgctgacgacgagaagatgctctttgatatccagaaattctacaatgtggtgattgaagagctccctgcaaacgttgcagatcttatatgatcactacaaagctgccattttgctggtgtttttagggaagaaagatgttttgactgtccaattagtaaagattccatttgggcacctgttgtttattggatgatatgattatttatctgctgacagtttatttac

SEQ ID NO: 5272 - DNA, 1506 bp, Ricinus communis
aggaaccgatggacaaagctcaaaactaagggaaaaatcgagaaatgaaaaggtggtcgttaaaaatccgttggactgcctaacctgcctccatctcctttttcacgctctttctctaatctgcaaacccagagtctcagctcagttagctcctccaaaatctaaatttgagaaagaaaaaagaagaaaaagatccaaggagtttggaaaagaaaccctaatcttaaccctaaaattcttgttaaaacctcaattacacccattctcaattcatcactcgctctcagtaatggctggtttggcacctcaaggatcccaatatgatgctcgtcactatgatagtaaaattattgaggtgcttggggccaaagggcaagactttttcacatcatatgatgaggtttatgacagttttgatgctatgggtttaaaggagaaccttttgaggggttttgagaagccttctccaattcagcaaaggggtattctgccactctgcgagggatttgatgtgatccagcaagcacagcaaggaactgggaaaacagctacattttgctctggaatcttgcagcagcttgattatgacttggtggaatgtcaggctttaattctgacacccactagagaattggcacagcagattggctttagttctaggatttactggtgccccggtcgtgtatttgatatgttgcggagacagtcactttgttctgataacatcaagatgtttgtgctggacgaagcagatgaaatgctctcacgaggtctcacggaccagatgtacgatattttccagttgcttccagcaaagattcaggttagagttttctctgctaccatgctacctgaggcccttgagatcacaagaaaagtcgcaatcacccaaagcgtcatctttgtgaataccaggcgcaaggtggataggctaacagacaagatgcagagtcatgatcatacactttctgctacccatggatacatgatcaaaacagaagggacgttatcatgcaggacttttgctctggttcctctcgtgtgctcattactactgacatcttggcacgtggtattgatgtccagcaagtctcacttgctatcaattatgatctccagacacagccagagaactgcctcaatcgaattgaccgtagtggacggtttgggaggaagggtgttgctatcaactctgtcaccaaggatgatgaaagaatgctttttggatatccagaaattttatcatgtagtaattgaggagctagcatcaaatgttgctgatcttctttgaaggaattttgattcagtctgagtatatatatgacttaagttcaagaaaaggtatatggctttgaatttggaagccatgatttttatgttccttgttgtaggtttgaggcctttatttaacatagactggatcttactcaagaggtcagattctgtgcacttgagatggaatccagttccattttaaagaacctgatgatttaaagttgtttcaca

SEQ ID NO: 5273 - DNA, 1002 bp, Ricinus communis
atggctggtttggcacctcaaggatcccaatatgatgctcgtcactatgatagtaaaattattgaggtgcttggggccaaagggcaagactttttcacatcatatgatgaggtttatgacagttttgatgctatgggtttaaaggagaaccttttgaggggttttgagaagccttctccaattcagcaaaggggtattctgccactctgcgagggatttgatgtgatccagcaagcacagcaaggaactgggaaaacagctacattttgctctggaatcttgcagcagcttgattatgacttggtggaatgtcaggctttaattctgacacccactagagaattggcacagcagattggctttagttctaggatttactggtgccccggtcgtgtatttgatatgttgcggagacagtcactttgttctgataacatcaagatgtttgtgctggacgaagcagatgaaatgctctcacgaggtctcacggaccagatgtacgatattttccagttgcttccagcaaagattcaggttagagttttctctgctaccatgctacctgaggcccttgagatcacaagaaaagtcgcaatcacccaaagcgtcatctttgtgaataccaggcgcaaggtggataggctaacagacaagatgcagagtcatgatcatacactttctgctacccatggatacatgatcaaaacagaagggacgttatcatgcaggacttttgctctggttcctctcgtgtgctcattactactgacatcttggcacgtggtattgatgtccagcaagtctcacttgctatcaattatgatctccagacacagccagagaactgcctcaatcgaattgaccgtagtggacggtttgggaggaagggtgttgctatcaactctgtcaccaaggatgatgaaagaatgctttttggatatccagaaattttatcatgtagtaattgaggagctagcatcaaatgttgctgatcttctttga

SEQ ID NO: 5274 - DNA, 722 bp, Cryptomeria japonica
aaaggttgattggctcacagaccaaatgagagctcgtgatcacacagtgtcggcaacgcatggtgatatggatcagaatactagagacatcattatgagagaatttagatctggttcttccagagtgctgattacaactgaccttttggcccgaggtattgatgtgcaacaagtttctcttgtcatcaattatgacttgccaacacaaccagaaaactatctccaccgtataggtcgtagtggaagatttggtaggaagggtgtggcaataaactttgtcacccgggacgatgagagaatgcttcaggatatacaaagattctacaatgtggtagttgaagaactgccatcaaatgttgcagatttgatataagatgctgcaggtgatgtaaatttgtgttatgttgtaaggacttttgggaacttaaagttgggaggatctgtttagtgtgtggaattatcagtatttctgtggccttattaactgaacgtttttgtaataactaatatctgatgagggagatcctatgtaatctatttactttccctcaatgttttttttatgttaatactcataacacgagtgatgtgtcacgaatacttataaaattctatgtattgtaccagttaaaatgtgaattttaaacgaatgtccatcatctcaattgtgtggtgatcatagaatgacttttattgaagtaggttgtgtatgcccattgtaa

SEQ ID NO: 5275 - DNA, 595 bp, Lotus japonicus
catttttgtgaacacaaggcgaaaggtcgactggctcactgacaagatgcgaagcaatgaccatacagtgtctgccacccacggagacatggaccagaacactcgtgatatcatcatgcgtgagtttcgctctggctcttctcgagtcctgattaccactgacctcttggctcgtggtattgatgtgcagcaagtttctctggtcattaactatgatctgccgactcaacctgaaaattatcttcatcgtattgggcgaagtgggcgttttggaagaaaaggtgttgctataaattttgtgacattggatgattcaagaatgctgtctgatattcagaagttctacaatgtgaccgtagaggagttgccatcaaatgttgctgatctgctctgatgagttaattttgtttaagtaagtcatcagggtggtgttctctttttgaccagtactattttgtgctctttttctgttacaatttttaatcattagagctagaagatatctgactctatttataatggattctataaaattttgttaattgcttggtagggcgctgaagccccttttgtgtttattctttgttttggtgtc

SEQ ID NO: 5276 - DNA, 739 bp, Triphysaria pusilla
ttcatgaacaaggcagtggatatcctcgtgaagcgcgacaagttaatccttgagggtatcaagcaattctacgtcaatgttgacaaggaacagtggaagctcgacaccctcagcgatctttacgagatagtaagaagcagaactcagtgtgtcatcttcgtgaacactaggcgtaaggtcgactggctgaccgacaagatgagcgaaagagattacagcgtctcggcaactcacggtgacatgaaactgaacacccgtgatatcaacatgcaggaatttcggtccggttcctcgcgggttctcatcacgacggatctgttctcacgtgggattgatgtccagcaggtttcacttgttataaactatgatcttccgaccaagcccgagaattatctgcatcgtattggacgaagtggccgttttgggagaaagggagttgtgcttaactttgtgactaaggatgatgaacatatgcttttcgatattcagaagttttataatgttcagattttggagatgccggggaatcttcctgatctgctgtgatgcacaggttttgagttagtttaatgtgtactggactgtacgtttgtttcgtgtttgtttgttcgtgcaacatacacctttggatgaaattagattttgattttgaaagggtgtgtgttaagaatgtcttttacttgctaattatttatttatttaattttgtaaagtttatcatcaaaaaaaaaaaaaaaaa

SEQ ID NO: 5277 - DNA, 643 bp, Triphysaria pusilla
tgacaaggaacagtggaagctcgacaccctcagcgatctttacgagatagtaagaagcagaactcagtgtgtcatcttcgtgaacactaggcgtaaggtcgactggctgaccgacaagatgagcgaaagagattacagcgtctcggcaactcacggtgacatgaaactgaacacccgtgatatcaacatgcaggaatttcggtccggttcctcgcgggttctcatcacgacggatctgttctcacgtgggattgatgtccagcaggtttcacttgttataaactatgatcttccgaccaagcccgagaattatctgcatcgtattggacgaagtggccgttttgggagaaagggagttgtgcttaactttgtgactaaggatgatgaacatatgcttttcgatattcagaagttttataatgttcagattttggagatgccggggaatcttcctgatctgctgtgatgcacaggttttgagttagtttaatgtgtactggactgtacgtttgtttcgtgtttgtttgttcgtgcaacatacacctttggatgaaattagattttgattttgaaagggtgtgtgttaagaatgtcttttacttgctaattatttatttatttaattttgtaaagtttatcatca

SEQ ID NO: 5278 - DNA, 512 bp, Triticum aestivum
aaaatgaggggaggggaccacactgtttttgccacgcacggagatatggaccagaacattagggacatcatcatgagggagttcagatttggattttttggtgtggtcatcaccaccgacctgttggcccgtggtattaatgtgcagcaagtttcccttgtcatcaaatatgacctgccgactcagcctgagaattacctccatcgcattggttgtagtggtcggttcgggaggaagggagttcccatcaactttgtcacccgtgaaaatgaaaggatgttgtttgacatccaaaagttttacaacgtggtcattgaggagctcccggccaatgtcggtgcccttttttagattatattttaggaatgcagtaaggtggttgataaagtttgtttttgttgaatatttcccaactttcagttttggagtggtaaggtttgggtttgtttgaattgtggttaaggatggttttttgagttttttcctgttatgcaatgtccggaaatttttgt

SEQ ID NO: 5279 - DNA, 672 bp, Ipomoea batatas
ctgtcaagaggtttcaaggatcagatgtatgacattttccaattgctaccaccaaagatccaggtcggtgttttctctgccacaatgccaccagaggcactggaatcactaggaaattcataacaaacccgttaggattctcgtgaaacgtgatacgctgaccttggaaggtatcgaccagttctatgtgaatgttgagaaagaggaatgaaagctcgaaacgctttgtgatctttacgagacactagccattacccagagtgtcatcttcgtaaacaccaggcgtaaggtcgattggctcaccgacaagatgcgcgcccgtgatctcactgtttcggcgactcacggagacatggaccagaacaccagggacatcatcatgcgggagttccgttctgggtcttccagagttctaatcaccactgatctcttggcccgtggtatcgatgttcaacaagtgtcccttgttatcagctatgacctaccgactcagcctgagaactacctcccccgtatcgggcgtagtggacgattcgggaggaagggtgtcgcgatcaacttcgttacaaaggatgacgacagaatgctttttgacatacagaagttttataatgttgtagttgaggagctgccggctaatgttgcagatctcctgtaatgtggtttttgcaa

SEQ ID NO: 5280 - DNA, 657 bp, Zingiber officinale
  misc_feature (427)..(427): n is a, c, g, or t
  misc_feature (607)..(607): n is a, c, g, or t
gcaccatgctcatcacgactgacctgcttgcccgcggcatcgacctccagcaggtctcacttgtcataaattatgatctaccaacacaaccggagaactacctgcacaggatcggacgaagtggacggttcgggaggaagggtgtggcaataaactttgtcgtccgtgacgacgagaggatgctgtatgacatccagaagttttacaatgtggtgatagaggagctgccttcctcaaagcgtcatcttcgtcaacacccgccgcaaggtcgactggctcactgaaaaaatgaggagcagagatcacactgtctcagccacccacggcgacatggaccagaacaccagggacatcatcatgcgcgaattccgctcaggctcctctagagtcctcatcacgactgacctgcttgcccgcggcatcgacntccagcaggtctcacttgtcataaattatgatctaccaacacaaccggagaactacctgcacaggatcggacgaagtggacggttcgggaggaagggtgtggcaataaactttgtcgtccgtgacgacgagaggatgctgtatgacatccagaagttttacaatgtggtgatagaggagntgccttccaacgtcgccgacctcatctgagctgagcttggctgagaactg

SEQ ID NO: 5281 - DNA, 559 bp, Solanum tuberosum
aagatgcgaagcagagaccatacagtgtcagctacccatggtgacatggaccagaacactagagatattataatgcctgaattccgttctgggtcctcgcgcgtcctcatcaccactgatcttttggcgcgaggaatcgatgtccaacaagtctcgctggtcataaattatgatctcccgactcagcctgagaattatcttcatcgtattggacgtagtggaaggtttggcaggaagggtgtggccatcaactttgtaacaaagcatgatgagaggatgctgtctgatattcagagattttacaacgttgttattgaggagctgccagcaaatgttgctgatctcctgtaggaagctaatttcctacaaaataggagcgggtgggtgggttctacacacttcaatctcttttcctttttacattttctgtggtatctaaattatgcacattggccttgtgtaatccattattaaatgctagctgttgacctcaagggttgtatctcaagagtattataaaatgattcaacctcacgggacatttagcggccgctcgagc

SEQ ID NO: 5282 - DNA, 544 bp, Eucalyptus gunnii
gggtcttctcgggttctcatcaccaccgatctcttggctcgtggaattgatgtgcagcaagtctcacttgttattaattatgatctgccaacccaaccggagaattacctacatcgtataggacgaggtggacgttttggaagaaagggtgttgccataaactttgtgacaagggacgatgagaggatgctgttcgatatacaaaagttctacaatgtggtcgtcgaggagctaccatcgaatgtggctgatctcctttgaagaggttttttggtctctgtggcgagtgaaatttttccatctcttaagcagtttttgttgctcttttgtttcagtaacttaaggtactttgctaagtctatatgaccatttaattgtatcggagcctcaattgcaacatccctgcggcaagtgttgcagggaggtttggttttgtgcggtctttttcgtaacgctgtcgaaagtcatgtagtaggttggaccgcttgcgtctgttttgatccgcccctttctatatatttcatattgcttgtcacctttaaac

SEQ ID NO: 5283 - DNA, 526 bp, Thellungiella halophila
ctggttcatcccgtgttctaatcacgaccgatctcttggctcgtggtattgatgtgcagcaagtctctctggtcatcaactttgacctcccaactcagccggagaactaccttcaccgtatcggaagaagtggaaggtttgggagaaaaggtgtggcgattaactttgtgactcgtgatgatgagagaatgctttttgatattcagaaattctacaatgtggttgttgaggagcttccatcaaacgtcgccgatctgctgtgaagaagaaaagaaaaccaccgttgttcgccggagaagaagaaaaggttacttgtttgcaggttgcttatttgatttttgacccatcattatcatctctctcttttttcattttctagtattcaccaactctttcgaacatatgtcttttctgaccaattttctttttattctcaagcaatttttatttttctgttgtatgatacccacaaatctttttctcaataggtgtcgttttaatattttattggtattagtaacttatc

SEQ ID NO: 5284 - DNA, 553 bp, Pisum sativum
tagacaaaatgcgaggcagggaccatacagtctcagccacccatggagacatggaccaaaacactcgtgatatcatcatgcgtgaattccgctctggttcttccagagttctcattaccaccgaccttttggctcgtggtattgatgttcagcaagtgtctttggtgataaattatgatcttcctacccaacctgaaaactatctccatcgcattgggcgaagtgggcgtttcggaagaaaaggtgttgctataaactttgtcactgtggatgatgcaagaatgctgtctgatattcagaagttctataatgtcaccgtagaggaattgccttcaaatgtcgccgatcttctctgatgagttaatttttgttctttgttaagtcatcagttttttttttttagtttttgacaaatgcaattttctgttttttttctttaccatttttacccattagagatcaaagacatctgactctatttataatggatttatgaattttgttttattgcttaattaattaaaaggatggtctagactttttcaaaaaaaaa

SEQ ID NO: 5285 - DNA, 657 bp, Zea mays
tacaagacccttgccatcacccaaagagtcatctttgtcaacacccgacgcacggtggactggctcactgacaagatgaggagcaaggaccacactgtttctgccactcacggtgacatggaccatatcactagagacatcatcatgagggagttccggtctggctccttccgtgggctcatcaccaccgacctgcttgctcgtggtattgatggtcagcacgtgtccctagtcatcatctatgatcttcccacccacccatagaattacctgcatctgattggtcgtagcgatcgtttctataggaagggtgttgacatcaactttgtgacccgcgacaaccagcggatgctgttcgacatctcagaagttctacaacgtgttgattgaagagctgcctgccaacgtcactgaccttctgagatcattttgaagaacaacagaactattagcaaggtgtgggcagcgatctggtaaggcttggctctgccgaaatattgcattaggagaagtgataaggtcggtgtactttctatgttaaagtcacagtctcgagcaatatacgattcttctctatgccatgttttgctaaattttgtagcatgctaggcctcttgctgctgcgagggctaattagtaccttggccgtgaccacgc

SEQ ID NO: 5286 - DNA, 269 bp, Avena sativa
ggagacatggaccagaacactagggacatcatcatgagggagttcagatttggttcttcacgtgtgctcatcaccactgacctgcttgctcgtggtattgatgtccagcaagtgtccctggtcatcaactatgatcttccgacccagccagagaactacctgcatcgcatcggtcgtagtggtcggtttgggaggaagggtgttgccatcaactttgtgacccgcgaagacgagaggatgctgtttgacgtccagaagttctacaacgt

SEQ ID NO: 5287 - DNA, 926 bp, Tragopogon dubius
acaggaaagactgcaactttttgctctggtatccttcaacaacttgactacagtgtggttgagtgtcaggctttggttcttgcacctactcgtgaacttgctcaacagattgaaaaggtcatgcgggcccttggggattaccttggggttaaggttcatgcgtgtgttggtgggactagtgtccgtgaagaccaacgtattctttcggctggtgttcatgttgttgttggtactcctgggcgtgtgtttgacatgcttcgtaggcagtcactacgtgctgattacattaagatgtttgtgttggatgaggctgatgaaatgctttctcgaggtttcaaagatcagatctatgacatcttccagttactaccatcaaaggtccaagtcggggtcttctccgccaccatgccaccagaagccctagaaatcacaagaaaattcatgaacaaacccgtccgcatcctagtcaaacgtgacgaactaaccctagaaggaatcaaacaattctacgtaaacgttgaaaaggaagaatggaaactcgaaaccctgtgcgacctctacgaaaccctggccatcacccaatcggtcatcttcgtcaacacccgccgaaaagtcgactggctaaccgacaaaatgcgcagccgcgaccacaccgtctcggccacccacggtgacatggaccaaaacacgcgtgacatcatcatgcgcgagttccggtctggatcatcgcgtgtcctaatcacaaccgatcttttggcacgtgggattgacgtccaacaagtgtcgcttgttataaactacgatcttccgacccaaccggagaattaccttcataggatcggtaggagtgggcggtttggaaggaagggtgtggcgattaattttgtgacgttggatgatgaacggatgcttgcggatattcagaa

SEQ ID NO: 5288 - DNA, 253 bp, Brassica juncea
cgcgcgttctgatcactaccgatctgttagcgcgtggtatcgatgttcagcaggtgtcattggtgattaactacgatttgccgactcagccggagaattacctccaccgtatcggaaggagtgggaggtttgggaggaaaggtgtggcgattaactttgtgacgaaggatgatgagaggatgttgtttgatattcagaagttttataatgttgttgttgaggagctgccttctaacgttgctgatctgctgta

SEQ ID NO: 5289 - DNA, 580 bp, Helianthus annuus
ggcggcgcgatatacggtatagatgcgttttgcgtcaatgccgcatcagggagcaagtcgacatgcaagccgaggtaatcttgataagagcttacggagcgcacatagtgtcaattacgccaaaattcgaggtaaagatgactgagtgaacgacaagatgcatagcggagaacgaagagtcgctgcgagtgatggagtcgcggacgaaagcaccagcgagatcatcgtgagagactactgagctgagtcatcacgtgtgttgttctccactgatcttttggcgcgtggtattgatgtccaacaagtgtcacttgtgatcaattatgatcttcctacacaaccagaaaattatcttcaccgtatcggacgaagtgtgcgatttgacagaaagggtgttgcgattaattttgtgacgttggatgatgaacggatgcttgctgatattcagaagttttataatgtgtcggttgaggagttgccgtccaatgtcgctgatctgattgagaaaatgatcttgggatgttgggcttgtttaagtaaaaaagaacaaaggttagaacgtgttgttttgaatctatcg

SEQ ID NO: 5290 - DNA, 814 bp, Brassica napus
cagatctatgacatattccagcttctcccaccaaagattcaggtgggagtgttctcagctacaatgccaccagaagctctcgagatcacaaagaagttcatgagcaaaccagtgagaatcctgtgaaacgtgacgagctaacgctcgaaggtatcaggcagttttacgtgaacgtggagaaagaagagtataagctcgaaactctctgtgacctctacgatactttaaacatcactcagggcgtcatcttcgtcaacacacgtcgcaaggtggactggctcacagaccaaatgagaagccgtgaccacacggtctcggccactcacggagacatggaccaaaacacgagagacattatcatgagagagttcaggtctggttcttctcgtgttcttatcacaaccgatctcttggctcgtggtatcgatgtgcagcaagtgtctcttgtcatcaactttgacctcccaacacagcctgagaactaccttcaccgtataggtagaagtggaaggtttgggaggaaaggtacggcgattaactttgtgactcgtgatgatgagagaatgcttactgatattcagaaattctacaatgttgctgttgaggagcttccatcaaaaatcgatgacctgctttgaagaaagaaaagaaaaccacgccgttgttagctggtaaagaataaaaaggttacttgtctcgcaagcttcttatttgatttttgacccatgtctcttagaattatacaccaactctttggaacatatgtcttatctgagtatttttcattttaatctcatgcaatattttttttaac

SEQ ID NO: 5291 - DNA, 942 bp, Ipomoea nil
  misc_feature (136)..(136): n is a, c, g, or t
  misc_feature (160)..(160): n is a, c, g, or t
  misc_feature (176)..(176): n is a, c, g, or t
  misc_feature (519)..(519): n is a, c, g, or t
  misc_feature (531)..(531): n is a, c, g, or t
  misc_feature (538)..(538): n is a, c, g, or t
  misc_feature (568)..(568): n is a, c, g, or t
  misc_feature (572)..(572): n is a, c, g, or t
  misc_feature (655)..(655): n is a, c, g, or t
ctgtcaagaggtttcaaggatcagatgtatgacattttccaattgctaccaccaaagatccaggtcggtgttttctctgccacaatgccaccagaggcactggaatcactaggaaattcataacaaacccgttagnattctcgtgaaacgtgatacgctnaccttggaaggtatcnaccagttctatgtgaatgttgagaaagaggaatgaaagctcgaaacgctttgtgatctttacgagacactagccattacccagagtgtcatcttcgtaaacaccaggcgtaaggtcgattggctcaccgacaagatgcgcgcccgtgatctcactgtttcggcgactcacggagacatggaccagaacaccagggacatcatcatgcgggagttccgttctgggtcttccagagttctaatcaccactgatctcttggcccgtggtatcgatgttcaacaagtgtcccttgttatcagctatgacctaccgactcagcctgagaactacctcccccgtatcgngcgtagtggacnattcggnaggaagggtgtcgcgatcaacttcgttacnaagnatgacgacagaatgctttttgacatacagaagttttataatgttgtagttgaggagctgccggctaatgttgcagatctcctntaatgtggtttttgctcgagaaaaaaggtgaatggggttcctccttacattaagtaattttcggtaggtaatttggatgtgtagtgaacttgcaattgggaaagacgatggtaggttggtcctggaacttgcaaaattggggaattgcagtttttttttcccagtttggtcatagagtttgaatctgctgttgcaaattttgttggtttttgtcttttgtgcttttcttaaatgtccaaaacaactgcagtactgaatgttgtttaaattaatgacttcattggttt

SEQ ID NO: 5292 - DNA, 1673 bp, Zea mays
cgccacgacacggcccgcgcgatcacgcacgctcatgccactggcgccactcatggagatcgacctgcacgccgtgcgcgcggtgcgcgtgctgggccgcggcgccatgggcacggtcttcctcgccgtgaacggcgccggcggggaggcctacgcgctcaaggtcttcgacaagcgctcccccgcggtagcgtccaggccgtccgcgggcaccgacgcggcgcggcgcgcgcggtgggaggtgtccgtgctgtccaggctcgcgcacccgcacctgccgtccctgctcggctgcgccgagacgcccgacctgctggcgtgggcactgccctactgccccggcggggacctgaacgagctccgccacgcgcagcccgaccgcgtgttctcccccgcggccatccggttctacgtcgccgaggtggtgtccgcgctcgccgagctccacgccgccgggatcgcgtaccgcgacctcaagcccgagaacgtgctcctccgcgccgacggccacgtcacgctgaccgacttcgacctctcgcggcagctcccgcccaggtccccctccgccgcatccacgtccacctcctcgtcgtgctcggcgacatcgtctccgccgccacaggcccagagccacggccggagccagcaccgccacgtgaagaacatcttcaagagaagcgagtccgcggtgaccgcgtcaacctccggacaggaggaaccgcgcaacctcgcctggtacctgagcaaaagaatcgacggcggcgccgaccagatcaagaaggcgaagtcggccagggtgtcgccgatggaccgcggcaagaagctctcgagcttctgctccgccgcagcagcgggggagcggtcgttctcgttcgtgggcaccgaggagtacgttgcgccggaggtggtgcgcggcgacgggcacgagttcgcggtcgactggtgggcgctcggggtgctcgtctacgagatgtcccacgggcggacgccgttccggggccggggccggaaggagacgttccggaacgtgctgctccgggagccggagttcacggcggacgcgcggcggcggtggccggagctgacggacctcatcgcgaggctgctggagaaggaccctgcgcggaggctgggtttcgccggcggcgccgacgaggtccgggcgcacccgttcttcgccggggtggcgtgggacctgctcggggaggtgtcccggccgccctacattcccgcgccggccgatgacactgtctcctgcgagggattcagcgtggtggagtacttcgataggcttcaccagcctccgctgtcgccagcggagtactcgcccgaggaagagctcttgccggagttctgacactggttgtgccgtcgccggcggagcactcgcccgaggaagagctcttgccggagttctgacgtcggttgttccgttgttgtcgctcgagatttgtgctccctgttgttttcgttttgcgccctctaagatcgatcactatgtgtgaacagagaggggcttttgttagttaaccaagatacagtcgatgattcgacactcgacagatgagacttgtggtttcaagtctctcgtcagtttttactgtatactgtaaccgtaactgaactactgaaggtgtcaggcactgatgcacgaatatgaattccttgtgcat

SEQ ID NO: 5293 - DNA, 1508 bp, Zea mays
ccctccccgcccttggcaacaagtgcgtaacacgcgacgaggccacacacacagccgtgacagcccgcgctctcacgctcatgtcaatgacgccatccatggagatcgacctgcacgtcgtgcgcgcggcgcgcgtgctgggtcgtggcgccatgggcacggtattcctcgccgttgacggcggcaccggggaggcctacgcgctcaaggtcttcgacaagcgctccgctgcggcggcgtcgaggccggccgcgggcgccgacgcggcgcggcgcgcgcagtgggaggtgtccgtgctgtccaggctcgcgcacccgcacctgccgtccctgctgggctgcgccgagacgcccgacctactggggtgggcgctgccctactgtccaggcggggacctcaacgagctccgccacgcgcagcccgaccgcgtgttctcccccgcggccatccggttctacgtcgccgaggtggtgtccgcgctcgccgagctccacgccgccgggatcgcgtaccgcgacctcaagcccgagaacgtgctcctccgcgccgacggccacgtcatgctgaccgactttgacctctcacggcagctcccgccgcccaggtccccctccgcatccacgtccacgtcgtcgtcgtcgtgctcggcgacatcgtcgccgctgcctcagacccagacgacccacatgaagaacatcttcaagagaagcgagtccgctgtgaccgcgcccacctccggacaggaggaaccacgcaacctcgcctggtacctgagcaaaagcatcgacggcggcagcgaccaggtcaagaaggcgaaatcggccagggtaacgccggtggaccgcggcaaggagctgccgagcttctgccccgctgccgcagccgcagccggagagcggtcgttctcgttcgtgggcaccgaggagtacgtggcgccggaggtggtgcgcggcgacgggcacgagttcgcggtcgactggtgggcgctcggggtgctggtctacgagatgtcccacgggcggacgccgttccggggccggagccggaaggagacgttccggaacgtgctgctccgggagccggggttcacggcggacgcgcggcggcggtggccggagctaacggacctcgtctcgcggctgctggagaagaatcccgcgcggaggctgggtttcgccggcggcgccgacgaggtccgggcgcacccgttcttcgccggggtggcgtgggacctgctcggggacgtgtcccggccgccctacattcccgcgccgcccgatgacagtattgcctcctgcgaggggttcagcgtggcggaatacttcgataggcttcaccagcctccgctgtcgccggcgaagcactcgcccgaggaagagctcttgccggagttctgacaccggttgttcccgctcgagattcgtgctccctgttgtttccgttttgttgcaccatcaaagatcactatatcgttaaataatggatctcggtgatatgcgtgaacagag

SEQ ID NO: 5294 - DNA, 987 bp, Populus trichocarpa
aaaataaaactcggcaaatcacaaactgctatctccttcatctctcccccttcttctctcttctccatcgtcagatctaaaaaaatttctctctttctgtttctccccccccttccaactctcgcgccaaatacaaaaccactcccccccccctcccccctctctctccagtaagatggccgataatccgaccagtccggcggcggggagccacgagagtggtggtgagcagagcccgcggtcaggggtgagagagcaggatagatacctgcctattgctaatataagtaggatcatgaagaaggcgttgccggctaatggaaaaattgctaaggatgctaaggatactgttcaggaatgtgtttctgagttcattagctttgttaccagcgaggcgagtgataagtgtcagaaggagaagaggaagacgatcaatggggatgatttgttgtgggcaatggcaacgttaggatttgaggattatattgagccacttaaggtgtacctggctaggtaccgggagcaactttggcagggtgatgcaaaggggtctgctagaggtggagatggatcttctaaacgggatgcagttggaggtctgcctggtcaaaatgcacagtttgcttttcaaggatcgatgaactatacgagtccacaagtgcagggacagcatatgatccttccttccatgccaggcaacgagtagggtttggctttgctttggtcaattcagtgaattagtggtaccatgttatatgcttgtcaattgtcaaatttacggacctatcctgaacctcgagaacgagtcagcatcactaccaaaccttaaagtgactaaaaactggaaacagggatctttgatctgtcacttttcatcattgatgttttgcctgtgaactcctgtggttcctggattttgagtgaacttttattgtcgacaattcttcgtatgattttgaatgaattcattattgatttattgaaata

SEQ ID NO: 5295 - DNA, 1102 bp, Manihot esculenta
actctctaactaaccctctccctctccctcctctctctctctctctctctctctctctctctctctacagggatttcgttgagatggcggataacccaacaagtccggcaggagggagccacgagagtggtggcgagcagagcccccactctggggtgagagagcaggataggtacctgcctattgccaatataagcaggatcatgaagaaggccttgccagcaaatggaaaaattgctaaagatgctaaggataccgtccaggaatgcgtctctgagtttatcagttttattaccagcgaggcaagtgataagtgccagaaggagaagaggaagacaatcaacggggatgatttgttgtgggcaatggcaacattaggctttgaggactatatagaaccgcttaaggtgtacctagctaggtacagggagggtgacactaagggatctgcgaggggtggagatggatcagctaaaagggatgcaattggaggtctgcctgttcaaaaccctcagtttgctatccagggatcaatgaactacattagttcccaggcgcaaggacagcatatgattgttccatccatgcaaggcaatgagtagagagttctagtttcatattaccaatctaatgaaatttagggccagtaaaactgtttaatgtccaacttctatagcatctttgatattggtttatcagatatgaaccaaagtgcattatattcttggggctttggttttggttgttggggtttggattttgtgggttctctctctggcagaacagctttaatagtcacataaatgctgtaaattgttttttttttttaacattctcctgactatttgaagagactgatctcataaatctctatattgtatctttgtcaattctcatcttttgtgtgtattgttcatcatgttgctctgcaatgaactcttctgtagcagccatattgaaggcatgtaactctccctgcctctctgctgtggggagactctctgtaagtggactgccgttcaaatttctgttggaaacgccagtgaccatctagtttttttttttttttttgtgaaatactatattttccatattctccatt

SEQ ID NO: 5296 - DNA, 1042 bp, Cucumis sativus
caacaacaacaagcgcgccaaatacaaaaatttccctcttcttcttcctcttcctctctcttcctcctccttcttcttcgctactttctcttccataatcactttcaattccccttcttagggtttccatcccattcttttcctcttccttcccttcacgttgtttttcttctctcctctcctatggccgaccctcccaccagtcctcccggctgcagccatgaaagcggcggtgaacaaagccctaacactgctgctgccgttcgtgaacaagatcgtttccttcccatcgctaatattagtcggatcatgaagaaagctttacctgctaatggcaagatcgctaaagacgctaaagataccgtccaggaatgtgtttctgaattcattagcttcgttaccagcgaggcgagtgataagtgtcagaaagagaagaggaagactattaatggtgatgatttgctttgggctatggccacgttgggatttgaggaatatattgatccccttaaatcctaccttaatagatacagagagtgtgatgctaaaggatcttctaggggtggtgatgagtctgctaaaagagatgcagttggagtcttgcctggtcaaaattcccagcaatacatgcagccgggatcattgacctacattaacactcaaggacagcacatgatcattccttcaatgcagaataatgattaggaatctcctgcatttccactcggattgcttgaaatctgaggctggtagaagcgttcaacacctaaatagcttctttacaatcgatttggctaatttattatgaaaacaatgatattataatacatattttctggggttcctgttttggttctggatttgattttgatttaggcttcgattttattgatgctctcgtcagctaaaattcttgtaaatttgggagcttcaatttagtatagttgctttggtaatttggaaactggaaaaatattatcctctttcccccacttatgtttcttttgtttcgaattattaagaaagtgatacataatatcct

SEQ ID NO: 5297 - DNA, 866 bp, Hordeum vulgare
ccccatctcaactctcaagcctcaagagctcacagtggataagctcgcgctctgctctcactcccagacacacacacactacacagcacagacactctctctgcttcacgatcttctccactgagctcgcgaggaggagagccgcatcgatctattcccgaccatggctgcgcgagcgctgaccgccgccgccggccgccgggtggccggccggaccgggacgacgccgcttctcgcctcgtgcaggaacggggccagcatgagccactcctcggccacggccggcgcgcggcgggaggaagagccgtacaaggacgtgcatggcccggcggcggcggcggcgatgacgggggcgcaggtggaggcggcgctgaaccgcaagaacgtggaggtgctccagggcgaggaggaggaggaggagcacgtcgccacggtgctgccggacgagaccgtcagcatccctgccggtgacggcgaggaggacgcgtcgtgggtgcccgaccaggacacgggcgtcttcggccccgcccacgttcgacgccacccacaggcgacgggtggggcaagtgcattcccgcccccgccgtacctgtttggaaggcgccacggcccctggagtactccacgcacggggtcggggcctcaaccaggcggagtttcgaccgcgcaggaggaacttggagaagtagtaaaggccctcccgccgtccgaattgcccaaccccaaacgatgagttaaacgggtgcgtcatgaacctttagggagcgggtaatattaccgggaacccgggaggctctctgccttttcagttcacttagcgtaatgttatggcgtgcgccactcgcgtttgaaatggtgacacccac

SEQ ID NO: 5298 - DNA, 1482 bp, Manihot esculenta
gaagcctagtcttaaaaaaagtggaaaaaaaggaacccataaagtaaacaatatcagaaacttgtgttcttgccatctctgatttcgtttaccagttcccttacaagccacttctcttgcctttctttcatcttcccaactcccacttgtataaagactcttttcaatccttgaacctccagaaattttcagtttgccttcgtgatttagagagaatggcaagtggggatccagagagagggacaaagaatagaggatacaacgacactagcttatactatgtggaaacctcggataagcaatggacttcgtggttgatccctatgtttgttgttgctaatattgctgtgttcatcgttgccatgtatgtcaataattgtcccaaaaacaatctgggttttgaaggtagctgcgttgccaagttccttggcaggttatcgtttcagcctttaaaagagaatcctctttttggtccatcttcttcaacactggagaaaatgggagccttggagtggaacaaggtggtgcatgggcatcaaggatggagacttatcacttgtatgtggttgcatgcaggagttattcatctgctagcaaatatgctgagcttgatctttattggaattcgccttgaacagcaatttggatttgtgcgagttgggatagtctacctattatcaggatttgggggaagcatattgtcttcactctttattcagcgaaatatttctgtgggtgcctctggtgctttgtttggccttcttggagcaatgttatcagagcttcttactaactggactatctatagtaacaagattgcagctctattgactctcgtggtcatcattgccattaacttggctgtaggaattcttccacacgttgataactttgcacacattggaggtttcttggccgggtttctcctgggctttgttatactacttcgtccgcagtttgggtggtatgaaagccaacatctccccgctgatgctcgtgtaaaatctaggcacaaggcttatcagtatgtgttcctgctggttgccgccgtattacttattgttggatttactgtgggattggtgatgctatttagaggagtgaatggaaatgatcactgcagctggtgccattacttaagctgtgtgcctacctcaaagtggaaatgtgacaactgatgcgagtcttttttccatcttgtcgtttcatggataattttttagtaaccttgttattggattattttatcttttcttctctaaccctttgagttttatttatcgtcatttgttcatttgtttgggatgctttcagtttcacacttgtacatgagattttagcaatatggcactgtgataatatttgaacatgaaaatgagttgtgctataaatgttggtttctccttataccctcaaatgatttgtagagaattgaagtctctaatccaataaatctcccaacaaaacgggattatgtgccca

SEQ ID NO: 5299 - DNA, 1427 bp, Theobroma cacao
  misc_feature (766)..(766): n is a, c, g, or t
  misc_feature (789)..(789): n is a, c, g, or t
  misc_feature (897)..(897): n is a, c, g, or t
  misc_feature (905)..(905): n is a, c, g, or t
  misc_feature (909)..(909): n is a, c, g, or t
  misc_feature (922)..(922): n is a, c, g, or t
  misc_feature (949)..(949): n is a, c, g, or t
  misc_feature (956)..(956): n is a, c, g, or t
  misc_feature (974)..(974): n is a, c, g, or t
  misc_feature (1038)..(1038): n is a, c, g, or t
  misc_feature (1044)..(1044): n is a, c, g, or t
  misc_feature (1066)..(1066): n is a, c, g, or t
cgggagagacagaacataacccaactatctctctctctttgtttttgtccattcctagtcattgatttttttcttgcaagccgctcttttcacatatatatctaaagttcaattggatctcaatttcttttcaaaaagaaaaaagacccggaaaaaaaagatctcgaatttttatccattaagcggtggaaagtaaggattttcttttttctgagggagaatggccagtggggatctggagagaggaggaggaagtaatgggaagaacagggcaaataactattaccaatcagcttctacaggtccatactatatggaaagtgctgaaaagcaatggacttcgtggcttgttccgatgtttgtggtggctaatgttgctgtttttgttgtggtgatgtatatcaataactgtcctaagaacaatctgggaatcgaagggagctgtgtggctaagtttcttggcaggctttcttttcagcctttgaaagaaaaccctctctttggtccttcttctaatacattggaaaaattgggagcattagagtggaacaaggtagtgcatggtgatcaaggatggaggcttatcacttgcatctggttgcatgcaggtgttattcatctgcttgcaaacatgttgagcttggtctttattggaattcgccttgaacagcaatttggattcgtgcgagttgggcttatctatctattgtctggatttggtgggagcatactatcttctcttttcattcagcgtaatatttctgtnggtgcctctggtgctttatttgnccttcttggagcaatgttatcagagcttttgactaactggactatctatacaaataaggctgcagctctcatcacacttgtaatcatcattgccattaacttggcagnagggattnttcntcatgttgacaantttgcacatattggaggtttctttgcnggctttntccttgggtttgttttgntgctccgtccccaatttgggtgggtggaacgtcagcaccttcctgctggtgctcgtgtaaaatntaagcncaaggcataccaatatgttttntgggtgattgctgtggttttactcattgttggtttcacagttggattggtaatgctgtttagaggagagaacggaaacgaccattgcagctggtgccattacctgagctgtgtgcctacatcaaaatggcgctgtggaaactaatgcaaacattacgaatactaccatacctagacttgatctcgctcaccgattctttcctgattccccttttttatattttattcatttgttaattttttcgagttggtattgcttatgtatatgcatagtttttgacatctgagattatatatctttggacatcagagaatccattgttatatatttggttgataatatatatatatagatatagata

SEQ ID NO: 5300 - DNA, 1924 bp, Gossypium hirsutum
gacaacccaaatctctctccatttctactaatcgaaatagatataaatttgagtttgatcccagtttcctttgaaaaagaaaaccccacagaagaaaaaaaggtacaaattttattcattaaacttgaaaaagaaccaagtttttgtattggaggatggcaagtggggatctagagcgaggaggaaggaatgggaagaacagagcaaatagctatcaccaatcatcatctcctttctatgtagaaaacactgataagcaatggacttcatggcttgttccaatgttcgtggtggctaatgttgctgttttttttgtggtgatgtatatcaatgattgccctaacaacaatctgggatttgaaggcagctgcgtggctaagttccttggcaagctttcttttcagcctttgaaagaaaatcctctctttggtccttcttctcatacattggacaaattgggagcactaaattggagcaaggtagcgcatggcaagcaaggatggaggctcatcacttgcatctggctacatgctggcgttattcatcttcttgctaacatgttgagcttggtcttcattggaattcgccttgaacagcaatttggattcctgcgtattgggcttatctatctattgtccggctttggagggagtatactatcatctcttttcattcaggataatatttctgttggtgcatctggtgctttattcggccttctgggagcaatgttatcggagcttctgactaactggactatctacacaaataaggctgctgctctgatcacacttgtggtcattattgccattaacttagcagtagggattcttcctcacgtcgataacttcgcacatatcggtggcttcttgaccggctttctccttgggtttgttttgctgcttcgtccccaattcgggtgggttcaacgtcagcatgttcctgctggtgcacctgttaaatctaagcacagggcataccaatatgttttctgggtgattgcagtggtcttggttatagttggattcacagtcggattggtgatgctgtttagaggagaaaatggaaatgaccattgcagctggtgccattacctgagctgtgttcctacatcaagttggcactgtggaaaataataatgaaaccattaccattactactattaacccccgtcttcatcttctctcactcaattctttcactatttttattcgtttattaatttcttccggttgatatttgtctatgtatatgcttagagattatatttgaatattagtaaattcgttgttcttaaaaaaaaaaaaaaaaaaaaaacggtcgacattatgacaaataaggcacgagccgaaacagagctcgggtactctcatcttcagccgcagccatggtgaacgtacctaagacgaagaagacctactgcaagagcaaggagtgcaggaagcacactttgcacaaggttacacagtacaagaagggcaaagatagtttggctgctcaagggaagcgccgttacgatcgcaaacaatcaggttatggtggtcagaccaaaccagtgttccacaagaaggccaagaccaccaagaagattgtgctgaggctgcaatgccagggttgcaagcatgtatcccaacatccaatcaagaggtgcaagcattttgaaattggtggcgacaagaaggggaagggaacatctcttttctaaatggtgtttatttatttcatgtcatgtcatgttgttgggaaccttttaagacagtatggaatttttgtttttctaatgtaatgttttccgagggatatggtgttctttaagcacttaatagttaatggcatcgtttgatctcattgtcgccatttgttttaaatactgtattttaatttaattgtttttggaacttcaataatctttgctatatttttc

SEQ ID NO: 5301 - DNA, 1865 bp, Populus trichocarpa
attcattacaacggttaaaatcctccagaaaccacttcctgctcgatttctgatcccagcaacttccttgtaagctacttctctatttaacttcccacatatataaactcacaaaaatattgtctatccgtaagagcgagagacaatggcaagtggagatctagagagggggacaaagaacagaggaaataacgcaaatttcccttcatactatgttgaaacagcagaaaagcaatggacttcatggataattcccatgtttgttgttgcaaatattgctgtttttattgttgtcatgtatgtcaacgattgtcctaaaaaatctctgggtattgaaggtagttgcgtggctaagtttcttggcaggttctcttttcagccgttgaaggaaaaccccctgtttggcccatctgctgctacattggaaaaaatgggagctctggagtggaacaaagtagtgcatggacatcaagggtggaggctcatcacttgtatgtggttgcatgccggagttgttcatgtgcttgcaaatatgttaagcttgatctttattgggattcgtcttgaacagcaatttgggtttgtgcgagttgggattatctacctagtatcaggatttggtgggagcatcttgtcttcactttttattcagcaaaacatttctgtcggtgcatctggtgctttgtttggacttcttggagcaatgttgtcagagcttcttaccaactggacaatctattctaataagattgctgctctactcacacttgtggtcatcattgccattaacttagctgtgggaattcttccacatgttgacaacttcgcccacattggaggtttcataagtggttttctcctcggctttgttttcctacttcgtcctcagtttgggtgggcaaaaaaccagcattctcctgccgatgctcgtgtaaaatccaagcacaaggcttaccaatatgtactcatgctagctgctgcggtgttgcttattgttggatttactttggcattggtaatgctatttaaaggagaaaacgggaatgatcactgcagctggtgccattaccttagctgcgtgcctacttcaaaatggaactgccggagctgatgaagattttcccatctcatcttctgtttgataattttcttattcttttcatccttccattttccttggttttcattttttcatttgtttgtaacgctttcacatatgtacatggaagtcacgctgcgattaactttggacatcaaagaggattataatgctacttacccgcagaatggtttcccatcatcacaaatgcattgctgtcaagcataaaaaacctagaattaatgttgttgaatgggccatcagaaatacgtggagtgtttaaaaaaaagaccagagacattctggcctgtgacgttgacacggtaccagttgcaccaaaacaccaacaaccaatgttagttgaaggatgacaagtcatttttgcttgcttgcccaaacatctaacaacttttgaattcgagggttagatttcgttcaataatgagagtttccagagagaacgagtagctaaagagaagaaatcatccgaccaatgcctaacgagttggtgtggggaatattggagaagtcatgattcaaggttggaacgaatggaatactagtattctatgggatttatttaaccctataatgcctaaatcaagcctttgaaggctgtttatatgtttttagttgcagtggccgctctctagatcaaattttttctcaatataaaaaaaatactaaggaaaaaaatataagatgtgagtcattagatatatcagttggtaatttaaataaaaaaatataacagcaataaataaaa

SEQ ID NO: 5302 - DNA, 1339 bp, Populus trichocarpa
actttacaacggctaaatcctcgaaaaaaaaaaaaaattcctttcctgctcgatttctgatttctttcagcaactcccttgtaagccacttctctattttaacttcccgcatgtataaataatccgttactcacaaaaataaaaaataaaaaacatattatctctctgtaagagctagagacaatgacaagtggggatctagagagagggacaaagaacagaggaaatagctcaaatttcccttcatactatgttgaaacagcagagaagcaatggacttcttggctaattcccatgtttgttgttgccaacattgttgtttttattgttgtcatgtatgtcaacgattgtcctaaaaaaaatctcggttctgaacgtagttgtgtggctaagttccttggcaggttctcttttcagccgttgaaggagaaccctctgtttggcccgtcttctgctacattggaaaaaatgggagctcttgagtggaacaaaatagtgcgtggagatcaaggatggagactcatcacttgtatgtggttgcatgccggtgttattcatgtgcttgcaaatatgttgagcttggtgtttattgggattcgccttgaacagcagtttggatttgtgcgagttgggcttatctacctagtatcaggatttggtgggagcatcttttcttcactttttattcagcgaaacatttctgttggtgcatctggtgctttgtttggacttcttggagcaatgctatcggagcttcttaccaactggacgatctattctaataagattgctgctctcctcactctcatggtcatcatcgccattaacttagcggtgggaattcttccacatgttgacaacttcgcacacattggaggtttctttactggttttctccttggctttgttttgctacttcggccacagtttggatgggtagaaagccagcattttcgtgcagatgctcatgtaaaatccaagcacaaggcttaccaatacatgttcttgctggctgctgcagtcttgcttattgttgggtttactttcggattggtaatgctgtttaaaggagagaatgggaatgatcactgcagttggtgccattacctaagctgtgtgcctacttcaaaatggaagtgcgagaaccgatgaagatttttccaacatatcttctgtttgataatttttttgttctttttacccctttatttgtattgattttcatttgttcatttgtttgttgtgctttcacatgtaagtaaacactgggattgactttggacatgaaaagagtaatataacgttttaaaatcttcaaaatggatctaataacttgcag

SEQ ID NO: 5303 - DNA, 2790 bp, Zea mays
cgatcttcgaattctcctcctcttttccttcctcttctgcagcgccagcgccagcgccgaccgaacccaacgccaacggcacggcaagccaagcgaagcggagcaagggtttgctcgccccacacccgtcccgcggccgaggctctgcttctcatcgtgacaagcctggcgaactgccatggacctggtgggatccttgctcctgagcatggcacgtctgcttgacccatccggtctccacttcgtgggctggctcgtcaccgcgggctccattggtcttgccgcactcatctacgctctcctcaggctgcagcgtgaggcggcgttgtactggaccaaggcgaccagggagaagcgtgccgcatggaggagattgcggtgccctagctcctgccactcgtggtctgaggactacttccacggtggccagccatcgacatgctgcgtttgcctgtcgtcccttggctccacgcagggcgtcgacatggttcaccgctgctctgtttgcggcgtggctgcacactcaaactgctctccccgtgcagagaaggattgcaagtgcgttgcacaggctggcgcttcgcccttgctgcatcactggtctgagaggtgggtggagctggatgacaacccggagatatcctcctcctgttactactgtgatgagccgtgcggtgtgcctttccttggagtctctcctatatggcgttgcctgtggtgccagcggcagatccatgttgattgccatgcaaaactgttgaaggaaaccggaaacacttgtgatcttggccttctcaggaggcttatagttcctccccaatcagtgaaagaaattggtcaaggttcaggaattagtggaatgctgaactcaatcaaggacgggtttgccaattcaacagttgggaaccgtaggaggtcacgcaacaagaagcgcatgaataaccatcctggtggcaagataaattccattcccacaaaattctcagtcattgattcagtgcttgaaggatttgctagattgaagggcctggatgggaagtatgcactagcaaagcctttatctcaacattctgtaaagcaaacatatcgatctgttattcctaatggacgagtcagaaagtatgaacttgttgatttgccacaagattcaagaccactgctggtattcatcaatggcaagagtggaggtcgaaatggaccttctcttagaagaaggctgaacatgttgttgaatccaatacagatatttgagctaagtgcttctcaggcacctgaagttggattacaactattccacaatgtgaaacacttcagaatccttgtttgtggtggggatggaactgtagcatgggttcttgatgctattgaaaagcagaactacgaatctcctccccctgtcgccattcttcctctcggaactggaaatgacctatcacgtgttatgcgctggggagggggtttatcttctgttgaacgacaaggaggcatatatgcacttttaaatgatgttgaccatgcagctgttacagtgcttgatcgctggaatgtaaccatcaaagagaagaatggaacagaaggtgaatgcaccaagcaaataaaatttatgactaattatttaggtattggatgtgatgcaaaggttgcttatgacttccacaccactagggaggaaaaaccagataaattttgcagtcagtttgtcaacaagcttatatatgctagagagggtgcaaaggatatgatggataggtcatgttctgatttaccgtggcatgttagccttgaggttgatgggaaaaacattgaaattccggaggatgcagaaggtgtgattgtaatgaatatcccctagctacatgggtggtgtggatctgtggcaaaacgacaatgaccataatgatgatttcagattgcaatcaatccatgacaaaatacttgaggtggtttgtatatccgggacatggcatctaggcaaactgcaggtcggactttcaagggcacaccggttagcccaaggaaaagttataagattacacctccacagttcattccctgtgcaggttgatggtgaaccatggatccagccacctgggtgccttgagatatctcatcgtggacagatgttcatgctaaggaggacatctgaagagcctactggacatgctgccgcaatcatgagtgaggtgctcgtgaatgcagagtgcaatggtgtgattgacgcctctcagaagagattgcttctccacgagatagcactccgtttatcctcctgagactatccagtccagcaaccctcacctcacaaggctaactcattctgtaccctttgatgccaaacctatcgtctctgttgagaaatccctttgcacagacgtaaactgctatggtagagttggtgtatacaatacaaagagatagaaggtgtatacaatacgaggaaatagaagtttccttttgtatttggctgtaccttttgagataggtcatctacttctttgtggctggtttcatcagaacagctgttgaagaattttgtagcgcagagccactataaccgcaactagggctcaatgaaatgtaactagagtggatgtgaatgttttgtttgcaaagatattgatgcaactgttatcacacttcatgagaagacctgaatttcgctaaggggccattttgatccttttattttgaaggaattggaatttacttcaaagagtaggttatttagtttgtaatttgacattcaatcactttccagattttatatataagtctatctcaaatttatag

SEQ ID NO: 5304 - DNA, 2832 bp, Oryza sativa
ctctccccatcctctccgtctcctctcctcccttccaccacgacgcgaccgacgcggcggagaaacccgcgaagccgcagtccagccagcgaggggccgccagccgaagctgaagcgagagctagggtttgctccaccccttgaacccgcccgcgcccccgccgccacgaggccgatcgagggttctgcttctgaggctgtcaagcctggcggctaattgggatggaccttgtgggatcgctgctggtgaacatgactcacttggttgacacctcggggctccagttcttcggctggctcatcaccgccggctccttcggcctcgccgcgctcatctacgccctcctcaggctgcagagggcggcgtcgctgtactggatcaaggcggctgccagggagaagaaggcggcgtggaagtcgttgcggtgccccagctccggccacacctggaccgaggactacttccgcggcggccagccttcgacgtgctgcgtgtgcctgtcgtccctgaccacagctcagggtgtgggctctcggggtgccgatgccgttgtggtccaccgctgctcggtgtgtggggtggcggcccattctggctgctctcgtggcgccgagaaggactgcaagtgtgtttcacagcatggtgcttccaccttgcttcatcactggtcggagaggtgggtggagctggatgacaacccagagatgtcctctttctgttactactgcgatgagccatgtggtgtgccatttctcggcgtctctccaatatggcgctgcctgtggtgccagcggcagatccatgttgattgtcatgcaaagctgttaaaggagacggggaatacttgtgatctaggccttctcaggaggctcattgttcctcctctgtctgtgaaagaagttgcccaaggaccagcaattactggaatgctcaactcgatcaaggaaggtcttgtcacttcatcagttaggggcaggattaagaggcgaggcaacaagaaacgcatgaacaaccatcctggtggtaagacaagtccagtccccacaaacagctctatccttgattctgtgcttgaagggtttgctagactgcagaacttgaatggaaagtatgcgctggcaaaccataagtctagtggggattctgtcaagcaaacacatggatatggcagccctaatggagggaagaaaaagtatgaaatcattgatttgccacaagattcaaggccactgcttgttttcattaacggcaagagtggaggacgaaatggaccttctcttagaagaaggcttaacatgttgctaaatcctatccagatatttgagcttagtgcttctcagggacctgaagttggattgcaatttttccacaatgtaaaacacttcagaatccttgtttgtggtggggatgggactgttgcatgggttcttgatgctattgaaaagcagaactatgaatctcctcctcctgtttccattcttccattaggaacaggaaatgacctatctcgtgttatgcgctggggtggaggtctgtcttctgttgaaggacaagggggaatatgtgcacttctaaatgatgttgaccacgcagcagttaccgtgcttgatcgctggaatgttgccatcaaagagaagaatggagcagaagatcaatgtaccaagcaagttaaatttatgactaattatataggtgttggatgtgatgccaaggttgcatatgacttccacactacgagagaggaaaaaccagataaattttgcagccagtttgtcaacaagctgatatatgctagagaaggcgctaaggatatcatggataggtcatgttctgatttaccatggcatgttagtcttgaagttgatggaaagaacgtcgaaattccagaggacgcagaaggtgtgattgttctgaacattcctagctacatgggcggtgttgatctttggcaaaacgacaatgaacatgatgatgattttggtttgcaatccatgcatgacaaaatgcttgaggttgtctgtatatctgggacgtggcatctaggaaaactgcaggtgggactctctagagcacacaggctagcccaagggaaagttataaggttgcatctccacagttcattccctgttcaggttgatggtgagccatggatccagccacccgggtgccttgagatatctcatcgtgggcagatgttcatgttgaggaggacatccgaagaacccaccgggcatgccgctgctatcatgagcgaggtcctcatgaatgcagagtgcaatggtgtgattgatgctgctcagaagagattgctccttcatgagatcgcactacgtttgtcctcctgacagtccagcccgtcccctccatctcttactcgccgtactaatgctgataccgaatccactcccttttgtgttgagaagttccccttgcacaggtgagaaaggcatacggtaggatgttacacagaggaaatagaagatttcctgttttcatgatttgacgtatacatacatagattaccttttcacactaggtgatctgcttctttgtttactgggctgtgggctcatcaaggtgagtattcaccagtttacgaagagttttgtagcgcgtagaaacactgttactgcatgtagggttcaatgagcattgtaagctgtatctagggtgtatcggtggcctatacaaaaggtatgaatgtaagtttaatccctcgttttttgacagaagaaagattgtggattttgttcctgatgagtgactaaagattcttttggtgcctgtcgtgacagaaatcagttgtgatgatcctgctgattttatttctt

SEQ ID NO: 5305 - DNA, 2652 bp, Brachypodium distachyon
cctcttgaggccgtcaaccctggccaattgggatggaactggtgggatcgctgctggtgaacatgacccgctgggttgatccttccgggattgagttcttcgggtggctcatcaccgtcggctcctttggcctggcggcgctcatctacggtctcctcaggctgcagagggaggcgtcgctctactggctcaaggcgtccgccagggagaagaaggccgcgtcaaaggttcagcgatgcccctgctcgagccatagctggactgaggactgcttccgaggtggccagccttcgacgtgctgcgtgtgcctgtcgtcgctaggctccgctcagggcgtgggatccaagggccctgatgctgatgtggttcaccggtgctctgtgtgcggagtggcagctcattggtactgctcgcggggtgctgacaacgactgcaagtgcgtcgcgcaggctggtgcttccactttgctgcatcactggtcggagaggtgggtggagatggatgacaacccggagatatccaccttctgttattactgtgaggagccctgtggtgtgccattcctaggtgtatctcctatctggcgctgcctctggtgccagaggcagatccatgttgattgtcatgcaaagctgctgaaagaaacggggaacacctgtgatcttggcctcctcaggagacttattgttcctcctctgtcggtgaaagaagttggtgaagctcaggcaatcagtggagtgttcaactcattcaaagaaggctttgtcacttctaggggtcggattaaaaggcaacgcaacaagaagcgcatgaacaatcaaccaggtgttaagacaaatccgactcctgcagacagttcaatccttgactcagttcttgaagtatttgccaaacttcagaacctgaatgaaaaggatgcactcgcaaatcccaagttatctagaaactctctcaaggaaacacatggatctgacattcccaatggaggaaaaaagaagtatgagcttgtaaatttgccacaagattcaaggccgctgcttgttttcatcaacggcaagagtgggggccgaaatgggccttctcttagaagaagacttaacatgctgctgaatcccatacagatatttgagctaagtgcttctcaaggacctgaagttggattgcaactattccacaatgtaaaacacttcaggatccttgtttgcggtggggatggaactgtagcatgggtccttgatgccatagaaaagcagaactatgaatctcctccccctgttgccattctcccactaggaacaggaaatgacctttcacgtgttacacgctggggtggaggtttgtcttctgttgaaggacaagggggaatatgtgcacttctaaatgacgttgatcatgcagcagtgacagtgcttgatcgctggaatgtagcgatcgaagagaagaatggagcacaaggtcaatgcaccaagcaagtaaaatttatgactaattatttaggtgttggatgtgatgccaaggttgcatatgacttccacactaccagggaggaaagcccagataaattttccagtcagttcgtgaacaagctgttatacgctagagaaggcgctaaggatatgatggataggtcgtgttctgatttaccatggcatgttagccttgaggttgatggaaagaacattgaaattccagaggatacagaaggtgtgatcgttctgaatattgctagctacatgggtggtgttgatctttggcaaaatgacaatgaacatgatgacgatttcatttcacaatcaatgcacgacaaaatgcttgaggtggtttgtatatctgggacatggcatctaggcaaattgcaggtagggctttcgagagcccaccggctagcccaagggaaagttataagatttcacctccacagctcattccctgttcaggttgatggggaaccatggatccagccacctgggtgccttgagatatctcatcgtggacagatgttcatgttgaggaggacatctgaagagcccactgggcatgccgcggccatcatgagtgatgtcctcgtgaatgcagagtgcaacggtgtaattgatgctgctcagaagagattgctcctccatgagatagctctccgtttatcctcctgacactccatatatagctgtctcccctcagaaagctaacagcatactatactgttgataccaaacccttttgtgtcgagaagtcccttggcacagatgagaaaggcatacggccggtagatgttgatgtatacaccaagggaatagaaggttccccgctttcatgattgatggtaccttccagagttcagataggtttgtcgcttctttgttggctgggctcatctgaagtggctaccaaggtgagatagaagaatcccagttcagacagaattttgtagagcttagagcactgtaattgcatataggtctcggcaaggcattgtaactgcaaatagggctcttgtaactagagagtgcgtcaatgcgtgtagtttaagtttaatctcttactatgtcacaagcattgtggattttgctacttccagcgagtgactaaaattttgggttgtggtgaaggaactgatggtgataactctgctgatttatgttcttcctgcatgtt

SEQ ID NO: 5306 - DNA, 2409 bp, Brachypodium distachyon
cctcttgaggccgtcaaccctggccaattgggatggaactggtgggatcgctgctggtgaacatgacccgctgggttgatccttccgggattgagttcttcgggtggctcatcaccgtcggctcctttggcctggcggcgctcatctacggtctcctcaggctgcagagggaggcgtcgctctactggctcaaggcgtccgccagggagaagaaggccgcgtcaaaggttcagcgatgcccctgctcgagccatagctggactgaggactgcttccgaggtggccagccttcgacgtgctgcgtgtgcctgtcgtcgctaggctccgctcagggcgtgggatccaagggccctgatgctgatgtggttcaccggtgctctgtgtgcggagtggcagctcattggtactgctcgcggggtgctgacaacgactgcaagtgcgtcgcgcaggctggtgcttccactttgctgcatcactggtcggagaggtgggtggagatggatgacaacccggagatatccaccttctgttattactgtgaggagccctgtggtgtgccattcctaggtgtatctcctatctggcgctgcctctggtgccagaggcagatccatgttgattgtcatgcaaagctgctgaaagaaacggggaacacctgtgatcttggcctcctcaggagacttattgttcctcctctgtcggtgaaagaagttggtgaagctcaggcaatcagtggagtgttcaactcattcaaagaaggctttgtcacttctaggggtcggattaaaaggcaacgcaacaagaagcgcatgaacaatcaaccaggtgttaagacaaatccgactcctgcagacagttcaatccttgactcagttcttgaagtatttgccaaacttcagaacctgaatgaaaaggatgcactcgcaaatcccaagttatctagaaactctctcaaggaaacacatggatctgacattcccaatggaggaaaaaagaagtatgagcttgtaaatttgccacaagattcaaggccgctgcttgttttcatcaacggcaagagtgggggccgaaatgggccttctcttagaagaagacttaacatgctgctgaatcccatacagatatttgagctaagtgcttctcaaggacctgaagttggattgcaactattccacaatgtaaaacacttcaggatccttgtttgcggtggggatggaactgtagcatgggtccttgatgccatagaaaagcagaactatgaatctcctccccctgttgccattctcccactaggaacaggaaatgacctttcacgtgttacacgctggggtggaggtttgtcttctgttgaaggacaagggggaatatgtgcacttctaaatgacgttgatcatgcagcagtgacagtgcttgatcgctggaatgtagcgatcgaagagaagaatggagcacaaggtcaatgcaccaagcaagtaaaatttatgactaattatttaggtgttggatgtgatgccaaggttgcatatgacttccacactaccagggaggaaagcccagataaattttccagtcagttcgtgaacaagctgttatacgctagagaaggcgctaaggatatgatggataggtcgtgttctgatttaccatggcatgttagccttgaggttgatggaaagaacattgaaattccagaggatacagaaggtgtgatcgttctgaatattgctagctacatgggtggtgttgatctttggcaaaatgacaatgaacatgatgacgatttcatttcacaatcaatgcacgacaaaatgcttgaggtggtttgtatatctgggacatggcatctaggcaaattgcaggtagggctttcgagagcccaccggctagcccaagggaaagttataagatttcacctccacagctcattccctgttcaggttgatggggaaccatggatccagccacctgggtgccttgagatatctcatcgtggacagatgttcatgttgaggaggacatctgaagagcccactgggcatgccgcggccatcatgagtgatgtcctcgtgaatgcagagtgcaacggtgtaattgatgctgctcagaagagattgctcctccatgagatagctctccgtttatcctcctgacactccatatatagctgtctcccctcagaaagctaacagcatactatactgttgataccaaacccttttgtgtcgagaagtcccttggcacagatgagaaaggcatacggccggtagatgttgatgtatacaccaagggaatagaaggttccccgctttcatgattgatggtaccttccagagttcagataggtttgtcgcttctttgttggctgggctcatctgaagtggctaccaaggtgagatagaagaatcccag

SEQ ID NO: 5307 - DNA, 2691 bp, Hordeum vulgare
ggaggcttcatcgtctctcgactcccccctccttcagcagccagcacttgacgacgagacgagacctaggggagccgcgagacaggcggtccgaagcgagaacaaacccgcgcccaccacgaggttctgccttttgaggccaaccaaacctggccaactgccatggacctggtgggatcactgttgataaacatgacccgctgggttgacccttctgggattgaattcttcgggtggctcatcacagtcggttcctttggcctggccgcgctcatctacggtctcctcaggttgcagagggaggcgtcgctctactggctcaaggcggccaccagggagaagaaggctgcgtccaaggcgctacggtgcccctgctcaagccatacctggactgtggactgcttccgtgttggccaaccttcgacgtgctgtgtgtgcctgtcgttgctgggctcgcctcagggtgtaggctcgagggcccctgatgctgatgttgtttgccggtgctctgtgtgtggagtggcggctcattggtactgcttacagggcgctgacaaggactgtaagtgtgtcacgcaggctggtgcttccactttgctgcatcactggtcggagaggtgggtggagatggacgatagcacggagatatcaaccttctgttattactgcgatgagccctgtggtgtgccattccttggcgtctctcctatatggcgctgtctttggtgccagaggcagatccatgtcgattgtcatgcaaagctgttgaaggagacggggaacacttgtgatcttggcctgctcagtagacttattgttccacctctatcggtgaaacaagttggtcaaggtccggcaaccggtggagtgttcaactcaatcaaagaagggtttgtcacttcttcagttaggggtcggattaggaggccccgcagcaagaaacgcatgaagaatcagtctggtgttaagacaattccgatttccgcagacagttcaattctcgactctgttcttgaaggatttgctagactgcagaacctgaatggaaagtatactctggcaaaccccaagttatctggaaacactctcaagcaaacacgtggatctgacattactaacggagaggaaaagaagtatgagcttgtaaatttgccacaagattcgaggccgctgcttgttttcatcaacggcaagagtgggggccgtaatgggccttctcttagaagaagactgaacatgctgctgaatcccatacagatattcgagctaagcgcttctcagggtcctgaagttggattgcaactattccaaaatgtaaaacacttcagaattcttgtttgcggtggggatggaactgtggcatgggttcttgatgccatagagaaacagaactatgaatcccctccccctgttgccattcttccgctaggaacaggaaatgacctatcacgtgttacccgctggggtggaggtttgtcttctgttgaaggacaagggggaatatgtgcacttttaaatggcattgatcacgcagcagttacggttcttgatcgctggaatgtagccatcaaagagacgaatggggcacaaggtcaatgcaccaagcaagtaaaatttatgactaattatctaggtataggatgtgatgccaaggttgcatatgatttccacacaactagggaggaaaggccagataaatttagcagtcagtttgtgaacaagctgatatatgctagagaaggcgctaagcatatgatggataggtcatgttccgatttaccatggcatgttagccttgaagttgatggaaagaacattgaaattccagaggatgcagaaggtgtgatcattctgaatatagctagctacatgggtggtgttgatctttggcaaaatgacaataatcatgacgatgatttcagttcacaatcaatgcatgacaaaatgcttgaggtggtctgtatatctgggacatggcatctcggcaaactgcaggtaggactatcgagagcacatcggctagcccaaggaagagttataagatttcacctgcacagttcattccctgttcaggttgatggtgaaccatggatccagccacctgggtgccttgagatatctcaccgtggacagatgttcatgttgaggaggccatctgaagagcccactgggcatgctgcggcagtcatgagtgacgtccttgtgaatgcagagtgcaatggtgttattgacgctgctcagaagagattgctcctccacgagatagcactccgtttatcctcctgacagtccatactgccctctcccctcagaaatctaacactgttgataccaaacccttttgtgttgagaagtcccttttgcacagatgaaaaggcatgtggtagatgttgatgtatacaacgagggaatggaaggtttcccacgcttatggttgactgtacctttttctgaatttggataggttggttgcttctttgttggctggggtgccagttgaagtggctatcaaggtgagaaagaatcccagagaattttgtagagaccttagggcaccctaattgcatgtactgcttttgtaagtgtcttcaacaacaaggcatagctttgcagctagcgtctaaaattttgtgttgttgtattgaagaagctcatggtggtattcctgctgattaaaaaaaaaaaaaaaaa

SEQ ID NO: 5308 - DNA, 887 bp, Solanum lycopersicum
acaccataaagatacccttctatcaactgtcaactactgccacagagatgatacatgaacattacatttccaatccacacacataaatatatcccaaatcaagaaatctcattaataacatgtttgatacaggggaattttctccaagttcttcaacagctgctgtgtctgcagagtgttttagcagtagcagttgcttcagcagtctatcatcctcaaagaagaagaagattcatagtagtaacaacgcgaggaggttcagcgatgaacagattaaatcattagaaaccatgtttgaaacagagaccaaacttgaaccaagaaagaagcttcaactagccagagaactcggattgcaacctcgacaagtagcaatttggtttcaaaacaagagagctcgatggaaatcgaagcaactcgaaagggattacagtatacttaaatccaattatgacaatcttgcttctcaatacgaagctttaaagaaagaaaaacaatccttgcttattcagttgcaaaaactgaatgatgtgatgcagaaagaaagggggaagtactgttgcaagcaagaaatcgagtcagacaacagatgctctgtaattaagaaaaatgaaatggaagggatgccaagcttgtcttttgacttatcatctcaacatggaacaaatggtgttatgtcagatgatgacattgacagcagtataagagccgattatctcgggttagatgatgatgcagagtatcatctactgaaaattgttgaaacaggggatagttctttaacttcccctgaaaattggggctgtttagacgacgatggtatcttaaaccatcagcctaatagttctagttatgatcagtggtgggatttctggtcttgaatcaaa

SEQ ID NO: 5309 - DNA, 2376 bp, Solanum phureja
ccaaaacgtcatgcctaacgtgaagactccccatctacctacgatccgtcgccgtctccaattgcagctcagatttctctataataacatttgccatttcgggcctgcaaagcacatcaacgatagtattatggattcacagtcgtcaccacatggctctattatcttctccacagttggcagaaccaattacggcttcgacatcttctccatcaaatctccattttctttcctcaattctccggtagagcatcgcctcacagacggtacctccatcaattacaacggacagttcgtcgatgaagatcaaacactcgtattcgtctctgagagatcaggtgctcctcgcatttacttgagacgcccctcctctcaggtacagattgaacaacttcctacttccattgatagcctatttctcgaccgtccgtttcttcgaaatagacgactctactatatttcagctcatcagcaacccaaacaagttttcaccagctcgtccgctctttactctaccaatatagaggatggaagtaagatcacccgcttaactccgtatggctttgctgattatagtccggcgatttcgcagtctggacacctgattgcggttgcatcttacggagaccgtcgttggcctactggtgaattccatgacctgactactgatattgttgttttccctgaatccgaccccgaaaagcggatagtcgtgtgccaacacggtggctggccaacttggtctggtgattcgactatcttttttcaccgacaagctgatgatggttggtggagcatttttagagttgatttgcctgaggataaacccaatttgtgtgctgatccgattcgagttactcctcctggtgtgcactgctttactcctgcagcagcctcgtacaattccaaatcaatgattgctattgctaccagaagaccggggaagaggtatcgccacattgagattttcgatgtggagtcacacgagttctattcggtgaccgagttgcttaaccctaccacccaccattacaatccattcttctctcctaagtcgacgtttctcagttatcaccggttccgaggtgaatcatcatcgggagatgcaacaattccttccttggacccggtaatttcttcagagaaaggactgagaatgctgaggcttaatggatcatttccttccttctctccctcaggtgactttattgcgttcaatcatgatttcaatgctaattcaggcctcgaaatcatcaaatcagatggttccaagaagtggacattgttcaaaggccgtacggctttctgcaactcctggtctccagctgaacccgatgtgatttttacgtcagtcggacctgtattcgactctgtaaaagcaactgttcaaatcgcacgagtctcattcaattcattaaatctaaccaacgatgattgcgggaaaattccagtagaaatagaagttctcacaaaagaggagacaggaaataatgccttcccttcctgctctccagacggaaagcacattgtattccgatcaggccgttcggggcacaaaaatctgtatattatggatgctgttaaaggagagctggagggtggaggaatccgtcagctaacagaggggccatggattgatacaatgccaagctggtcacctgacggaaagctgattgcattttcttccaacaggcacaatccggataatgtcacttgcttcagcatttatgtcattcatcctaacggcacaggtcttcgtaggatccacgtggcagggccggagggatctgatgaagtagataaagagagattaaaccatgtatgctttagtaaggactgtgagtggcttctgttcacgggcaacttgggtggagtaacagcagaaccagtgtcactgccaaaccaataccaaccgtatggtgacttatatttggtgaagttggatgggagtgggttgagacgcctgacatgtaatgcatatgagaatggaactccggcatggcacccatcggctatgcctatgactgctttggacatagaacggaacgtaatagtaggagataagttgaggggtgaatttgatgatgtactatggatgaattgttgaggtagaacaagtgtctagtcaagaaaaagatcaacccgaacttcaaacaagtgctattgttgttctctcattgagttcagatatcatgttattcgtatgggctgacgacagaagtatctctgcaaaatgatcctgtcaaggattcttgtattctattttcggatctcttacatgttaaaataaacatctctatagagatttgatgtaaattgttatgggatagctcagttgagagagcgtcaactgaagatcgtgtaagtgcgcataat

SEQ ID NO: 5310 - DNA, 2745 bp, Solanum phureja
tcatatttctttcttcttcttccccaaaacaccttaaaccctaaaaaaaaaaaacctcaaaatctagcattttttctaacacatttctcagcaaaatggggaaaaagcagcaaaaaaaggtccaaaatcaagaagaattgctgaaaacattgggagatttcacaagcaaagagaattgggacagttttttcactatcagaggttcagatgatgcttttgaatggtacgcagagtggtctcagctcaaagaaccacttctctctaatctcacaattccatcatcaaacgatgccgtttctgcaaaagaactgcaaattcttgttccgggttgtggcaattcgaagctctctgagtatctctatgatgaggggttttgtaatattactaatgttgatttctctaaagttgttatttcggatatgttgagaagaaatattcggtctagacctgttatgaaatggcgcgtcatggacatgacgaatatgcagtttgccaaggagagctttggtgccattctcgacaagggaggattggatgctttaatggagcctgagcttggatcaaagttaggaactcagtatttgtctgaggttaaaagattgctaaaagtcggggggagatttatttgcctcactttggcagaatctcatgtattaggtttactcttcccaaagtttcggtatgggtggaagatggggattcatcccattgctctgaaaccatctgacaggtcaagcctacagacttttatggtggtagccgagaaagaaaattctcctgctttgtgccaaatatcgtcaactgttgatcagtcgtcctttggtggtctaaagaaccaggttcatggactctttcaagcacttgaagatgaaaataaaatacgtgcagattattccagtggttctgatataacgtatgcactagaagacttgaaaatcggagttgagggaaatctggcagagctatgtccaagtcgtagagttcagcttagtttaggtgaacctggggtttcccttttctgttacagagctgtgcttcttgatgcccaaaaggactttggaccttttgcatatcaatgtgctgtgtttcttgtaccaaagactcgagctcatgagtggctgttctcttcagaagaaggacaatgggcagttgtagaaagctctaaggctgctcgtttaataatgattttgttggattctagccattcagatgccaatatggatgacattcagaaagatctctctcctctgataatgcaattggcgccgggagattttgacgatgaagctcagataccttttatggctgcaagtgatggaatcaagcagcgaaagattgttcaagagatcacatctcccttgactggtccaataattgtagatgatgtgatctatgagaaagttgatgacaatattagccgcctctttgcgtctgatgatgtgatatttcgtcgccttactttccaaagaacggagagtttagttcaatctgaggctgtgctatcaaaagaaggatcaccgaagtctgtagctgatattaatcagaagacaggccagtcatcttcaaaatccaagaaaggaaatcagaaaaaatctgggtctaatgtctcgtcatctgatggattgagcagcgatttgaaagttgaccacagttatttggccagttcatatcatactggaatcatctctggttttacattgatatcttctcatttggatggtttggcatctacgggaggcacggtgagatcagtagtaattggtcttggagcaggattgcttcccatgtttctatgtaagcacctgagttttgcagagattgaggttttggagttggatcctgtggttgtagatcttgctagagactattttgattttagagatgatgaacgattaaaggtacatgtgactgatggtttgaagtatgtcaaggatgcagctcatgcagttaccaatggttatgaaaatgatgtttctgaggcaaaggtcccttcttccaatggtaattccatcccgtctagtgcaccacttaaaaacacagaaaaaatcgacatgctcattgttgatgtggactcttcagactcgagttctggtttaagttgtcctgctgcggactttgttgaagagtctttccttgtggcagcaaaagattctctttctgatcaaggtttatttgtcataaatttggtaacaaggtcacaagccatcaaggattcgatttactccaaattgaagtcggtatttcctcacctcttccaccttcagctggacgaagatgtcaatgacgttattttcgctctcaagacggagacatgtatcacggaagataaatttcatgaggcttctcaacaactcacaagattattaaacctagaaaactccccatggggccaaaatataacagaagccactagcaagatcaaaaggttgagatgatttacacactgatgaatgccatcaaatactgcagtctaggggcgaagctagaagccgatgtacgagttcagctggaactagaacccataaagttcaaatcctggctccgcctctatccatgccctgctgaggctgccaatagaacgatgcacttcttctttttaagtacctctacgttgaaccacggattatccccgtgcgagtttgatatttacatgccttgagatttataagatatagtattgaaattgctatgtacattggataaatttgatatgtttgtcaaagttatgtaatgtgtttatatgta

SEQ ID NO: 5311 - DNA, 870 bp, Brachypodium distachyon
atgggcggcacgacctcatcgacggggcgtggtggggggacgtcgctgggggacctgccggagaactgcgtcgcggaggtgatgctcaggctggacccaacggagatctgcgggatggcgcggctcagtcgcacgttccgaggcgctgcgtccggggacggcgtctgggaggccaagctgccgcgcaactacgcgcgcctcctcgctgcagccgccgccggcgacgacagcgaggaagccgccgcgttggagctggaggcgatcccaaagaaggaggtgtacgcgcggctctgccgccgcaaccgtctcgacgggggcaccaaggagttctggctcgacaaggttggtggaggcatttgtatggcaatctattcaagggcgctttcaataactggcattgatgataggagatactggaacttcatcacaaatgatgaatcaaggttccattcggttgcttatctgtcccaaatctggtggtttgaagtcaggggtgaggttgaattcttcttcccagaaggtacatatagtctgtttttccgtcttcatctaggcagaccattcaagcggctcggtcgccgggtttacagtgctgaccacatccatggctgggacgtaaagccggtgcgcttccaactatcaacttctgatgggcagcatgctcagtccaagtgttatttaactgatccaggtgtctggatcaatcaccatgtgggcgattttgtcgtgaagaactcgaacgagccactgaatgtccaatttgcgatggttcaaatagattgcacacacacaaaaggaggcttatgtgtggattcagtcgttataaaaccgcaataccttgcacagaaaatggcagctaggacgagctct

SEQ ID NO: 5312 - DNA, 1152 bp, Brachypodium distachyon
ttgtgtttctcggttgaatcatgggcggcacgacctcatcgacggggcgtggtggggggacgtcgctgggggacctgccggagaactgcgtcgcggaggtgatgctcaggctggacccaacggagatctgcgggatggcgcggctcagtcgcacgttccgaggcgctgcgtccggggacggcgtctgggaggccaagctgccgcgcaactacgcgcgcctcctcgctgcagccgccgccggcgacgacagcgaggaagccgccgcgttggagctggaggcgatcccaaagaaggaggtgtacgcgcggctctgccgccgcaaccgtctcgacgggggcaccaaggagttctggctcgacaaggttggtggaggcatttgtatggcaatctattcaagggcgctttcaataactggcattgatgataggagatactggaacttcatcacaaatgatgaatcaaggttccattcggttgcttatctgtcccaaatctggtggtttgaagtcaggggtgaggttgaattcttcttcccagaaggtacatatagtctgtttttccgtcttcatctaggcagaccattcaagcggctcggtcgccgggtttacagtgctgaccacatccatggctgggacgtaaagccggtgcgcttccaactatcaacttctgatgggcagcatgctcagtccaagtgttatttaactgatccaggtgtctggatcaatcaccatgtgggcgattttgtcgtgaagaactcgaacgagccactgaatgtccaatttgcgatggttcaaatagattgcacacacacaaaaggaggcttatgtgtggattcagtcgttataaaaccgcaataccttgcacagaaaatggcagctaggacgagctctgtatagattcgtgggacaaatggacgtgactatctgtacaaacaacatagcttcgtttccgccatagtgtgcttgcggttatccaagttcgtctcggttctcaatcctgtattgtaattgaaacagtgagtgattttttttatttcctcttgtcccagtaggagcatcccacacttgtaaattgtgagctcatagacatatatctgctttgttctgtacttctgtggcgcctgatccttgtgtaccaaaagcttggttgaag

SEQ ID NO: 5313 - DNA, 1713 bp, Oryza sativa
gatcacacacacggcacccttcttcccggcttttctgctgctgcccatcgtcttctcccccctcccctcgaaaccaaccaaccttcaacctaaccccgcaagcaaacgccctgaccgactaaccctcgccaccgagcaaactcgagacccaaagccacgcaactttctttgtgttctttgatttgttcttggcaatcgcatcagagatctattgattgattttgaagcagaggaggagcagagaggtagacgaagagctgcaagattctttgcctgttcaatcgaccgtgctttgtgagagcatacgacggcggcggcggcgagggcgcggcgtctcacctgccccgacggcacggcgaccgaggaggggaggccggcgacgagatgggctccttgccgctgaggagtggtagcagcctgcctccaccgtccttctccaagtcgccggcctcgctgctgctgctgtccaagtcgctcaccctctactgctgagagagctcgagctcgagctcgagagctcatgggcggtgtcacctcgtcgtcggcggggggaggcggaggaggggagaccgcgctgggggacctgccggagagctgcgtggcggaggtgctgcgcaggctggacccgccggagatctgccggatggcgcggctcagccgcacgttccgcggcgccgcgtccggcgacggcgtctgggaggccaagctgccgcgcaactacgcgcgcctcctcgccgtcgccgccgacggggaagccgccgcgctggaggcgatccccaagaaggaggtctacgcgcgcctctgccgccggaaccgattggacggcggcaccaaggagttttggctggacaagggtggtggaggtgtctgcatgacaatctcttcaagggcactttcaataactggcattgatgataggagatattggaatttcattccaaatgatgagtcaaggtttcatgcggttgcttatctctcacaaatttggtggtttgaggtcagaggggaggttgaattctgcttcccagaaggtacatatagcctatttttccgtcttcatctaggcaggccactcaagcgactaggacgacgggtttatagctccgagcacatccatggctgggatataaaaccagtgcgcttccagctatcaacttctgatggacagcaagctcagtccaagtgctacttaactgatcctggtgtctggatcaatcaccacgtcggcgatttcgtcgtgaagagctctaatgaactagtgaagatccaatttgcaatggttcaaatagattgcacacacacaaaaggtggactctgtgtcgattccgtggctgtaaaaccacaatacctcgcgaagaagaaagcatctcggatatatgtgtaggttcttcgatcaagttcagctgattctcatcgataccgcatagctttgtttttatgcaccacttgtgtgcttgcttttgagttttttacagatcctgtaatatgtagttcatggggtaagtgatttttatttcctcttgtccctctagaagcatgttacacttgtaaattgttaatttagcatacagatagcttttgtggctcatgatccttgacaccctgtgcaccaatgttgttcttctggtagtgtatcaaaagctttcatggagcaatttcatcctcaatttctgagttctcgacttaatgagaagtgctagtgcgttttgctca

SEQ ID NO: 5314 - DNA, 1823 bp, Zea mays
ccatagtttagtcgcagcagtacaggctccacttgggagcgaggacgaggaggcgggtgccgctcctgtggcttcgccatgtgctctcgccccgcgtcctcggctcctccctcctcggtatctacatgccattatgccaagatctcccactctccgatctgaccagggccgggccaccgcagccatttgcgtctgctcttcccgaatccctgtctcgctttgccctccgtttctccagctataaagccggggggtcctgtggcgtgtgacctttttataccggatgtgcagcgcagggtcaacttcgtcaggtttcttggctccaacaaccttcctgggtcactctaaactgtaaagagatggggtgtggcccatcgatccccgacaagtacacgataggtgggaaggggcgcaagcgccggagcgtcatacaggaggttgccgtgttcgtgcccaccatccgcatcccagtggcctctgacatagctcatccgctcaggggaatagtttccaaggatcttgtcgaccgactctccacactccgtgcccatgtcgcctcgctggctgaagaaatctatcacgcggacgtatcagctgttcaagaactgcagcatgcgctagaggagtacttgccagttgttcttggtttaacaacgaaagagagccgtcttgaatcgtcagtacagttcagatggaagaccttagacgacgaccaggcgagagagtgttgtctggcgagcgcgtggtatgaggtgctctcggtggtccacatgatggccatgcttgcgttgtttgaggctaacctattgctcatcccaaagagcagccaaggtggtggtgaaaggaaggtagcagaagacgcaaagaaggatgtcgtcgattcattgctcagggcgtcgggatgcttagactactccgtgcatcgcatacttgttcagatacctgcgcaagtcaagaagggttttcccagttacttgcaggagggcatgcttgaggccatctcaattcaggcattggctcagtgtgtggaaatacagcttggcttggcttctgaatgtgagaaggcaacgctgtcagtaaagaggaggctagcttgtgagcaagtcagctatttttctcaggctcactattgtctgtcgggatgcgatacgagtgactcgtacgggaagaagcttctgctgttcctcaagtggaagtggatggaggccaaggctgtagcgtattactaccatggtctggtgctcgacaagggcggcgaaccggcaaaccatatcagtgcagtctgctgcctctctgcagctgatgacctgctctcagacagcaaaagggcttgcttgagtttttgcttggcaaatcctgtcacgagggtgcctcctccttggggtgtcatgaaaaacatgcacaaaaagatcccagatgtcgcttacaagaagttccaagcgcacgggcatctgtttgagcaaaacaagaacagcgcactccaatccgttcctgacctaccagagtttgcgctgtcgctgagaccggatggatacgagttgccaagcactgattcgatctgggataatgttgatggccaacctcagattcaaagcctcaaggagcatatgatagatgacgaagatgaagtaggcacaaaatgatagttctcacttccaaatgcttcttttcattgtaccaccaaaagtagcagagttcaaaaacgcttaatccaaaatgttttggattcagcatatggctcaactgaaaaaggaatcgcgatctctgtattattgcaagtattaccatatgatatagtaaagtcttatgtgtaatagaatcat

SEQ ID NO: 5315 - DNA, 1712 bp, Oryza sativa
cttaatcttccacctgtgatgtgctcctcgccatgtgatcctcgccccctcctcctcctcctcctcctcgggtcaaaacaaacacacacacacacatctgtctcttcttcaggtttcaggtctcctggctgctttgcttctgctgcctctgtgtggggctccagccttgctcagattgatgattggtgatccaaccatcttcatcacttacagagatggggtgtggtgcatcaatccctaagaaatgcaaggtaggagggaaggggaagaagcgccggagcgtcatacaggaggttgccatattcgtgccgacaattcgcattccggtggacagtgatgttgcccatccactcagaggactagtatccaaggagctcgtcgaccgcctctcaaagttcagagaccgcgttgtcgcgctctctgaagatatctattgcgcggatgtttcggatgtttcagagttacagcatgcccttgaggagtacttgccagttgttcttggtttaacaatgaaagaaagccgtcttgaatcatcggtggaattcagatggaggaccttggatgatgacgaagagtgttgtctttcaagtgcatggtatgaagttctgtcagtcatccacatgatggcgatgcttgcattgtttgaagccaacctgatacttattccgaagaacggtcaagttggaggtgaaaggaaggtatcagaagatgcaaagaaggatgtcgtcgattcgttgctcagagcatcaggatgtttagattactgcgtgcaccgtatacttgtacagatgccggcacaagtcaagaaaagttttcctagttattttcaggaaggtatgcttgaggccatttcaattcaagcattggctcagtgtgtagaaatacaacttggattggcttcagagtgtgagaaggcaactctgtcagtaaagaggaggctagcctgtgagctagtcagttatttctcacaggctcactattgcttatcgggatgcgacacgagcgactcgtttgggaagaagctcctgctgtttctgaagtggaaatgcatggaagccaaggcagtagcatactactaccatggccttgtgcttgacaaaggcaatgaagccagcagccacatcagtgcagtgtgctgcctctctgcagctgatgatctagttgcagatagcaagagggcttgtttgagcttctgcttggcaaaccccatcacaagggtacctcctccttggggtatcatgaggaatatgcacaagaaaatcccagattctgcgtgcaagagattccaaatgtatggatatctttttgaacaagacaataacagtgcacttcaatccttaccagatctaccagaatttgcgctgtcgctgagacccgaagggtatgaactgcctagcactgattcaatctgggataatgttgatagccagcctcagattcagagcctcaaggagcatctggatgatgaagacgaagtggaaacaaaatgatacttcagacatccaaaacgcttcatttcattgtgccatgaaaagtagcattagtactagcaaagacatcggaatgctcaattcagaagtgtttggattcagcatatggcattgagccaaaaagaaatcagaatatgtaccttctgtgtagttgaaagtatctatcactgattataaacagaatcaacaataataggaaagaagggtgtttcttatttttca

SEQ ID NO: 5316 - DNA, 1458 bp, Brachypodium distachyon
ccctgctcctgcagcagcggagtgcgatctgaacaaaggctgccattcgcgtctcctcctctgcagggtcaaacgactctctctctccttcctctctgccggttcgccgtcttcagacttcaggtctcgtgatctcgtcttgtcttggctgcactgcacggctgcctctgaccttgctcgcattaaatggggtgtggtgcgtcaatccccatcaaatatagtgggaaggggcggaagcgccggagcgtcatacaagaggtcgccgtgtttgtgcccaccatccgcgtcccggaggataccgacatcgtcaatccactcagggggctggtttccaaggagcttgtcgatcgtctcgccgcgctccgtgcaaacgtcgtgtcactgtctgaagaaatatatcatggggatacgtcagcagtttctgaattacaacgcgcactcgaagagtacctgccaattgttcttggtttagcaatcaaagagagccgtctagaagcatcagtgaaatttagttggaggaccttagatgatgaccaggagtgtgttcttgcgagtgcatggtatgaagtgctttctgttgtccacatgatggccatgctcgcattgtttgaggcaaatcttttactcattccgaggaatgttcaggatggaagtgaaaggaaggtgtccgaagatgcaaagaaggatgtcgttgattcattgctcagagcatcaggatgcttagactactgtgtgcatcgcatacttgttcagataccggcacaaatcaagaagagctttcctagttacttgcaggaaggtatgcttgaggcgatctcaattcaggccttggctcagtgtgttcaaatacagcttggattggcttccgagtgtgataaggcaacattatcggtaaagagaaggctagcttgtgagcaagtcagctatttttcgcaggctcactattgtctgtcgggatgtgatacaagtgactcatatggaaagaagcttctgctgttccttaagtggaaatgcatggatgctaaggcagtagcatattactaccatgctctagtacttgacaagggcagcgaaccgagcaaccatataagttcagtctgctgcctgtctgcagctgatgacctcctggctgagagcaagagagcttgtctaagcttttgcttggcaaaccctatcacaagggtacctcctccttggggtatcatgaagaacatgcacaagaaaattccagacgtcgcgtacaagaaattccaaatttatggacatcttcttgaacaaaacaagaatagtgcacttcaatccttgcctgatctaccagagtttccactctcgctgagacctgaagggtatgaatttccaatcaccgattcaatctgggagaatgttgattgccaaccccagattcagagtcttaaggagcatctaaaggatgatgaagaagtagccgaaacaaaatga

SEQ ID NO: 5317 - DNA, 1528 bp, Triticum aestivum
cacatcaaatggggtgtggcgcctcggtccccaacgggaagggccggaagcgccggagcgtcgtacaggaggtggccgtgtttatcccgaccatccgtgtcccggtggccaccgacgtggtccaaccgctcagggggctggtttccaaggagctagtcgatcgcctcgcgacgctccgtacgaacgtcgtcgcgctggctgaagatatctatcatggggatatgtcggctgtctctgaattgcaacgcgccctcgaggagtacctgccggttgttcttggattaacagcgaaagagagccgtcttgaagcatctgtgcaattcagctggaggaccatagacgatgaccaggagtgctgtcttgcgagcgcgtggtacgaagtactttctgttgtccacatgatggcgatgcttgcgctgtttgaggcaaacctcaaactcatcccgagggacggtcaaaatgggactgaaaagaaggtatctgaagattcaaagaaggatgttgtcgactcattgctcagggcatcagggtgcttagactactccgtgcatcacgtacttgttaagatacctgcacaaattaagaaaggctttcctagttacctgcaggaaggtatgcttgaggccatctcaatccagtctttggctcagtgtgtagaaatacagcttggattggcttctgagtgtgaaaaggcgacgttgtcggtgaagaggcggctagcctgcgagcaagtcagctatttttcaaaggctcactactgtctgtcgggatgcgacacgagcgactcgtatgggaagaagctcctgctcttcctcaagtggaaatgcatggacgccaaggcagtagcatattactaccatgctctagtgctcgacaaggggagcgagccgaccaaccatataagcacggtctgctgcctctctgcagctgatgacatccttgcagagagcaagagggcttgtctgagcttttgcctggcaaatcccatcactagggtgcctcctccttggggcatcatgaagaacatgcacaagaaaattccagatgtcgcgtataagaaattccaaatctacgggcatcttttcgagcaagacaagaaaagtgcccttcaatccttgcccgatcttccggagtttccgctgtcgctgagacccgaagactacgaatttccgggcaccgattcgatctgggagaatgttgattgccaaccccagattcagagcctcaaggagcatttggaggacgaaacagaggaatcgtcgaaatagttcaggctcccggatgcttcattgtattgtaatccagaaaattaacagaacttacacaggtactactagtggtaaaacttgtagcatgcatgcataaggcagaacagaaggactacagaatattacctgtgtaagtgaaaagaatttactaccatctgattgtaaatgtcttacagaatggctgataatcaagcttttgcttcggtaacatgtcatgatcagacgagccaactgaagtgtaaagcatcaaccagaatact

SEQ ID NO: 5318 - DNA, 1030 bp, Panicum virgatum
  misc_feature (996)..(996): n is a, c, g, or t
ggagcaacctcgaagctagttcaaactagtgggagaggttgtgggaggaagacgaagaccacgaagaagctgctgcagctgaagctacccggtgacgatcgatcctaagaatcaatcgggtcgtccatggcgaggggcaaggtgcagctgcggcgcatcgagaacccggtgcaccggcaggtgaccttctgtaagcgccgcgccgggctgctcaagaaggcccgggagctctccgtcctctgcgacgcccacatcggcatcatcatcttctccgcgcacggcaagctctacgacctcgccaccaccggaaccatggaagaactgatcgagaggtacaagactgccagtggggaagcggccctaccgggtgacggcggcggcggactcagaatggacccaaaacaggagactgtggtgctgcaacaggaaatcaatctgctccacaagggcctgaggtacatctacggaaacagggcaaatgaacatatgaatgttgaagaactgaatgccctagagaggtacttggagatatggatgtacaacatccgctccgcaaagatgcagatgatgattcaagagatccaagcactgaaaagcaaggaaggaatgttgaaagctgctaacgaagttctccaggaaaagatagtagaacagagtggtttgcgcgacgtaggcatgatggtagcagatcagcagaatgggcattttagtacagtcccactgatagaagagatcactaacccactgactatactgagtggctattctaattgtaggggctcagagatgggctattccttctaacggtaataacaccctgagggtctcgtactgttgattactagtgtgtaatacaattaataatgcttgtgtaatggtttgttctgagactttggtgtaacttaagctatatagcccattgtccctcaggagtgccctgtgtattgtattgtattgtatcatcatacattgtggttctttacttcccctaaaganctcttgaggagctctgatgttgtgttatttcact

SEQ ID NO: 5319 - DNA, 1077 bp, Leymus cinereus x Leymus triticoides
ccgttgctgtcgccgttgctgtcgccgcagcaacctcgaagctagtccaaactagtggaaggttgtgtgcaatccatcatcatcttcgtctgtctgtctgtctgtctatctacccctggtcaatccatccatccatccatcatcatcacccatggcgagaggcaaggtccagctccgccgcatcgagaaccccgtccaccggcaggtcaccttctgcaagcgccgcgcggggctcctcaagaaggccagggagctctccgtcctctgtgacgccgacatcggcatcatcatcttctccgcacacggcaagctctacgacctcgccaccaccggaaccatggatgggctgatcgagaggtacaagagtgccagcggagaaggcatgaccgccgacggctgcggcgaccagagagtggacccaaagcaggaggcaatggtgctgaaacaagaaatagacctgctgcagaagggactgaggtacatttatggaaacagggcaaatgagcacatgaatgttgatgagctgaatgccctggagaggtacttggagatatggatgttcaacatccgctccgcaaagatgcagataatgattcaagagatccaggcactgaagagcaaggaaggcatgttgaaagctgccaacgaaattctccaggaaaagatagtagaacagcatggactgctcgacgtaggcatgactatagcagatcagcagaatgggcattttagtacagtcccactgatagaggagatcactaacccactgactatactgagtggctattctacttgtaggggctcagagatgggctattccttctgatggtaataacgccctgagggactattagtgtgtaatattatggttaatacttaacaaagcttgtgctatggtttgatgtggtactactctgtaatatttatataggccatattccctcaggagtgcccttaaggccttaagtattgtactgcattgagctgctgtgcttttacattcccctaaagaactctcgaggagctctcatgttgctatttcacataatcaagacctttgtttgtgtgttgtttcga

SEQ ID NO: 5320 - DNA, 1200 bp, Oryza sativa
gtaagcaagagatagggataaggggaagaggaggaagaaggaggaggtgtagggagaaaccggagcaacctcgaagctagtccaaactagtgggaggttgtctttccggcaagccggagcccggagctatcgatcatcaagctttctaccccgaccgacgaggaagaagacgactgatcaattgatcaaaccgatctctccatagctaggtagacaggaggagaggaggaagaagagggggagaggagacttatcttgatcgatggcgcgaggcaaggtgcagctccgtcgcatcgagaacccggttcaccgtcaggtcaccttctgcaagcgccgtgccggcctgctgaagaaggccagggagctctccatcctctgcgaggccgacatcggcatcatcatcttctccgcccacggcaagctctacgacctcgccaccaccggaaccatggaggagctgatcgagaggtacaagagtgctagtggcgaacaggccaacgcctgcggcgaccagagaatggacccaaaacaggaggcaatggtgctcaaacaagaaatcaatctactgcagaagggcctgaggtacatctatgggaacagggcaaatgaacacatgactgttgaagagctgaatgccctagagaggtacttagagatatggatgtacaacattcgctccgcaaagatgcagataatgatccaagagatccaagcactaaagagcaaggaaggcatgttgaaagctgctaacgaaattctccaagaaaagatagtagaacagaatggtctgatcgacgtaggcatgatggtagcagatcaacagaatgggcattttagtacagtcccactgttagaagagatcactaacccactgactatactgagtggctattctacttgtaggggctcggagatgggctattccttctaacactaataatggcctgggggatacttgtgttcattactagtgtgtaatatggttaataatgcttgtgttgctgtttgctttgctattctgatgtaccttatttagacaagttcccgcaggaagtgtcttttagtattgtatttgtcttgggctgtggtgctttgtttttccctaaagaactcttgaggagctctgttgttgaaccatttcaagtaattgagactattgtttcctggaacgtttattacatttgtagaattaagcatttt

SEQ ID NO: 5321 - DNA, 813 bp, Zea mays
atggcgcggggcaaggtgcagctgcggcgcatcgagaacccggtgcaccggcaggtgaccttctgcaagcgccgcgccgggctgctcaaaaaggcccgggagctctccgtcctctgcgacgcccacgtcggcatcatcgtcttctccgcgcacggcaagctctacgacctcgccacctccgggaccatggaagagctgatcgagaggtacaggactgccagcagcagagaagcagccgacggctgcggcgacaataacagaatggacgcaaagcaagaaaccatggtgctgcaacaggaaatcaacctgcttcagaaaggcctgaggtacatctatgggaacagaacaaatgaacacatgaatgttgaagaactgaatgctctagagaggtacttggagatatggatgtacaacatccgctctgcaaagatgcagataatgattcaagagatacaagcactgaaaagcaaggaaggcatgctgcaagctgctaacgaagttcttcaggagaagatagtagaacagagtagtttgcttgacgtaggcatggttgtagcggatcaacagaacgggcattttagtacagtcccactggtagaagagatgatcagtaacccgctgactatactgagtggctattctaactgtaggggctattccttctgacactgtcataacaccctggggggctaactctctgttgattactactactagtgtgtaatactaccagttaataaagcttgtgtaacttgccatatagccctccaggagtgccctggtattgtatctgtgtgcttttttttacttccc

SEQ ID NO: 5322 - DNA, 1158 bp, Zea mays
tttttttttttgaaaaggagaattttaggtgcgtgcatgccctgatgcgagccaaacaaacgttaaatggcaacaggtgtaaagcaggcaagagattcgtatgggatttgattattcttcttccatcaatccatgggactagcctgtaggcagagctgctggttggccaggccatatatatgcaccaggggcctgtggtggctgagcaacaagagagagaggacatagccgcacaaagggaaggagaccctcgccaacctcgaagctagtccaaactagtgggaggttgagtgcagggatcgatcgaggaagacgagacaagcttcttctgctgctgctgccgcccccgccagctctagttcaccagagttactagctacgccggcaccgaccgtccatggcgcggggcaaggtgcaacttcggcgcgtcgagaacccggtgcaccggcaggtgacattctgcaagcgccgcgcggggctgctcaagaaggcccgggagctctccgtcctctgcgacgccagcgtcggcatcatcgtcttctctgcgcacggcaagctctacgacctcgccaccaccgggaccatggaggagctgatcgagaggtacaaagctgccagcgccggagaagcgacgaccgacggctgcggcaggcacaacaggatggaccccaaacatgaaaccacggtgctgcaacaggaaatcaacctgcttcagaagggactgaggtacatctacgggaacagggcgaacgagcacatgaatgttgacgaactgaacgccctagagaggtacttggagatatggatgtacaacacccgctctgcaaagatgcagataatggctcaagagatccaagcactgaaaagcaaggaaggcatgttgaaagctgccaacgagattctccaggaaaagatagtagagcagagtagtttgcttgacgtaggcatggtggtagcggaccagcagaatgggcgttttagcacagtcccactggtagaagaggtgatcagtagtaacccactgactgtactgagtggctattctagctgtaggggttcagagatgggctactccttctgaccgtaataacaaacagcctgggggctccttctgttgattactactagtgtgtaatacatacagtcaataaagtctgt

SEQ ID NO: 5323 - DNA, 1099 bp, Triticum aestivum
  misc_feature (902)..(902): n is a, c, g, or t
  misc_feature (921)..(921): n is a, c, g, or t
  misc_feature (927)..(927): n is a, c, g, or t
  misc_feature (1000)..(1000): n is a, c, g, or t
  misc_feature (1008)..(1008): n is a, c, g, or t
cgacgacccacgcttccggtagtctcacatagagagagctgcaagggtgcaaccgcagcaacctcgaagctagtccaaactagtggaaggttgtgtgcaatccatcatcttcttcgtctctccatctaccccttatcaatcatccacccatccatccatccatcatcatcatccatggcgagaggcaaggtccagctccggcgcatcgagaaccccgtccaccggcaggtcaccttctgcaagcgccgcgcagggctcctcaagaaggccagggagctctctgtcctctgcgacgccgacatcggcatcatcatcttctccgcacacggcaagctctacgacctcgccaccaccggaaccatggatgggctgatcgagaggtacaagagtgccagtggagaaggcatgaccggcgacggctgcggcgaccagagagtggacccaaagcaggaggcaatggtgctgaaacaagaaatagaccttctgcagaagggactgaggtacatttatggaaacagggcaaatgagcacatgaatgttgacgagctgaatgccctggagaggtacttggagatatggatgttcaacatccgctccgcaaagatgcagataatgattcaagagatccaggcactgaagagcaaggagggcatgttgaaagctgccaacgaaattctccaggaaaagatagtagaacagcatggactgatcgacgtaggcatgactatagcagatcagcagaatgggcattttagtacagtcccaatgttagaggagatcactaacccactgactatactgagtggctattctacttgtaggggctcagagatgggctattccttctgatggtaataacgccctgagggactattattagtgtgtaatatggtggttaatanttaacaaagcttgctttangtatgntttgctctggtactactctgtaatatttatataggccatattccctcaggagtgcccttaaggccttaagtantgtactgnactgtgcttttacattacctaaagaactcttgaggagctctgatgttgctatttcacataatcaagacctttgttggtgtgttgcttcgta

SEQ ID NO: 5324 - DNA, 1268 bp, Brachypodium distachyon
cttaagccagacaagggagcctcacatcgagagagctgcaagggcgccacagcagcaactggaagctagtccaaactagtggaaggttgtgtgcaaccaactatcatatctatcctgaccatccatccatccatccattgtctgtcatcgtcgccgtccatttgtccaaatacaaatcgaccagtcttatcatccgtctaccaagaccgtccatggcaagaggcaaggtgcagctccggcgcatcgagaacccggtgcaccggcaggtgaccttctgcaagcgtagggcaggattgctgaagaaggccagggagctgtcggtgctctgcgatgccgatatcggcatcatcgtcttctccgcccacggcaagctctatgacctcgccaccaccggaaccatggatgggctgatcgagaggtacaagagtgccagtggaggagaaggcagcatgcaggctgatggctttggtgaccacagaatggacccaaagcaggaggcaatggtgctgaagcaagagatcgacctgctgcagaagggactgaggtacatttatggaaacagggcaaatgagcagatgagtgttgaagagctgaattccctggagagatacttggagatatggatgttcaacatccgctccgcaaagatgcagataatgattcaagaaatccaagcactgaagagcaaggaagacatgttgaaagctgcaaacgaaattctccaggaaaagatagtagaacagcatggattagtaggacatcatggattgatcgacgtaggcatgacgatagcagatcagcagaatgggcattttagtacagacccactgatagaagagatcactaacccactgactatactgagtggctattctacttgtaggggctcagagatgggctattccttctgatggtaataaggccctgggggactagttgtgtttaattattagcagtgtgtaatatggtcattaatacttaataatgcttgtcttatggtttgttgtgtgctgctactctaataatttgcataggccatattccctcaggagtgcccttaaggccttaggtattgtattgacttgagttattgtgcttttatattccctaaagaactcttgaggagctctgatattattatttcacataattaagacctttgtttcttgttgcttgtaaattgtaatattgagatgctacaatctcttgccatcctttgtttgttcttgcttgtaaattgtaatattgagatgctacaatctcttgct

SEQ ID NO: 5325 - DNA, 1731 bp, Arabidopsis lyrata
aaacgccgaattctcatattctacataagacatggctctctttattatccttcctgtatattttttccttcataatatattactatccttctcgtttattaatacaaacttgaattcttcttctcttcgtctctcattcacatataaaaagaagcatcatcgcatgagtatctcacaacacatcataatgaccaaagaaatggattcatcacttaaaatcatcgacgaggcacaagtccctccatcaaactctgactcgtccgagtcactcactctcccactcaccttcttcgacctcctctggtataaacttcacgccgtcgaacgagtcatcttctacaaactcactgacgcaactcgtcctttcttcgactcagtcatcgtccccaacctcaaaacctctctctcctcctccctctctcactacctcccactcgccggaaaactcgtctgggaaccacttgatcccaaaccaaaaatcatctacaccccaaacgacgccgtttcattcaccgtcgccgagtcaaacgccgatttctctcgtttatccggcaacgaaccataccccaccgccgagttatacccgttagtccctgagttacaagttgccgatgactcagccgccgccgtgtcgtttcaagtcacgttatttccaaaccaagggttttgcatctgcgttaacgcacatcatgccgttttagatggaaaaacgacaaccatgtttctcaaatcttgggctcacacatgtaaaaatcaagattcttctctaccggacgatcttatcccaatttacgatcgtacggtcgtaaaagatccaacggatttagatacaaaagtcttaaacgcttggcacaaagtaggcaaagtcttcaccggtggtaaagaaccagagaaccctaaaagtttaaagcttttatggtcgccggaagttggtcccgacgtttttcgatacactctcagtctcactaaagagaatatccaaaagcttagagaaagacttaagaaagagtcttcctcctctgtttcctcatcaccaaaagagcttcgtttatcaacgtttgtgattgtttactcttatgctttaacgtgtttaatcaaagctcgtggcggtgatccgaatagaccagtcgggtacggattcgcagtggattgtcgaagccttatggttccaccagttccttctaattattttggtaattgtgtctctgcttgttttaaaatgccgataaaggcagagagttttatgagtgaagaagggtttttagctgctgcaagattggttagtgattcggttgaggcattggatgagaatgtagcatggaagattccagagcttttggaagggtttgcgactctttcaccaggagcacaagttttgtctgttgccgggtcgacccggttcggagtatacgggttggatttcgggtggggtagaccggagaaagtggtggttgtgtcgattgatcaaggcgaagcgatttctatggcggagagtagagatgggaatggtggtgtagagattggcttctcgctcaagaaacatgaaatggatgttcttgttgagttgcttcataaagggctagaaaattaaatcatattttttccttcttcataagagtaaaataatataagaaataaaatttattgtggaaaattgtagctttctattgtcaaataaatctagtttagagttccagcttcaccaggaaactcaatctttgaaccacatat

SEQ ID NO: 5326 - DNA, 822 bp, Triticum aestivum
ttcctatcccatcccactccagtgagctcgaaaccgagaggggaagaggaggaaacgatacagtactacaggcaaccatggaggtggtgactggcagcaacggcgggaggctgaacccgtgggcggagcccttcgtgccggggagctggtgccgccccgcccccgtgcaggcggccgcggcggaggtcgaggacttctcccccgagtggtggcgcctcgtcgcctcctcgccgtccttccgcgacagctggctccgcgactacggcgacctggggctcctggacgccgacgaaggcccagacgacagcgacgccttcttccctccgccgcgccacaacgatggggaggagaggaaaggagaagccgccgtcaagaagagcggaggggaggtggcgccctgggggatcgagaagtggtggcgggcgcacgtcgcctcgccgccggaggtcccgaagtatgcggagaaggcgcctgccaaggtcctgggcggcggcaggttcagcccccgcacaatccagcagcctcgctaagggaccgacgaaccccgtcattccgcgtcgatccatcgatcttggcataaatgaaagaaaaatactagaaaaaacagtagtactcctagttgtcttgcgagctctcctgctctcaattagccttgcttaatcttgttgtgtcgtcgtagtttgagttttcagccaaagatcgagcggaggtcaattgcgctgcgtatgtgttcagttgtctgtaaatggtgtagtgtgtaataagatgcagtgatacaatggctattccgtgcaaatggttttccggtttaaaaaaaaaaaa

SEQ ID NO: 5327 - DNA, 820 bp, Triticum aestivum
attccatcccgctccaccagtccacaccgcagcagcacgagtgagctcgagaccgagaggggaagagaggaggaagcgatacagtactacaggcaaccatggaggtggtgaccggcagcaacggcgggaggctgaacccgtgggcggagcccttcgtgccggggagctggtgccgccccgcccccgtgcaggcggccgcggcggaggtcgaggacttctcgcccgagtggtggcgcctcgtcgcctcctcgccgtccttccgcgacagctggctccgcgactacggcgacctggggctgctggacgccgacgaaggcccagatgacagcgacgccttcttccctccgccgcgccacaacgatggggaggagaggaagggagaagccgccgtcaagaagagcgggggcgaggtggcgccctgggggatcgagaagtggtggcgggcgcacgtcgcctcgccgccggaggtcccgaagtacgcggagaaggcgcctgctaaggtcctgggcggcggcaggttcagcccccgcaccatccagcagcctcgctaaggggcctaccggcctcatcgcgttccgcatcgatccatcgatcttggcataaatgaaaaaaagatagaaaaaaatagtagtagtttgcgagctcttctgctcttaattagctttgcttatgcttaatttcgtcgtgtctcgttctagtttccagctcaagatcgaagggaggttcactccactgcgctgtgtatgtgtctgtaaatgatgtaataagatgcagtgatgcaatgactcaattcggtgcggtttaccggttaaaaaaaaaa

SEQ ID NO: 5328 - DNA, 799 bp, Triticum aestivum
cccactccaccagtccacaccgcagcagcactctagtgagctcgaaaccgagaggaggaagcgatacagtactacaggcaaccatggaggtggtgaccggcagcaatggcgggaggctgaacccgtgggcggagcccttcgtgccggggagctggtgccgccccgcccccgtgcaggcggcggccgcggcggaggtcgaggacttctcccccgagtggtggcgcctcgtcgcctcctcgccgtccttccgcgacagctggctccgcgactacggcgacctggggctcctcgacgccgacgaaggcccggacgacagcgacgccttcttccctccgccgcgccacaacgatggggaggagaggaagggagaggccgccgtcaagaagagcggaggggaggtggcgccctgggggatcgagaagtggtggcgggcgcacgtcgcctcgccgccggaggtcccgaagtacgcggagaaggcgcctgctaaggtccagggcggcggcaggttcagcccccgcaccatccagcagcctcgctaagggaccgaccagcctcaccgcgttccgcgtcgattaatcgatcttggcataaatgaaaaaaaaaagatagaaaaaaatactagtagttgtttgcgagctcttctgctcttaattagctttgcttatgcttaatttcatcgtgtctcgttttcgttctagtttccagctcaagatcgaagggaggttcaattcactgcgctgtgtatgtacagacgtctgtaaatgatgtactagtgtgtaataagatgcagtgatgcaat

SEQ ID NO: 5329 - DNA, 1070 bp, Triticum aestivum
  misc_feature (159)..(159): n is a, c, g, or t
  misc_feature (163)..(163): n is a, c, g, or t
  misc_feature (167)..(167): n is a, c, g, or t
  misc_feature (184)..(184): n is a, c, g, or t
  misc_feature (193)..(193): n is a, c, g, or t
  misc_feature (196)..(197): n is a, c, g, or t
  misc_feature (210)..(210): n is a, c, g, or t
gggccggacccccccccgggagctttaccagggcccgggggccggaaaccatttcaccccgggaaccgctatgacccttaggccctttttgggggacccttatgacccaatttgccccaaaaaccacggcgggacccggtcccggaatcccccggaaanttcntcanccacgggtccgcccagngttccgaantgnngcacgagaccctnacatggactgaagtagagaaaaccgtccattcccatcccaccccactccaccagtccacaccgcagcagcactccagtgagctcgaaacctagaggaggaagcgatacagtactacaggcaaccatggaggtggtgaccggcagcaacggcgggaggctgaacccgtgggcggagcccttcgtgccgggcagctggtgccgccccgcccccgtgcaggcggcggccgcggcggaggtcgaggacttctccaccgagtggtggcgcctcgtcgcctcctcgccgtccttccgcgacagctggctccgcgactacggcgacctggggctcctcgacgccgacgaaggcccggacgacagcgacgccttcttccctccgccgcgccacaacgatggagaggagaggaagggagaggccgccgtcaagaagagcggaggcgaggtggcgccctgggggatcgagaagtggtggcgggcgcacgtcgcctcgccgccggaggtcccgaagtacgcggagaaggcgcctgctaaggtcctgggcggcggcaggttcagcccccgcaccatccagcagcctcgctaagggaccggccagcctcatcgcgttccgcatcgatccatcgatcttggcataaatgaatggaaaagggatagaaaaaatagttgtttgcgagctcttctgctcttaattagctttgcttatgctaaatttcgtcgtgtctcgttttcgttctagtttccagctcaagatcttagggaggttcaattcgctgcgctgtgtatgtacagacgtctgtaaatgatgtactagtgtgtaataagatgcagtgatgcaatgactccattcggtgcaaaaaaaaaaa

SEQ ID NO: 5330 - DNA, 765 bp, Avena sativa
caccagtccacaccgcgccagcactagtgagctcaagactgaagagcaaccatggaggtggtgaccggcagcaacggcggcaagctgaacccgtgggcggagcccttcgtgccggggagctggtgccgccccgtggaagtggtcgcggaggtcgaggacttctcccccgagtggtggcgcctcgtcgcctcctcgccgtccttccgcgacagctggctccgcgactacggcgacctgggcctcctggacgccgaccaaggcccagacgacggcgacgccttcttccctccccggacgccgcgcaacgaaggaggagaggggaggaagggggaagccgccgtcaagaagagcggaggcgacgtggcgccctggggcatcgagaagtggtggcgggcgcacgtcgcctcgccgccggagatccccaagtacgcggagaaggcgcccgcgaagctcgccggcggcggcgggaggttcagcccccgcaccatccagcagccgcgctaaggggccagccaacctcaatcatcagtcgtcaccttcagcatcgagatccatcgatctgggcataaataatggaaaaaaaaaacttactactagtggttgtttcccgagcttttatgctcttaattagctttgcttaatcctgtcgtgtcgtctagttcgagttttcagctcaagatcgagcgaggtctcagtgcgcatacgtatgtacagatgtctgtaaatgtgtagtgtgtaataagatgcagtgatgcaatgactcta

SEQ ID NO: 5331 - DNA, 824 bp, Hordeum vulgare
gcaagctcagtcatggggacgatgaagcgatgcatggttcctggcatcctgctgatgcttgcgctgcaggcagccatgctggtcgccggcgacgaggtgggctccattctcctgccgagccagggccaaggcgaagcagctgccatggcggcgggcaagaagaggccgtggaagtgctgcgaccaggcggtgtgcaccaggtccatcccgccgatctgcacctgcatggaccaggtcttcgagtgcccgaaaacctgcaagtcctgcgggccgtccatgggcgacccgtcccgccggatctgccaggaccagtacgtcggcgaccctgggcccatctgccggccgtgggagtgctgcgacaaggctatctgcaccaggtccaacccgccgacgtgccgctgcgtcgacgaggtcaaaaagtgtgctccgacgtgcaagacctgcctgccgtccaggtcgcgcccttcccgtcgcgtctgcatcgacagctactttgggcccgtcccaccccgatgcacgccccgggaagacgttgccgccggcggtaactaggtaccgcatgcacgcgcgcgttggtcacccgatcaacgcccggccgtcgagtgtcctcctgccctgctgcagcaccagcagcgtgtaagaataaaataaaaatggatggccggcctcctgccaattatgagtaagacatcatggcagtgtttagtctttatgaatgagcggtgggtgcatgttttttcgatctcacagtcttctttctcaagtccttttccaatgcatcgtctgttagatcatctttattccaatgcatcgtctgttagatc

SEQ ID NO: 5332 - DNA, 762 bp, Hordeum vulgare
ccaaacccacaagagcaagctcagtcatggggacgatgaagcgatgcatggttcctggcatcctgctgatgcttgcgctgcaggcagccctgctggtcgccggcgacgaggtgggctccattctcctgccgagccagggccaaggcgaagcagccgccatggcggcgggcaagaagaggccgtggaagtgctgcgaccaggcggtgtgcaccaggtccatcccgccgatctgcacctgcatggaccaggtcttcgagtgcccgaaaacctgcaagtcctgcgggccgtccatgggcgacccgtcccgccggatctgccaggaccagtacgtcggcgacccagggcccatctgccggccgtgggagtgctgcgacaaggctatctgcaccaggtccaacccgccgacgtgccgctgcgtcgacgaggtcaaaaagtgtgctccgacgtgcaagacctgcctgccgtccaggtcgcgcccttcccgtcgcgtctgcatcgacagctactttgggcccgtcccgcccctatgcacgccccgggaggacgttgccaccggcggtaactaggtaccgcatgcacgcgcgcgttggtcacccgatcaacgcccggccgtcgagtgtcctcctgccctgctgcagcaccagcagcgtgtaagaataaaataaaatggatggccggcctcctaatgccaattatgagtaagacatcatggcaatgtttaatctttatgaatgagcggtgggtgcgtgttttttcgatctc

SEQ ID NO: 5333 - DNA, 788 bp, Hordeum vulgare
ggctcagtcatggggacgatgaagcgatgcatggttcctggcatcctgctgatgcttgcgctgcaggcagccctgctggtcgccggcgacgaggtgggctccattctcctgccgagccagggccaaggcgaagcagccgccatggcggcgggcaagaagaggccgtggaagtgctgcgaccaggcggtgtgcaccaggtccatcccgccgatctgcacctgcatggaccaggtcttcgagtgcccgaaaacctgcaagtcctgcgggccgtccatgggcgacccgtcccgccggatctgccaggaccagtacgtcggcgacccagggcccatctgccggccgtgggagtgctgcgacaaggctatctgcaccaggtccaacccgccgacgtgccgctgcgtcgacgaggtcaaaaagtgtgctccgacgtgcaagacctgcctgccgtccaggtcgcgcccttcccgtcgcgtctgcatcgacagctactttgggcccgtcccgcccctatgcacgccccgggaggacgttgccaccggcggtaactaggtaccgcatgcacgcgcgcgttggtcacccgatcaacgcccggccgtcgagtgtcctcctgccctgctgcagcaccagcagcgtgtaagaataaaataaaatggatggccggcctcctaatgccaattatgagtaagacatcatggcaatgtttaaatgagcggtgggtgcgtgttttttcgatctcacagtcttctttctcaagtccttttccaatgcatcgtctgttagatcatctt

SEQ ID NO: 5334 - DNA, 706 bp, Triticum aestivum
cacgccatggggatgaagcgatgcatcgttcctaccatcctgctgatgcttgcactgcagtctgcagccctcctcgtcgccggcgacgtgggcgccattctcctgccgagccaaggccaagttgcagacgaagcagccatggcggccaagaagaggccgtggaagtgctgcgaccaggcggtgtgcacccgctccatcccgccgatctgccgctgcatggaccaggttttcgagtgcccctccacctgcaaggcctgcgggccgtccgtgggcgacccgtcccgccgcgtctgccaagaccagtacgtcggcgaccccgggcccatctgccggccgtgggagtgctgcgactcgcctacctgcactaagtccaacccgccgacgtgccgctgcggggacgaggtcgacaagtgtgctccgacctgcaagacctgcctgccgtccaggccgcgcccctcccgccgcgtctgcctcgacagctacttcgggcccttcccgcccgcatgcacgcccaaggctgtcgccgccggcggtaactagcacgcccgttgatcacgcgatcaacgccgtcgagtgtcctcacctaccctgctgcagactgcagtagcagtgtgtaagaataaaataaaaatggatgacctatatgtgtggtggacacacgattatgaataagacaacgtggtgatgttcaatccttactcgtgcc

SEQ ID NO: 5335 - DNA, 734 bp, Triticum aestivum
ggcacaagcaagctcagtaagcacgccatggggatgatgaagagatgcatcgttcctagcatcctgctgatgcttgcactgcatgcagcgctccttgtcgccggcgacgtgggcgccattctcctgccgagccaaggcgaagttgcagacgaagcagccatggcggccaagaagaggccgtggaagtgctgcgacaaggcgttctgcacccgctccaaaccgccgacctgccgctgcatggaccaggtcttcgagtgcccatccacctgcaaggcctgcgggccgtccatgggcgacccgtcccgccgcgtttgccaagaccagtacgtcggcgaccccgggcccatctgcaggccctgggactgctgcgactcgcctgtctgcaccaagtccaaccctccgacgtgccgctgcgcagacgaggtcgacaagtgtgctccgacctgcaagacttgcctgccgtccaggccgcgcccctcacgccgcgtctgcctcgacagctactttggagccttccctcctgcgtgcacgccgtcagaggctgttgccgccggtggtaactagcacgcgcgttgatcacgcgatcaacgccgtcatcgagtgtcctctcctgccctgcagcatcagtagcagtgtcaagaatgaaataaaaatggatggtctatatgtgtggtggacacacaattatgaatgaataagacaacgtggcaacgttcaatctttatctttatata

SEQ ID NO: 5336 - DNA, 897 bp, Triticum aestivum
  misc_feature (22)..(22): n is a, c, g, or t
  misc_feature (33)..(33): n is a, c, g, or t
ggaaggcgatcggtccggcctnttcgctatacnccagctgcgaaagggggatgtgctgcaaggcgataagttgggtaacgccagggttttcccagtcacgacgttgtaaaacaacggccagtgaattgtaatacgactcactatagggcgaattgggcccgacgtcgcatgctcccggccgccatggccgcgggattagcgtggtcgcggccgaggtcacacgccatggggatgaagcgatgcatcgttcctagcatcctgctgatgcttgcattgcaggcagccctgctcgtcgccggcgacgtgggcgacattctcctgccgagccaaggccaagttgcagacgaagcagccatggcggccaagaagaggccgtggaagtgctgcgaccaggcggtgtgcacccgctccgaaccgccgatctgccgctgcatggaccaggttttcgagtgcccctccacctgcaagtcctgcgggccgtccatggccgacccgtcccgcctcgtctgccaagaccagtacgtcggcctccccgggcccatctgcaggccgtgggagtgctgcgactcgcctacgtgcaccaagtccaacccgccgacgtgccgctgcggggacgaggtcgacgagtgtgctccgacctgcaagacctgcctgccggccaggtcgcacccttcccgccgcgtctgcatcgacagctactttggagccttccctcctgcgtgcacgccgtcagaggctgttccgccggtgtaactagcacgccattgatcacgcgatcaacttcgtcgagtgttgtgtaagaataaaataaaaatggatggccggctactgctagtagtctatatgtgtggtggacacattatactatgaataagacaacatggcaatgtctaattt

SEQ ID NO: 5337 - DNA, 757 bp, Triticum aestivum
gcacaagcaagctcagtaagcacgccatgggaatgaagcgatgcgtcgttcctagcatcctgctgatgcttgcactgcaggcagccctcctcgtcgccggcgacgtggatgccattctcctgccgagccaaggccaagacgaagcagccatggcggccaagaagaggccgtggaagtgctgcgaccaggcggtgtgcaccaggtccatcccgccgatctgccgctgcatggaccaggtcttcgagtgcccctccacctgcaaggcctgcgggccgtccgtgggcgacccgtcccgccgcgtctgccaagaccagtacgtcggcgaccccgggcccatctgcaggccctgggactgctgcgacctgcccctgtgcaccaggtccaacccgccgacgtgccaatgcatggacgaggtcgacaagtgtgctccgacctgcaagacctgcctgccgtccaggtcgcgcccttctctccgcgtctgcatcgaccgctactttggacccttcccgcccgcgtgcacgccgtcagaggctgttgccgccggcggtaactagcacgctcacgcgttgatcacccgatcaacgccgtcgagtgtcctctcccgccctgctgcagcagcagtgtctaagaataaaatagaaatggatggcctatatgtgtggtggacacacaattatgaataagacaacgtggcaatgttcaatctttatctttatataaacgaacggtgctgttttcttccgcttcaaaaaaaaaa

SEQ ID NO: 5338 - DNA, 825 bp, Triticum aestivum
cggcacgagggcgaggctacatatactacgtctggctgctagctacaaacgcacaagcaagctcaataaagcacgccatggggacgaagaagagatgcatcgttcctagcatcctgctgatgctagcactgcagtcggcagccctcctcgtcgccggcgacgtgggcgccattctcctgccgagcaaaggccaagttgcagacgaagcagccatggcggcggccaagaagaggccgtggaagtgctgcgacaaggccttctgcaccagatccatcccgccgatctgccgctgcatggacgagctcttcgagtgcccctccacctgcaagtcctgcgggccgtccatggctgacccgtcccgcctcgtctgccaggaccagtacgtcggcgacccggggcccatctgcaggccgtgggagtgctgcgacctgccccggggcaccaggtcaaacccgccgacgtgtcaatgcctcgacgaggtcgacaaatgttccccaacctgcaagacatgcctgccgtccaggtcgcgcccttcccgccgcgtctgcatcgacagctactttggacccttcccgcccgcgtgcacgcccaaggctgtcgccgccggcgggaactagcacgcccattgatcacgcgatcaacgccgtcgtcgagtgtcctctcctgccctgctgcagactgcagtagcttcgtgtaagaataaaataaaaatgaacggccggtctcctgccaccacgcgctactgctggtagtagcctatatgtgtgatggacacacaattatgaataagacaaacatagttttcttcggtttaaaagggggggc

SEQ ID NO: 5339 - DNA, 695 bp, Triticum aestivum
aagaaagctcagtaagcacgccatggggatgaagcgatgcatcgttcctagcatcctgctgatgcttgcagtgcatgcagccctcctcgtcgccggcgacgttggcgccattctcctgccgagccaaggccaagtcgcagacgaagcagccatggcggccaagaagaggccgtggaagtgctgcgacctggcggtgtgcaccaggtccatcccgccgatctgccgctgcatggaccaggtcttcgagtgtccctccacctgcaaggcctgcgggccgtcaatgggcgacccgtcccgccgcatctgccaggaccagtacgtcggcgaccccgggcccatctgcaggccctgggagtgctgcgactcgcctgtctgcaccaagtccaacccgccgacgtgccgctgcggagacgaggtcgacaagtgtgctccgacctgcaagacctgcctgccatccaggccgcgcccttcccgccgcgtctgcatcgacagctactttggacccttcccgcccgcatgcacgccgtcagaggctgtcgccgccggcggtaactagcacgcacgttgatcacgcgatcaacgccgtcgagtgtcctctctcccgcgctgctgcagcagcagtgtgtaagaataaaaaaaaaatagatggcctattagtgtgatggacacacagttatgacttatgaataagacaa

SEQ ID NO: 5340 - DNA, 766 bp, Triticum aestivum
aattcggcacgaggacgccatgaagatgaagagatgcatcgttcctagcatcctgctgatgttttcactggaggcagcgctcctcgtcgccggtcgcacctccgccgccgacgaagtgggcgccattctcctgccgagccaaggccaagaggaagcagccatggcggcggccaagaagaggccgtggaagtgctgtgaccaggcggtgtgcaccaggtccatcccgccgatctgcagctgcatggaccaggtcttcgactgcccctccacctgcaagtcctgcgggccgtccatggctgacccgtcccgccacgtctgccaagaccagtacgtcggcgaccccgggcccatctgcaggccgtgggagtgctgcgactcgcctacctgcaccaggtccaacccgccgacgtgccgctgcggggacgaggtcgacaagtgtgctccgacctgcaagacctgcctgccgtccaggtcccgcccttcccgccgcgtctgcatcgacagctactttgggcccttcccgcccgcatgcacgccgtcagaggctgttgccgccggcggtaactagcatgcgcagcacacgcgcgttcatcacccgatcaacgccgtcgagtgtcctcataccctgctgcagcagcagtgtctaagaataaaataaaaatggatggtctatatgtgtggtggacacaattatgaataagacaacgtagcaatgttcaatctttataaatgaacggtgcagttttcttcggtttcaaaaaaaaaa

SEQ ID NO: 5341 - DNA, 769 bp, Triticum aestivum
tcggcacgagcacaagcaagctcagtaagcaagccatggggatgaagcgatgcatccttcccagcatcatgctgatgcttgcactacagtcggcagccctcctcgtcgccggcgacgtgggcgccattctcctgccgagccaaggcaaagttgcagaccaagcggccatggcggcggccaagaagaggccgtggaagtgctgtgaccaggcggtgtgcaccaggtccatcccaccgatctgccgctgcatggaccaggtcttcgagtgcccctccacctgcaaggcctgcgggccgtccatgggcgacccgtcccgccgcgtctgccaagaccagtacgtcggcgaccccgggcccatctgcaggccctgggactgctgcgactcgcctgtctgcaccaagtccaaccctccgacgtgccgctgcgcagacgaggttgacaagtgtgctccgacctgcaagacttgcctgccgtccaggccgcgcccctcacgccgcgtctgcctcgacagctactttggagccttccctcctgcgtgcacgccgtcagaggctgttgccgccggtggtaactagcacgcgcgttgatcacgcgatcaacgccgtcatcgagtgtcctctcctgccctgcagcatcagtagcagtgtcaagaatgaaataaaaatggatggtctatatgtgtggtggacacacaattatgaatgaataagacaacgtggcaacgttcaatctttatctttatatataaacgaacggtgctgttttcttc

SEQ ID NO: 5342 - DNA, 1886 bp, Leymus cinereus x Leymus triticoides
  misc_feature (4)..(4): n is a, c, g, or t
  misc_feature (6)..(6): n is a, c, g, or t
  misc_feature (8)..(10): n is a, c, g, or t
  misc_feature (12)..(12): n is a, c, g, or t
  misc_feature (14)..(14): n is a, c, g, or t
  misc_feature (17)..(17): n is a, c, g, or t
  misc_feature (19)..(20): n is a, c, g, or t
  misc_feature (22)..(30): n is a, c, g, or t
  misc_feature (32)..(32): n is a, c, g, or t
  misc_feature (37)..(37): n is a, c, g, or t
  misc_feature (40)..(40): n is a, c, g, or t
  misc_feature (42)..(43): n is a, c, g, or t
  misc_feature (53)..(53): n is a, c, g, or t
  misc_feature (65)..(65): n is a, c, g, or t
  misc_feature (67)..(67): n is a, c, g, or t
  misc_feature (71)..(71): n is a, c, g, or t
  misc_feature (78)..(78): n is a, c, g, or t
  misc_feature (81)..(81): n is a, c, g, or t
  misc_feature (91)..(91): n is a, c, g, or t
  misc_feature (100)..(100): n is a, c, g, or t
  misc_feature (103)..(103): n is a, c, g, or t
  misc_feature (105)..(105): n is a, c, g, or t
  misc_feature (114)..(114): n is a, c, g, or t
  misc_feature (338)..(338): n is a, c, g, or t
  misc_feature (511)..(511): n is a, c, g, or t
  misc_feature (560)..(560): n is a, c, g, or t
  misc_feature (701)..(701): n is a, c, g, or t
  misc_feature (704)..(704): n is a, c, g, or t
  misc_feature (725)..(725): n is a, c, g, or t
  misc_feature (830)..(830): n is a, c, g, or t
  misc_feature (833)..(833): n is a, c, g, or t
  misc_feature (835)..(835): n is a, c, g, or t
  misc_feature (840)..(840): n is a, c, g, or t
  misc_feature (853)..(854): n is a, c, g, or t
  misc_feature (883)..(883): n is a, c, g, or t
  misc_feature (893)..(893): n is a, c, g, or t
  misc_feature (903)..(903): n is a, c, g, or t
  misc_feature (923)..(923): n is a, c, g, or t
  misc_feature (1832)..(1832): n is a, c, g, or t
  misc_feature (1838)..(1838): n is a, c, g, or t
  misc_feature (1844)..(1844): n is a, c, g, or t
  misc_feature (1848)..(1848): n is a, c, g, or t
  misc_feature (1857)..(1857): n is a, c, g, or t
  misc_feature (1859)..(1859): n is a, c, g, or t
gacngngnnngnantancnntnnnnnnnnngncgatngangnnggcggcggcnaaggcgctctcntncgtncttttcntcnttgtcgccgncgcgtctcnagngnccgcggcgncgatcaccaagggcgacttccccccggggttcgtcttcggcaccggctcctccgcttaccagattgaaggtgcggttgcagaggacggaagaaaacccagcatctgggacacattcacacactcaggctactctgccgatggagccactgctgatgtgactgcagatcagtatcataagtacaaggaagatgtaaagcttttgagcgagatgggcgtcgacgcntacagattttccattgcctggcctcgccttattcctgatggccgaggagctgtcaatccaaagggactggagtactacaacaaccttatcaatgaactcctgagtcatggaattcagcctcacgtaacgatatatcatttcgacttccctcaggctcttcaagatgaataccntgggatgcttagtcgtaaattcatagatgactacacggcgtatgcagangtgtgcttcaagaactttggcgacagggtgaaatactggagcactgtgaatgagccaaacattgagccgattggcggatacgatgtaggattccttccaccacggcgatgctcattccccttcggcaccctcagttgcganaanggcaactctaccacagagccntacatagtagctcaccatcttctgcttgcacatgcctcagcagcttccctgtataaagagaagtaccaggccaagcaaggaggaaatattggactcacattgctnggntngtggnacgagcctgcganncaaacacctgaggatatagcagcagctgnaaggatgaangacttccacnttggatggtatatgcatccnttggtgcatggagattaccccccagtgatgaggaagaatgttggatccaggctaccatctttcaccaacgaagaactgaagagggtgctcggatctttcgattttgtcggatttaaccactacattgcggcatatgtgaaggctgatcttagcaagctggatgatgagctgagagattacatgggtgatgcagcagtgaaatatgacatgccatttttgaactcgaagaaccagctcctgtttgggttgaaaagcgatttcatgtcatcgacgccgtgggctctgaagaaaatgctggagcatctccagctcaaatacaagaaccctgtagtcatgatccacgagaacggtgctgctagcattgcggatccctctggcgggaacgcccccgacgacgagttcaggtcgcagtacctgcaggactacatcgaggcgacccttgagtccagcaggaacgggtccaacgtgcagggctacttcgtgtggtcgtttctggacgtgttcgagtatctgtttggctaccgcttgggcttcggcctctatggcgtcgacttcaactccgaggagaggacgaggtaccagaggcactccgccaagtggttcgccagcttcctccgtggcggcgagctcaggccggtggctctgcccggccaggcctattcgcagtgatcttggcaaactttttcaggcttctgtagactgtagcccacgaagaggaggatggacgacgaataagcctgggaggatggttgggtgctgtttttggatggaaattgaattttgcttgggcagtagggtttatacataggtctctgcttctttggattcgattgttccttatatcttataaatgtccatgctgatgtatgtgctgaaaatattaatatatgtcgacatggtctcggattnagtcantagtcnagantgaaatcananagctgaatttagatagtaaaaaaaaaa

SEQ ID NO: 5343 - DNA, 1837 bp, Triticum aestivum
aagaagagagacgccagcatcaccagcacagcaggagcgagaccgtggacggagctagcactagcaggcggggcaaccgatgatggcggcgctctcctccgtactcctcctcctgtttgtcgccgttgcgactccgaaggcggcggcgacgatcaccaggcgcgacttccccccggggttcatcttcggcaccggctcctccgcttaccagatcgaaggtgcggtcgcagaggacgggagaaaacccagcatctgggacacgttcacacactcaggccattccgtcgatggatcaaatgctgatgtgactgcagatcagtaccataagtacaaggaagatgttaagcttttgagcgacatgggcgtcgacgcctacagattttccattgcctggcctcgccttattcccgatggccgtggagctgtcaatccaaagggactggagtactacaacaatcttatcgatgaactcctggctcatggaatccagcctcacgtcacgatatatcatttcgacttccctcaggctcttcaagacgaatacaacgggatgcttagccccaaattcatagatgattacacggcgtatgcagaagtgtgcttcaagaactttggcgacagggtgaagtactggagcactgtcaatgagccaaatattgagccgattggcggatatgaccagggtatcctcccaccgcgacgatgctcattccccttcggtgccctcagttgcgataatggcaactctaccacagagccatacatagtagcacaccatcttctccttgcacatgcctcagcagcgtccctgtataaagagaagtaccaggccaagcagggaggaaatattggactcacattgctcggttggtggtacgagcctgcaacacaaacacctgaggatatagcagcagctgaaaggatgaacgactttcacatcggatggtatatgcatccgttggtgcatggagattaccccccggtgatgaagaagaatgttgggtccaggctaccatctttcaccgacgaagaactgaagagggtgctcggatctttcgattttgtcggatttaaccactacattgcggtatatgttaaggctgatcttagcaagctggatgatgagctgagagattacatgggtgatgcagccgtgaaatatgacatgccatttttgaagaagaaccagctcctgtttgggttgaaaagcgatttcatgacatcgacaccgtgggctctgaagaaaatgctggagcatctccagctcaaatacaagaaccctatagtcatgatccatgagaacggagctgctagcattgcggatccttctgccggaaacgcccccgacgacgagttcaggtcgcagtacctgcaggattacatcgaggcgaccctcgaatccagcaggaacgggtcgaacgtgcagggctacttcgtgtggtcgtttctggacgtgttcgagtatctgtttggctaccgcatgggcttcggcctctatggcgtcgacttcaactccgaggagaggacgaggtaccagaggcactccgccaagtggttcgccggcttcctccgtggcggtgagctcaggccggtggctctgcccggccaggcttattcgcagtgatttggcacgcctgaagattctgtagcccacggagaggaggatggacgacgaataagcctgggaagatggttgggtgttgtttttggatggtaattgaattttgcttgggcagtagggtttatatacaggtctctgcttctttggattcgattgttcctaaatgtatatgtctatgttgatgtatatgcgaaaatattaatatgccaatatgca

SEQ ID NO: 5344 - DNA, 1959 bp, Triticum aestivum
gaggccagagccaaagccaacaagaagaagagagaagccaccatcacctccagcctccaggagagagagagggactgcggacggagctaacactagcaggcaggcggggcgaccgatgatggcgccggcgaaggcgctctcctccgtgctcctcctcctgctcgtcgccgtcgcgactccggaggcggcggcggcgaccattaccaagcgcgacttccccccggggttcatcttcggcaccggctcctccgcttaccagatcgaaggtgcggtcgcagaggacggaagaaaacccagcatctgggacacgttcacacactcaggccattccgtcgatggatcgaatgctgatgtgactgcagatcaataccataagtacaaggaagatgtaaagcttttgagtgacatgggcgtcgacgcatacagattttccattgcttggcctcgccttattcccgatggccgtggagctgtcaatccaaagggactggagtactacaacaatcttatcgatgaactcttggctcatggaattcagcctcatgtcacgatatatcatttcgacttccctcaggctcttcaagacgaatacaacgggatgcttagtcgcaaattcatagatgactacacggcgtatgcagaagtgtgcttcaagaactttggcgaccgggtgaagtactggagcactgtcaatgagccaaacatagagccgattggcggatatgatcagggtatcctcccaccacggcgatgctcattcccattcggcgccctcagttgcgacaacggcaactctaccacagagccatacatagtagctcaccatcttctgcttgcacatgcctcagcagcgtccctgtataaagagaagtaccaggccaagcaaggaggcaaaattggactcacattgctcggttggtggtacgagcctgcgacacaaacacctgaggatatagcagcagctgaaaggatgaatgacttccatgttggatggtatatgcatccgttggtccacggagattaccccccggtgatgaggaagaatgttgggtccaggctaccatcattcaccggcgaagaactgaagagggtgctcggatctttcgattttgtcggatttaaccactacattgcggtatatgtgaaggctgatcttagcatgctggatgatgagctgagagattacatgggtgatgcagcagtgcaatatgacatgccatttttgaagaagaaccagctcctgtttgggttgaaaagcgatttcatgacatcgacaccgtgggctctgaagaaaatgctggagcatctccagctcaaatacaagaaccctatagtcatgatccatgagaacggagctgctagcattgcggatccttctgctgggaacgcccccgacgacgagttcaggtcgcagtacctgcaggattacatcgaggcgaccctcgaatccagcaggaacgggtcgaacgtgcagggctacttcgtgtggtcgtttctggacgtgttcgagtatttgttcggctaccgcatgggcttcggtctctacggcgtcgacttcaactccgaggagaggacgaggtaccagaggcactccgccaagtggttcaccagcttcctccgtggcggcgagctcaggccggtggctctgcccggccaggcctattcgcagtgatttggcacacttcaagattctgtagcccacgaagaggagaatgtacgaataagcctgggactgggaggatggtggggtgttgtttttggatggaaattgaattttgcttgggcagtagggttcatatataggtctctgcttctttggattgggttgatcctaatatatacgtatgttgtattcatgtatatgcggaaaatagtaatatgtcgatatacaagatgttggatctagtcagcagttcgagatcgaaatcacgtacctgcatttaaatagaacctgcaatg

SEQ ID NO: 5345 - DNA, 1831 bp, Triticum aestivum
gagctagcagtagcaggcggggcgatcgatgatggcggcgctctcctccctagtcctcgtccttttgctcgccgtcgcgtctcaggaggccgcggcgaccatcaccaggggcgacttccccccggggttcatcttcggcaccggctcctcctcttaccaggttgaaggtgcggtcgcagaggacggaagaaaacccagcatctgggacacgttcacacactcagggcacttcgtcgacggtgccactgctgatgtgactgcagatcagtatcacaagtacaaggaggatgtaaagcttttgagcgacatgggcgtcgacgcctacagattttcaattgcctggcctcgccttattcctgatggccgtggagctgtcaatccaaagggactggagtactacaacaatcttatcgatgaactcctggctcatggaatccagcctcacgtcacgatatatcatttcgacttccctcaggctcttcaagacgaatacgacggcatgcttagtcgcagattcatagatgactacacggcatatgcagaagtgtgcttcaagaactttggcgacagggtgaaatactggagcactgtgaatgagccaaacatcgagcccgtcggcggatatgatacgggtatcaacccaccgcggcgatgctcattccccttcggcgccctcagttgcgacaacggcaactctaccacagaaccatacatagtagctcaccatcttctccttgcacatgcctcagcagcgtctctatataaagacaagtaccaggccaagcaaggaggaaatattggactcacattgctcggttggtggtatgagcctgcgacgcaaacacctgaggatatagcagcagctgaaaggatgaacgacttccacattggatggtatatgcatccgttagtgcacggagattaccccccggtgatgaggaagaatgttgggtccaggctaccatctttcaccgacgaagaactgaagagggtgctcggatctttcgattttgtcggatttaaccactacattgcgttatatgtgaaggatgatcttagcaagctggatgatgagctgagagattacatcggtgatgcagcagtgaaatatgacatgccatttttgaacccgaagaaccagtcgtccacaccgtgggctctgaagaaaatgctggggcatctccagctcaaatacaagaaccctgtagtcatgatccatgagaacggagctgctagcatcgcggatccttctgctgggaacgcccccgacgacgagttcaggtcgcagtacctgcaggactacatcgaggcgaccctcgaatccagcaggaacgggtccaacgtgcagggctacttcgtgtggtcattcctggacatgttcgagtatatattcggctatcgcatgggttttggcctctatggtgtggacttcaactctgaggagaggacgaggtaccagaggcactccgccaagtggttcaccggcttcctccgtggcggcgacctcaggccggtggctctgcccggcaaggtctattcccagtgatcttcacacttcttcacacttccgtagcccacgaagaggaaaatgcactaataagcctggatggttaggtgttgtttttgggtggaaattgagctttgcttgggcagtagggtgtataggcctctgcttctttggattcgattcttcctaataagtactagcctatccccgcgcggtggcattgccgcgcccgtcggtatggttatatatgcattgtgtttatttttcggcaataagagtgtgactattttgaaataagagattgttatatgaaattatggatgg

SEQ ID NO: 5346 - DNA, 1861 bp, Triticum aestivum
gaagagagaagccaccatcaccagcacggcagcagagagactgtggacggagcgatcgatgatggcggccgcgaaggcgctctcctccctggtcctcgtcctgctgctcgccgtcgcgtctcaggaggcggcggcgaccatcaccaagcgcgacttccccccggggttcatcttcggcaccggctcctccgcctaccagatcgaaggcgcggtcgcggaggacgggagaaaacccagcatctgggacacgttcacacactcaggccattctgtcgatggatcaaatgctgatgtgactgcagatcagtatcataagtacaaggaagatgtaaagcttttgagcgacatgggagtcgatgcctacagattttccattgcctggcctcgccttattcccgatggccgtggagctgtcaatccaaagggactggagtactacaacaatcttatcgatcaactcctggctcatggaatccagcctcacgtcacgatatatcatttcgacttccctcaggctcttcaagacgaatacaacgggatgcttagtcgcaaattcatagatgactacacagcgtatgcagaagtgtgcttcaagaacttcggcgacagggtgaaatactggagcactgtcaatgagccaaacatcgagccgattggcgggtacgatcagggtatcctcccaccgcggcgatgctcattccccttcggcttcctcagttgcgacaacggcaactctaccacagagccatacatagtagctcaccatcttctgcttgcacatgcctcagcagcttccctgtataaagagaagtatcaggccaagcaaggaggaaatattggactcacattgctcggttggtggtacgagcctgcgacacaaacacctgaggatatagcagcagctgaaaggatgaacgactttcacattggatggtatatgcatccgttggtgcacggagattaccccccagtgatgaggaaaaatgttgggtccaggctaccatcattcaccgacgaagaactgaagaggctgctcggatctttcgattttgtcggatttaaccactacattgcggtatatgtgaaggctgatcttagcaagctggatgatgagctgagagattacatgggcgatgcagccgtgaaatatgacatgccatttttgaagaagaaccagctcctgtttgggttgaaaagcgatttcatgacatcgacaccgtgggctctgaagaaaatgctggagcatctccagctcaaatacaagaaccctatagtcatgatccatgagaacggagctgctagcattgctgatccctctgctgggaacgcccccgacgacgagttcaggtcgcagtacctgcaggattacatcgaggcgaccctcgaatccagcaggaacgggtcgaacgtgcagggctacttcgtgtggtcgtttctggacgtgttcgagtatctgtttggctaccgcatgggcttcggcctctatggcgtcgacttcaactccgaggagaggacgaggtaccagaggcactccgccaagtggttcaccggcttcctccgtggcggcgagctgaggccggtggctctccccggccaggcatattcccagtgatcttggcacacttcttcatgcttctgtagcacacggagaggaggatggacggcgaataagcctgggaagatggttgggtgttgtttttggatggtaactgaattttgcttgggcagtagggtttatatacaggtctctgcttctttgggtttgattgttcctaaatgtatatgtctgtgttgatgtgtatgcggaaaatattaatatgtcgatatacaaggtgttggatccagtcagcagttcgagatc

SEQ ID NO: 5347 - DNA, 1904 bp, Hordeum vulgare
gcaccaccggaaccggaagaaagagatatatagagagagagagcacggacggagctatcgatgatggcggcggcgaaggcgctctttcttcttctgctcgccgtggcgtctccggctgcggcggcgatcaccaagcgcgacttccccccggggttcatcttcggcaccggctcctccgcttaccagattgaaggtgcggttgcagaggacggaagaaaacccagcatctgggacacgttcacccactcaggctactctgtcgatggatcgaatgccgatgtgactgcagatcagtatcacaagtacaaggaagatgtaaagcttttgagcgacatgggcgtcgatgcgtacagattctccattgcctggcctcgccttattcccgatggccgaggagctgtcaatccaaaggggctggagtactacaacaaccttatcgatgaactcctggctcatggaatccagcctcacgtcacgatatatcatttcgacttccctcaggctcttcaagacgaatacaacgggatgcttagtcgcaaattcgtagatgactacacggcgtatgcagaagtgtgcttcaagaactttggcgatagggtgaagtactggagcactgtcaatgagccaaacattgagccgattggcggatatgatcagggtatcctcccaccgcggcgatgctcattccccttcggcgtcctcagttgcgacaacggcaactctaccacagagccctacattgtagctcaccatcttctgcttgcacatgcctcagcagcgtccctgtataaagagaagtaccaggccaagcaaggaggaaatattgggctcacattgctcggttggtggtacgagcctgcgacacaaacacctgatgatatagcagcagctgaaaggatgaacgactttcacattggatggtatatgcatccgttggtgcacggagattacccgccggtgatgaggaagaatgttgggtccaggctaccatctttcactgacgaagaactgaagacggtgcttggatcttttgattttgtcggatttaaccactacattgcggtatatgtgaaggctgatcttagcaagctgaacgatgagctgagagattacatgggtgatgcagcagtgaaatatgacatgccatttttgaactcgaagaaccagctcctgtttgggttgaaaaaagatttcacgccatcgacaccatgggctctgaacaaaatgctggggcatctgcagctcaaatacaagaaccctgttgtgatgatccacgagaacggagctgctagcattgcggatccttctgccgggaacgcccccgacgacgagttcaggtcgcagtacctgcaggactacatcgaggcgaccctcgaatccagcaggaacgggtccaacgtgcgaggctacttcgtgtggtcgtttctggacgtgttcgagtatctgtttggctaccgcatgggcttcggcctctatggcgtcgacttcaactccgaggagaggacgaggtaccagaggcactccgccaagtggttcaccagcttcctccgtggcggcgagctcaggccggtggctctgcctgggaacgcctactcccagtgatcttggttattgtcacacttcttcacgcttcccacgaagaggagaatgcacgaataagcctgggaggatgcttattgttttggatgaaaaattgaattttgcgtgagcagtagggtttatatataggtctctgcttctttggattggattgatcctaatatatatgtctatgttgatgtgtatgtttttttttttttggaaaagggggagtgacccccggcctctgcatcaatcgatgcatgcagccattgatcctaatatatatgtctatgttgatgtgtatgttgaaaatattaatatgt

SEQ ID NO: 5348 - DNA, 1975 bp, Hordeum vulgare
attcggcacgaggcaccaccggaaccggaagaaagagatatatagagagagagagcacggacggagctatcgatgatggcggcggcgaaggcgctctttcttcttctgctcgccgtggcgtctccggctgcggcggcgatcaccaagcgcgacttccccccggggttcatcttcggcaccggctcctccgcttaccagattgaaggtgcggttgcagaggacggaagaaaacccagcatctgggacacgttcacccactcaggctactctgtcgatggatcgaatgccgatgtgactgcagatcagtatcacaagtacaaggaagatgtaaagcttttgagcgacatgggcgtcgatgcgtacagattctccattgcctggcctcgccttattcccgatggccgaggagctgtcaatccaaaggggctggagtactacaacaaccttatcgatgaactcctggctcatggaatccagcctcacgtcacgatatatcatttcgacttccctcaggctcttcaagacgaatacaacgggatgcttagtcgcaaattcgtagatgactacacggcgtatgcagaagtgtgcttcaagaactttggcgatagggtgaagtactggagcactgtcaatgagccaaacattgagccgattggcggatatgatcagggtatcctcccaccgcggcgatgctcattccccttcggcgtcctcagttgcgacaacggcaactctaccacagagccctacattgtagctcaccatcttctgcttgcacatgcctcagcagcgtccctgtataaagagaagtaccaggccaagcaaggaggaaatattgggctcacattgctcggttggtggtacgagcctgcgacacaaacacctgatgatatagcagcagctgaaaggatgaacgactttcacattggatggtatatgcatccgttggtgcacggagattacccgccggtgatgaggaagaatgttgggtccaggctaccatctttcactgacgaagaactgaagacggtgcttggatcttttgattttgtcggatttaaccactacattgcggtatatgtgaaggctgatcttagcaagctgaacgatgagctgagagattacatgggtgatgcagcagtgaaatatgacatgccatttttgaactcgaagaaccagctcctgtttgggttgaaaaaagatttcacgccatcgacaccatgggctctgaacaaaatgctggggcatctgcagctcaaatacaagaaccctgttgtgatgatccacgagaacggagctgctagcattgcggatccttctgccgggaacgcccccgacgacgagttcaggtcgcagtacctgcaggactacatcgaggcgaccctcgaatccagcaggaacgggtccaacgtgcgaggctacttcgtgtggtcgtttctggacgtgttcgagtatctgtttggctaccgcatgggcttcggcctctatggcgtcgacttcaactccgaggagaggacgaggtaccagaggcactccgccaagtggttcaccagcttcctccgtggcggcgagctcaggccggtggctctgcctgggaacgcctactcccagtgatcttgagttattgtcacacttcttcacgcttcccacgaagaggagaatgcacgaataagcctgggaggatgcttattgttttggatgaaaaattgaattttgcgtgagcagtagggtttatatataggtctctgcttctttggattggattgatcctaatatatatgtctatgttgatgtgtatgttttttttttttttggaaaagggggagtgacccccggcctctgcatcaatcgatgcatgcagccattgatcctaatatatatgtctatgttgatgtgtatgttgaaaatattaatatgttgatatgaaaagtgttgggtttgggattgcaaaaaacaaaacaaactcaaaaaactt

SEQ ID NO: 5349 - DNA, 1652 bp, Brachypodium distachyon
gtttacagtcggagtcaaacaacgaaaacacatcgatcaatcgatccagctagctagctgctgctgggctgggctgggctgggctgttcgtcagccggccggtgcgcgacaaggcgcagccgcagcagaccgccgccacgatcgatggcgcagaccgccgccgcctttgtgttcctcctccttgccgccgctgcgtcggcggcggccgggaagatcaccaaggacgacttcccgccggggttcgtcttcggcaccggctcctccgcttaccagattgaaggtgcggttgcagaggatggaagaaaacctagtatctgggacacgttcacacactcaggctactctatcgatggagcgaccgctgatgtaactgcaaatcagtatcataagtacaaggaagatgtaaagcttttgagcgagatgggcgtcgatgcgtacagattttcgatcgcctggcctcggcttattcctgatggtcgaggagctgtcaaccccaagggactggagtactacaacaatctaattgatgagctcctgagctatggaattcagcctcatgtaacgatatatcactttgacttccctcaggctcttcaagacgagtacaaagggatgcttagtcgtagattcatagaagactacacagcgtatgcagaggtgtgcttcaagaactttggcgatagagtgaagtactggagcactgtcaatgagccgaacgtcgagccgattggcggatacgatcagggaatactcccaccacggcgatgctcattcccctttggtaccctcagttgcgaccaaggcaactctaccacagaaccatacatcgtagcacaccatcttctgcttgcacatgcctcagcagcgtccctgtataaagagaagtaccaggccaagcaaggaggacatattggactcacattgcttggctggtggtacgagcctgcgacgcagacacccgaggatatagcggcagctggaaggatgaatgatttccacattggatggtatatgcatccattggtgcatggagattatcccccagtgatgaggaagaatgttgggtccaggctaccatcgttcacagctgaagagctaaagagagtgcacggttcattcgacttcgtcggtttcaaccactacatcgctatatatgtgaaggctgatcttagcaagctggatcagccattgagagattatatgggagatgcagccgtggcatatgacagtaaagatgacatcatgacgtcgacgccatgggctctgaagaaaatgctggggcatctgcagttgaaatacaagaacccggtggtcatgatccacgagaacggagctgcgagcatgcctgacccctcgggcgggaacacctacgacgacgagttcaggtcgcagtacctgcaggactacatcgaagccgcgcttgaatccatcagggacgggtcgaacttgcagggctacttcgtgtggtcgttcctggacgtgttcgagtacctcttcggctaccgtatgggcttcggcctctacggcgtcgacttcggctccgaggcgaggacgaggtaccagaggcactccgccaagtggttcgccagcttcctccgcggcggcgagctcaggccggtggcgctgcccggcaaggcctactcccagtgatt

SEQ ID NO: 5350 - DNA, 1377 bp, Oryza sativa
gtcatcattgccgatccgcttccagaagcagcggcaagtttccatctccttcttccccttggctttttatcgctcgatcaggtggcagcgacaacgagagggagagcgagagctaagttcgccggagaagatggcgatgcggcggtggagagaggatgcggtggcgctgtcgctgcgcgggtgcggattcggcgacggggacgacgaccggccggagaagccgcggcggtacggggtgacggagatgaggagccccttctacgccttccgccccgcccaccacgcgctccaggaaatattggattctctaggtccttttgttgatggtttgaagtttactggtggatctcatagtttgatgggaaaagaactggttagagagattactgatttagcacacaagcatgacatatatgtgagtacaggagattgggcagagcatcttctgcgtcaaggaccttcttttttcaagcaatatgtcgaggagtgcaaggcattaggatttgacaccatcgagctgaatgctggatctctcaagctcccggaagaagctctcctgagattagtccgcctcatcaagactagtggtttgcaagcaaagcccctgttttcagtgaagtttgacagttctgatattcctccatctggagatagggcatttggggcatacatagttccagtgaagcagaattcagaaagagtcgaggatgttgacctgttgataaggagggccgagaggtgcttggaagcaggggcagacatgatcatgatcgatgccgacgacatttgccagcgcgctgactctctacgggcagacatcgtcgccaagattgtaggccggctcgggctcgagaagaccatgttcgaggcttccaaccccaacacctccgagtggttcgtcagaagatacgggccacgggtgaatctgttcgtggatcactccgacgtgatgaacctggagcgtctccgaggcttcaacatgcgtggagtctgcaactctcccttattcggaatcggctcgcccttcttcctgatgtgacgacctccctgaatcctcctgatgtatacgaccttcctgaatcgtgccagtcctatctcgcatggaatgctgtgttcgtggtgttgagatgccttcctgcaataactggatctggatgatgtgtagtatgaaaaaaatgtactcctgtctgctagcagtatcagctcatgtatcgtatgtactcttcattctctactcctgcccggaaacttattactccttgtcacagtttatagggtgttcttttacaagaaaaaaataactcggtaaatgtttgactaataacaattgcccctaatcgtcgtattaacagtgctaaatattatacacgttatctt

SEQ ID NO: 5351 - DNA, 964 bp, Triticum aestivum
tcgacccacgcgtccgcggacgcgtgggtcgacagacagatagctctgcctctgcaacgactaccaaagaaatcgatcgatccaatccaagccagccatgatgaggtcctgcctccccctcgccctcctggtcgccctgagcgccgtcgggtgcgccgcggcgcaggcggcggactacgacttcttctacctcgtgctgcagtggccggggtcgtactgcgacacgaagcagagctgctgctacccgcggtcggggaagccggcggcggacttcgggatccacgggctctggcccaaccgcgacgacggaacctacccgcagaactgcaaccccgccaacgccttcgatccctccaaggtgagcgacctcctgagcaccctgcgcagggagtggccgacgctggcgtgcccgacgagcgacgggctccagttctgggcgcacgagtgggagaagcacggcacctgcgcgcagaacctattcaacgagcacggctactttcagacggcgctccacctccgcgaccagctccgcgtcctcgacgccctcacctccgccggcgtctcccccgacggcggctactacacgctgagcgccatcaagggcgccatccagcaggggaccgggttcgagcccttcgtggagtgcaaccgcgacgagtccggcaacagccagctctaccagctctacttctgcgtggacgccaacgcctccggcttcgtcgagtgccccgtccagcccggcggcaggccctgcggcaacaggatcgaattccccaccttctgatgcgcccatttcctttttttcccctaattcattcactccctgcgttattatttagcgaagttcaagggctcgtgatgttaatgaagacaatgtatatcttgaaatggtgtaaacctgtggagggagccgattgctatttcatattcagataacaaggagcaatactttttttctttcttc

SEQ ID NO: 5352 - DNA, 872 bp, Triticum aestivum
agatagctctgtagcgagtcccaaagagatcgatccaagcaagccatgatgagatcctgcctctccctcgccctcctcgtcgccctgagcgccgccgggtgcgccgcggcgcaggcggcggactacgacttcttctacctcgtgctgcagtggccggggtcgtactgcgacacgaagcagagctgctgctacccgcggtcggggaagccggcggcggacttcgggatccacggcctctggcccaaccgcgacgacggctcctacccgcagaactgcaaccccgccaacgccttcgatccctctaaggtgagcgacctgctgagcagcctgcgcacggagtggccgacgctggcgtgcccgacgagcgacggcctccagttctgggcgcacgagtgggagaagcacggcacctgcgcgcagaacctcttcaacgagcacggctacttccagacggcgctccacctccgcgaccagctccgcgtcctcgacgccctcaccgccgcgggcgtctcccccgacggcggctactacacgctgagcgccatcaagggcgccatccagcaggggaccgggttcgagcccttcgttgagtgcaaccgcgacgagtccggcaacagccagctctaccagctctacttctgcgtcgacgccaacgcctcgggcttcgtcgagtgccccgtccagcccggcggcaggccctgcggcaacagggtcgagttcccgaccttctgatgcgcccatttccttttcccttcaaagttcaaaggctcgtgatgttaatgaagacaaaatgtatatcttgaaatggtgtaaacatgtggagggagccgattgttatttcatattcagataaacaaggagcaatactctct

SEQ ID NO: 5353 - DNA, 1040 bp, Triticum aestivum
  misc_feature (1027)..(1027): n is a, c, g, or t
tttttggggaccgttatggacaagttgttccaaaaaacaggcgggaccgtccggaattcccgggaattggtgacccacgcgtccgggattggagccggagaacctgacatgggttaaagggtagcaaaacctccagccgagatagatagctctgcagcgagtgccgaagagatcgatccaagcaagccatgatgagatcctgcctccccctcgccctcctggtcgccctgagcgccgccgggtgcgccgcggcgcaggcggcggactacgacttcttctacctcgtgctgcagtggccggggtcgtactgcgacacgaagcagagctgctgctacccgcggtcggggaagccggcggcggacttcgggatccacggcctctggcccaaccgcgacgacggctcctacccgcagaactgcaaccccgccaacgccttcgatccctccaaggtgagcgacctgctgagcagcctgcgcagggagtggccgacgctggcgtgcccgacgagcgacgggctccagttctgggcgcacgagtgggagaagcacggcacctgcgcgcagaacctcttcaacgagcacggctacttccagacggcgctccacctccgcgaccagctccgcgtcctcgacgccctcacctccgccggcgtctccccggacggcggctactacacgctgagcgccatcaagggcgccatccagcaggggaccgggttcgagcccttcgtggagtgcaaccgcgacgagtccggcaacagccagctctaccagctctacttctgcgtcgacgccaacgcctccggcttcgtcgagtgccccgtccagcccggcggcaggccctgcggcaacagggtcgagttcccgaccttctgatgcgcccatttcctttttccctaattcattcactccctgcgttattatttagcatagttcaagggctcgtgatgttaatgaagacaatgtatatcttgaaattgtgtaaaaatgtggagggagccggttgctatttcatattcagataaacnaaggagcaatact

SEQ ID NO: 5354 - DNA, 905 bp, Leymus cinereus x Leymus triticoides
  misc_feature (5)..(6): n is a, c, g, or t
  misc_feature (94)..(94): n is a, c, g, or t
  misc_feature (107)..(107): n is a, c, g, or t
  misc_feature (369)..(369): n is a, c, g, or t
  misc_feature (420)..(420): n is a, c, g, or t
  misc_feature (499)..(499): n is a, c, g, or t
  misc_feature (504)..(504): n is a, c, g, or t
  misc_feature (519)..(519): n is a, c, g, or t
  misc_feature (528)..(528): n is a, c, g, or t
  misc_feature (555)..(555): n is a, c, g, or t
  misc_feature (578)..(578): n is a, c, g, or t
  misc_feature (589)..(589): n is a, c, g, or t
gatanntctgcagcgagcaccaaagagatcgatcgatccaagcaagccatgatgaggtcctgcttctccctggccctcctggtcgccctgagcnccgtcgggtgcgncgcggcgcaggcggcggactacgacttcttctacctcgtgctgcagtggccggggtcgtactgcgacacgaagcagagctgctgctacccgcggtcggggaagccggcggcggacttcgggatccacgggctctggcccaaccgcgacgacggctcctacccgcagaactgcaaccccgccaacgccttcgacccctccaaggtgagcgacctcctgagcagcctgcgaacggaatggccgacgctggcgtgcccgacgagngacgggctccagttctgggcgcacgagtgggagaagcacggcacctgcgcncagaacctcttcaacgagcacggctacttccagacggcgctccgcctccgcgaccagctccgcgtcctcgacgccctcncctcngcgggcgtctccccngacggcggntactacactctgagcgcgatcaagggngcgatccagcaggggacggggtncgagccgtacntggagtgcaaccgcgacgagtccggcaacagccagctctaccagctctacttctgcgtcgacgccggcgcctccggctttgtcgagtgccccgtccagcccggcggcaggccctgcggcaacaggatcgagttcccggctttctgatgcgccgatttccttttcccttcactccctgcattatttaacaaagttcaagggctcgtgatgttaatgaagacactgtatatcatgaaatggtgtaaacatgtggagggagccgattgctatttcatattcagataacaaggagcaatactttttttgtcgtaaaaaaa

SEQ ID NO: 5355 - DNA, 994 bp, Avena sativa
gataaattcacacgcttcctcaatccatcaccaccctcacctcaacacaccagcaaattcagaacagagcagggctccaagaaccccatcggaaggaggtcgttacaaagagagagccaagccatgaggacgcacctctccctggctttcctgctcgtgctggccgccgggtgcgcggcgtcggcggcggcgcaggactacgacttcttctacctcgtgctgcagtggccggggtcgtactgcgacacgaagcagagctgctgctacccgcggtccggcaagccggcggcggacttcgggatccacgggctgtggcccaaccgcgacgacggatcctacccgcagaactgcaaccccaacagcgccttcgacccttccaaggtgagcgacctgctgagcagcctccgcagcaactggccgacgctggcgtgcccgaccagcgacggcctcaagttctgggcgcacgagtgggagaagcacggcacctgcgcccagaacctcttcaacgagcacggctacttccagaccgcgctcagcctccgcgacgagctcaaggtcctcgacgccctcgccgccgcgggcatctcccccgacggcggatactacacgcaggccgccatcaagagcgccatccagcaggggacgggctacgcgccctacgtcgactgcaaccgcgacgagtccggcaacacccagctctatcagctctacttctgtgtcaccgccgatgcctcgggcttcgtcgagtgccctgtcagccccggcggcaggccatgcggcaacagggtcgagttcccggccttctgatccatccaaacaccctaccacgagtcgtcgtatcatgtcttcctgataggctgatacatacatagctgctattcatttggtcctcattgcttgcccttgacagaataaacccaaggagcatgttcgatcatgtgctgattttcccttaattctactctacgagcgatttataaaagtttaagatccc

SEQ ID NO: 5356 - DNA, 1076 bp, Triticum aestivum
acgcagcctataaatccgcaacaccaacagaggcttctatctcatctcatctccgaagaaccatcagtccgagatagctctacaaccagcaaagccatccaaagtcatgaggttgcagtgctccctggtcctcctgatcgccctgagcgtcggctgcgcggcagcgcaggagagcgggaaacaggcgggctacgatttcttctacctcgtgctgcagtggccgggttcgtactgcgacacgaagcagagctgctgctacccgcggtcaggcaaaccggcggcggacttcgggatccacgggctgtggcccaaccgcgacgatgggtcctacccgcagaactgcaaccccgacagcgccttcgacccctccaaggtgagcgacatcctgagcagcctgcgcagcagctggccgacgctggcgtgcccgaccaacgacggcctccgcttctgggcgcacgagtgggagaagcacggcacctgcgcgcagaacctcttcaacgagcacggctacttccaggccgccctccgcctgcgcggccagctccgcgtcctcgacgccctcgccaccgcgggcatctcccccgacggcgggtactacacgatgggggccatcaagggcgccatccaggaggggaccgggttcgcgcctcacgtcgactgcaaccgcgacgagtccggcaacagccagctcttccagctctacttctgcgtccacgccgacgcctcgcgcttcgtcgagtgccccgtccagcccggcggcaggccctgtggcaacaggatcgagttcccggctttctgatcattatctcctccaacccaaggagtcatcatgtgttccttaatttgcctcccgattcctagatattcatttggttttcatttcttgccgctggcagaataaacgtgtgctcgttttctttctttttcccattaactttcatgtcaatgacctgatctcaggcagcaattgaagttacgacgagcactgttcagtggccactaaacaaactaaagtattaaactcataatactagtatttgccatccgtgaagctggtggttcccaggttcaaaacc

SEQ ID NO: 5357 - DNA, 970 bp, Brachypodium distachyon
cgccgttgccattgtacatgcacatcaatgatccgggatccacacctgcctaagaagaatgcctataaattcacagccccgatagcctgcaatcctcatcaccatcgacgactcccacccatctcatctccaagaataaacacatccaatagagaatcgaccgagatagctcctggagccatgagggcgcacctctccctggccgtccttctcgtcctgaccatcgggtgcgcggcgccggcgttggcggcggcgcaggactacgacttcttcttcctcgtgctgcagtggccggggtcgtactgcgacacgaagaagagctgctgctacccgaagtcggggaagccggcggcggacttcgggatccacgggctgtggcccaaccgcgatgatggaacctacccgcaggactgcaaccccgacaacgcgttcgacccctccaaggtgagcgacctgctgggcagcatgcgcaagaactggccgacgctggcgtgcccgaccaacgacggcgtccgcttctggggccacgagtgggagaagcacggcacctgcgccgagaacctcttcgacgagcacggctacttcagcaccgcgctccgcctccgggaccagctccgggtcctcgacgcgctccgctccggcggcatcagcccggacggcggctactacacgctgagcgccatcaagggcgccatccagcaagggacggggttcgagcccttcgtggagtgcaaccgcgatgagtccggcaactcgcagctctaccagctctacttctgcgtcgacgccggcgcgacgaagttcgtcgagtgccccgtgtcgcccggcggccgcccctgcggcaacaggatcgagttcccggcattctgactgatgatttctggtggttgatcatatatggctattcttcatttggtctttgatgatttcttcagacttgacagaataaactcaaggatgttcgatcatg

SEQ ID NO: 5358 - DNA, 870 bp, Brachypodium distachyon
cgccgttgccattgtacatgcacatcaatgatccgggatccacacctgcctaagaagaatgcctataaattcacagccccgatagcctgcaatcctcatcaccatcgacgactcccacccatctcatctccaagaataaacacatccaatagagaatcgaccgagatagctcctggagccatgagggcgcacctctccctggccgtccttctcgtcctgaccatcgggtgcgcggcgccggcgttggcggcggcgcaggactacgacttcttcttcctcgtgctgcagtggccggggtcgtactgcgacacgaagaagagctgctgctacccgaagtcggggaagccggcggcggacttcgggatccacgggctgtggcccaaccgcgatgatggaacctacccgcaggactgcaaccccgacaacgcgttcgacccctccaaggtgagcgacctgctgggcagcatgcgcaagaactggccgacgctggcgtgcccgaccaacgacggcgtccgcttctggggccacgagtgggagaagcacggcacctgcgccgagaacctcttcgacgagcacggctacttcagcaccgcgctccgcctccgggaccagctccgggtcctcgacgcgctccgctccggcggcatcagcccggacggcggctactacacgctgagcgccatcaagggcgccatccagcaagggacggggttcgagcccttcgtggagtgcaaccgcgatgagtccggcaactcgcagctctaccagctctacttctgcgtcgacgccggcgcgacgaagttcgtcgagtgccccgtgtcgcccggcggccgcccctgcggcaacaggatcgagttcccggcattctga

SEQ ID NO: 5359 - DNA, 1138 bp, Sorghum bicolor
atgttcctttttctgagcataagtttattgtgtaactccttcggaaacacagttaatgaccatatgagatcaactttgagttttgataacaagcaatctccatttgcaagtcaaaacattgactacggtcaaacaatagcttgcatttcatacccgtacaatcattctggctcaggaggtgtttgggcagcctatgagtcaggcaccactgctaccactgtgttccattcccaaatttctggtggaggtgcaagaattcccttacctttggaattagcagagaatgaacccatatacgtgaatcccaaacaatatcatggtatacttcgcagaagacagttacgtgccaagttagaggctcagaacaagctagtcaaagcccgaaagccttaccttcatgagtcaaggcatcttcatgcaatgaagagggcacgaggttccggtggacgattcctcaacactaagcagttccagcagcaacagcagtcccacactgcctccaccaggtccaccacaaatggcacaagctcctcaggctcaactcatctacggcttggtggtggcgcagctggagatcgatctatgttggcacccaaaacaatggcctcacaagacagtagcaagaaggctgtttcttcagctcttgccttcactgtgactccaatgttgcacagagatgatgccttcttgcagcacccaagccattatctcagtttttctggccatttcgggcaggcaagcgtgcaagctgggatgcataatggaagtcagcatagggttccatttatgagatgacagtttgcgaaccatagctggtgatccatgcttctatggtcctagtgtccggtgtggtctcagtctctcaggcaattcatccttggcttagtttatggcttgttattagaaggtaccaaatgttttttcatactgttgtcgccatacaacccatagacctggttttgttggttgacactcctacccaaaatattgttgcagtggtgtgtgttagaataaaccttagcttttgggttatagtagtagtacattatgctgtacaatttgcctttatcgtgtactgccaaatattgtggagtggtcagtttgtccagtttatggcctcaacaagtctacctgtttg

SEQ ID NO: 5360 - DNA, 1684 bp, Saccharum officinarum
tgagttaccgggtccacccacgcgtccgtctcctcttcctaccattagcagcagcagcagggagagacgagagagagactgcgtcgactagcagagcagccggcagcgattgagcgagggaggaacacgatgagcggcggcggtcaggatctgcagctgccgccggggttccggttccacccgacggacgaggagctggtgatgcactacctctgccgccgctgcgccagcctgcccatcgccgtccccatcatcgccgagatcgacctctacaagttcgatccatggcagctccccaggatggcgctgtacggcgagaaggagtggtacttcttctccccgcgggaccgcaagtacccgaacgggtccaggcccaaccgcgccgccgggtccggctactggaaggccaccggcgccgacaagcccgtgggcacgcccaagccgctcgccatcaagaaggcgctcgtcttctacgccggcaaggcgcccaagggcgagaagaccaactggatcatgcacgagtaccgcctcgccgacgtcgaccgctccgcccgcaagaagaacagcctcaggttggatgactgggtcctgtgccgcatctacaacaagaagggagggctggagaagccggcggcggcgtcctccggcgaccacaagccaatggtgttcgccgcgggcgcggtgagctccccgccggagcagaagccgttcgtggcgacgccgggcgggctgccccccgccgcgttcacggcggacctggcggcgtactacgaccggccgtcggactcgatgccgcggctgcacgcggactccagctgctcggagcaggtgctgtcgccggagcagctggcgtgcgaccgggaggtgcagagccagcccaagatcagcgagtgggagcgcaccttcgcctccgaccccgtcaaccccgctggctccatgctcgtcgaccccgtcgtcggtggccacgccggcgacccgctgctgcaggacatcctcatgtactggggcaagccgttctagaagacgacgctcatcgtcaatcaagggggaattaaaaaaaaggcgaagcatggatgcaaacacccatcctcggctgcggttggttggttggtctgtcttgggcagcgcaatgcatgcaaccgcgcggtgtgggcttgactcaggcgagccgccattgttgacttgtaaggaggagataggttatgaaactatagctggattggataagactgagaggcggcaatgagaccgtgtggccccgccggtagggagcgagacggatggcacagtgcattgggtatttggtggtcgatcgtgcgcggcatgtgtgtgttctgtacatatacatacagtacaggattggttcagtgcatgttccttcattggttagttatagtagcagcaatttttaaagggcttgtagttgcaatctccaatgggggtaggtagtgcaggccatatatactccgttcatcatcgtcaagcttcgagtagtacagtatatatattgtagctgttggctctttgaattggaaaaatcaaaaagaaaaaaagggaaattatgctattttggtcgccgcccgggttccctgtcgcgctttggatcgccccatgtgtgccggtcgtaaaaaagagggaaagccatcgttaggtagccgggcttccgggccccttcatataaaat

SEQ ID NO: 5361 - DNA, 1577 bp, Saccharum officinarum
  misc_feature (1541)..(1541): n is a, c, g, or t
atgttaatgcatgcacgctccggtcctgaattcccgggctaccattagcagcagcagcagggagagacgagagagagactgcgtcgactagcagagcagccggcagcgattgagcgagggaggaacacgatgagcggcggcggtcaggatctgcagctgccgccggggttccggttccacccgacggacgaggagctggtgatgcactacctctgccgccgctgcgccagcctgcccatcgccgtccccatcatcgccgagatcgacctctacaagttcgatccatggcagctccccaggatggcgctgtacggcgagaaggagtggtacttcttctccccgcgggaccgcaagtacccgaacgggtccaggcccaaccgcgccgccgggtccggctactggaaggccaccggcgccgacaagcccgtgggcacgcccaagccgctcgccatcaagaaggcgctcgtcttctacgccggcaaggcgcccaagggcgagaagaccaactggatcatgcacgagtaccgcctcgccgacgtcgaccgctccgcccgcaagaagaacagcctcaggttggatgactgggtcctgtgccgcatctacaacaagaagggagggctggagaagccggcggcggcgtcctccggcgaccacaagccaatggtgttcgccgcgggcgcggtgagctccccgccggagcagaagccgttcgtggcgacgccgggcgggctgccccccgccgcgttcacggcggacctggcggcgtactacgaccggccgtcggactcgatgccgcggctgcacgcggactccagctgctcggagcaggtgctgtcgccggagcagctggcgtgcgaccgggaggtgcagagccagcccaagatcagcgagtgggagcgcaccttcgcctccgaccccgtcaaccccgctggctccatgctcgtcgaccccgtcgtcggtggccacgccggcgacccgctgctgcaggacatcctcatgtactggggcaagccgttctagaagacgacgctcatcgtcaatcaagggggaattaaaaaaaaggcgaagcatggatgcaaacacccatcctcggctgcggttggttggttggtctgtcttgggcagcgcaatgcatgcaaccgcgcggtgtgggcttgactcaggcgagccgccattgttgacttgtaaggaggagataggttatgaaactatagctggattggataagactgagaggcggcaatgagaccgtgtggccccgccggtagggagcgagacggatggcacagtgcattgggtatttggtggtcgatcgtgcgcggcatgtgtgtgttctgtacatatacatacagtacaggattggttcagtgcatgttccttcattggttagttatagtagcagcaatttttaaagggcttgtagttgcaatctccaatgggggtaggtagtgcaggccatatatactccgttcgtcatcgtcaagcttcgagtagtacagtatatatattgtagctgttggctctttgaattgaaaaaatcnaaaaggaaaaaaaaagggaaattatgctattttggt

SEQ ID NO: 5362 - DNA, 1475 bp, Zea mays
tttcaagctctcctcccctcttcctaccattagcagtagccacagccagaacaccagcagacagcagcatcagcagggaggaacacgatgagcggcgccggtccggatctgcagctgccaccggggttccggttccacccgacggacgaggagctggtgatgcactacctctgccgccgctgcgccggcctgcccatcgccgtccccatcatcgccgagatcgacctctacaagttcgacccatggcagctcccaaggatggcgctgtacggcgagaaggagtggtacttcttctccccgcgggaccgcaagtacccgaacgggtccaggcccaaccgcgccgccggggctgggtactggaaggccaccggcgctgacaagcccgtgggcacgcccaagccgctggccatcaagaaggcgctcgtcttctacgccggcaaggcgcccaagggcgagaagaccaactggatcatgcacgagtaccgcctcgccgacgtcgaccgctcggcgcgcaagaagaacagcctcaggttggatgactgggtcctgtgccgcatctacaacaagaagggcggcgggctggagaaggcggcggcgccggcggccggcggcgaccacaagcctgtgttcgccacggcggcggtgagctccccgccggagcagaagccgttcgtggcggcggcgggcgggctgcccccggcgttcccggagctggcggcgtactacgaccggccgtcggactcgatgccgcggctgcacgcggactactccagctgctcggagcaggtgctgtccccggagcagctggcgtgcgaccgggaggtgcagagccagcccaagatcagcgagtgggagcggaccttcgcctccgaccccgtgaaccccgcgggctccatgctcgaccccgtcgtcggccacgccggcggcgacccgctgctgcaggacatcctcatgtactggggcaagccgttctagacgacaccgcccatcatgtcctgaggggaggtgggggtggcgaagcatcctcggctgcggttggttggttgattgatctgtcttgggcagcgcaatgcaatgcaaccgcacggtgtgggctttgactcaggcgagccgccattgttgacttgcaaggaggatataatatgaaactatagctggattacatggagaggcggcaatgagaccgtctggccccgccggaagggagacggagacggagacggatggcgcagtgcatcgggtgtggtggatcgtgcgcggcatgtgtgtgtgtggctgtacatatacatactgtacatgattggttcagtgcagggtttctgttccttcattgattagttattatactaataagtactagtaattttgtaagggcttgtagttgcagtctccgtactggtggtaggtagtgcaggccatattcgtcatcgccaagcttcgagtgtacttactcctacaatatatattttacagta

SEQ ID NO: 5363 - DNA, 1591 bp, Oryza sativa
gtcgcttgcccccggctctataaatgcccggctcctcacccggaacaagtttcaagccctcctctcctcttcccaacactagtaggataaagccacagagagagcagtagtagtagcgagctcgccggagaacggacgatcaccggagaagggggagagagatgagcggcggtcaggacctgcagctgccgccggggttccggttccacccgacggacgaggagctggtgatgcactacctctgccgccgctgcgccggcctccccatcgccgtccccatcatcgccgagatcgacctctacaagttcgatccatggcagcttccccggatggcgctgtacggagagaaggagtggtacttcttctccccgcgagaccgcaagtacccgaacgggtcgcggccgaaccgcgccgccgggtcggggtactggaaggcgaccggcgccgacaagccggtgggctcgccgaagccggtggcgatcaagaaggccctcgtcttctacgccggcaaggcgcccaagggcgagaagaccaactggatcatgcacgagtaccgcctcgccgacgtcgaccgctccgcccgcaagaagaacagcctcaggttggatgattgggtgctgtgccggatttacaacaagaagggcgggctggagaagccgccggccgcggcggtggcggcggcggggatggtgagcagcggcggcggcgtccagaggaagccgatggtgggggtgaacgcggcggtgagctccccgccggagcagaagccggtggtggcggggccggcgttcccggacctggcggcgtactacgaccggccgtcggactcgatgccgcggctgcacgccgactcgagctgctcggagcaggtgctgtcgccggagttcgcgtgcgaggtgcagagccagcccaagatcagcgagtgggagcgcaccttcgccaccgtcgggcccatcaaccccgccgcctccatcctcgaccccgccggctccggcggcctcggcggcctcggcggcggcggcagcgaccccctcctccaggacatcctcatgtactggggcaagccattctagacgaccaaaaaaaaaaaaaaacaaccgcattggcagcaatggtgtcactgaacaccgtgcaggctagctagcttcatggccggtgaactttgactcaggcgagccgccggagttgactcaaagataattaaaagaagtgttttaagtggattggattggattagacagaggagatgaggactcgagaaaggcggcgatgagaccgtggttggggggaccctggcctggactgaacgacgacgaggcagcagcagaaagatggtgcaattgcatcgggtggcatgtcagtgtgtgtgtatagtggcatgtacatagtacatggtgattgattcggtatacagggggctagctttcctgtttctgtttcttcattggttaattattactcccattataaggtcttcttcagggttgctagcttaattaattaattaattagcccagtggttgaagtgtaagtcaaaattcatcaagtcagagactggaataatacaatacagtactgtagatatcttttt

SEQ ID NO: 5364 - DNA, 1593 bp, Triticum aestivum
gacccacgcttccgcccacttagagcagcagcagaagagaaggaaaattcagtagcagtagaactcagagcagcggcagcagaactgcggcgagctgatccagcgagagaactacagcgaggtttgttggatcgccgacccgaccggagatgagcggcggacaggagctgaatctgccgccgggcttccggttccacccgacggacgaggagctggtgacgcactacctctgccgccgctgcgccggcgcgcccatcgccgtccccatcatcaccgagatcgacctctacaagttcgacccctggcagctcccaaagatggcgctgtacggcgagaaggagtggtacttcttctccccgcgggaccgcaagtaccccaacgggtccaggcccaacagggccgccgggtcagggtactggaaggcgacgggggccgacaagcccgtgggcacccccaagccgctggccatcaagaaggcgctcgtcttctacgccggcaaggcccccaagggcgagaagaccaactggatcatgcacgagtaccgcctcgccgacgtcgaccgatccgcccgcaagaagaacagcctcaggttggatgactgggtgctgtgccgcatctacaacaagaagggcggcttggagaagccggcgtccgtggaccgcaagccggcggccatgggcggctacgggggtcctcctggggccatggtgagctccccgcaggagcagaagcccgtcatggggatgaacgccaacggcggcggtggcgtgcagccgttcccggacttcgcggcgtactacgaccggccgtccgactcgatgccgcggctgcacgccgactcgagctgctcggagcaggtgctgtcgccggacttcccggccggggaggtgcagagccagcccaagatcagcgagtgggagcgctcattcgcctccggcggcgaccctgtgaacccggcggccggctccatgctcgagcccaacggcggcttcggcggcgacccgctcctccaggacatcctcatgtactggggcaagccgttctaagcagcaaacaaaccgatcgatcggtcgaagcgagtacctccatccttggcgtttggggcgatgaaacgggcgagccgccattgttgacctgatgaaggggagataatttaagaagatattagacgggagataagacaaaatcaggtgcttgatgacgacgacgacgaagattggaaggtggcggcgatgataccgtgggtccccgggctctctcaccagcttgacatgaccgacgcccaagatgcttcaaagcgttcgccgcattgcatcatcgggcgggcggttgtgcgctagcatgcatgcatgtgcgtgtatatggatgggtgtacatacatggagatcatgattggttcggtgcaggggttgctgtttcttgattggttagttgtaatattttttttttttgcgggtgagttgtaagggtttattgataagttgataccataccataccagtgctagccgccgtgcgtggtgctggctagctgtagtccgatggtagtagtgtaactgtaagccattcatcaaatgaaactgaataatatgtt

SEQ ID NO: 5365 - DNA, 1517 bp, Triticum aestivum
  misc_feature (453)..(453): n is a, c, g, or t
cttctccctcctccccagagcagcagcagagaagcgaagaagaattcagcagcagtagaattcagagccgcggcgagctgatccatccatccgacggatcgaccggagatgagcggcgggcaggagctgaatctgccgccgggcttccggttccacccgacggacgaggagctggtgacgcactacctctgccgccgctgcgccggcgcgcccatcgccgtccccatcatcaccgagatcgacctctacaagttcgacccctggcagctcccaaagatggcgctgtacggcgagaaggagtggtacttcttctccccgcgggaccgcaagtaccccaacgggtccaggcccaaccgggccgccgggtccggctactggaaggccaccggggccgacaagcccgtgggcacccccaagccgctcgccatcaagaaggcgctcgtcttctacgcnggcaaggcccccaagggcgagaagaccaactggatcatgcacgagtaccgcctcgccgacgtcgaccgctccgcccgcaagaagaacagcctcaggttggatgattgggtgctgtgccgcatctacaacaagaagggcggcatggagaagccggcggccgtggaccggaagccggcggccatgggcggctacgggggtggccctggggccatggcgagctccccgccggagcagaagcccgtcatggggatgaacgccaacggcggcggcggcggcgcgcagccgttccgggacttcgcggcgtactacgaccggccgtccgactcgatgccgcggctgcacgcggactcgagctgctcggagcaggtgctgtcgccggagttcccggccggggaggtgcagagccagcccaagatcagcgagtgggagcgctcgttcgcgtccggcggcgaccccgtgaacccggcggccggctccatgctcgagcccaacggcggcttcggcggtgacccgctcctccaggacatcctcatgtactggggcaagccgttctaggcagcgaagaaaccgatcggtcggtcgaagcgagtacctcctatccttggcgtttggggcgatgaaacgggcgagccgccattgttgacctgatgaaggggagataatttaagaggatattagacgggagataagacaaaatcaggtgcttgatgacgacgacggcgaagatcggaaggtggcggcgatgataccgtgggtccccggcctctcaccagcgtgacgtgaccgacgacgcccaagatgcttcgaagcgttcgccgcattgcatcatcgggcgggcggtcgtgcgctagcaagcaagcatgtgtgtgtgtgtgtgtacatacatggaaaaaacatgattggttcggtgcggggttgctgtttcttgattggttagttgcaagggtttattgataaattgatatatagtaccataccagtgctagctgtagtccgatggtagtgtaagccattcatcaaatgacaccgaataatatattgttcttacccctccaaaaaaaaaa

SEQ ID NO: 5366 - DNA, 1539 bp, Brachypodium distachyon
aagcctcctctcctccttcctgtacacacaacagagaagaacagcggagagatagttgtccttccagtagagactagagaggaagaagtagcgagcgtgagagagtatcgaagatgagcggcggacaggacctgcagctgccgccgggcttccgcttccacccgacggacgaggagctcgtcatgcactacctctgccgccgctgcgccggcgcgcccatcgccgtccccatcatcgccgagatcgacctctacaagttcgacccatggcagctccccaagatggcgctgtacggcgagaaggagtggtacttcttctccccgcgggaccgcaagtacccgaacgggtcgaggcccaacagggcggccgggtcggggtactggaaggccacgggggccgacaagcccgtgggctcgcccaagcccgtggccatcaagaaggcgctcgtcttctacgccgggaaggcgcccaagggcgagaagaccaactggatcatgcacgagtaccgcctcgccgacgtcgaccgctccgcccgcaagaagaacagcctcaggttggacgattgggtcctgtgccgcatctacaacaagaagggcgggctggagaagccggcggccgcggaccagaagccgccgctgatgggcggctacggggctgccgccatggcgagctcccctccagagcagaagcccctggtgggttccggcatggccccgccggctttccccgactacgcggcgtactacgaccggccgtcggactcgatgccgcggctgcacgcggactcgagctgttcggagcaggccgccgtgctgtcgccggaccagttcccgggcggcggcgaggtgcagagccagcccaagatcagcgagtgggagcgctccttctccaccaccaccgccgacaacccggcatccgccggcggcgggctcgggctcggcggcgacccgctgctccaggacatcctcatgtactggggcaagccgttctaagcaacaaagcgatcaaaatcatggcatccatcgttagttcttgggaggcaatgacgttcgcgggcgagccgccggagttgacccgatcgagcacgggataattttaagaagaatttagaagagggattagatggttgataagacaaaggcaggtgtcgttggtgatgtcgactcgaattgaagggcggcgatgagtccgtggaggggcctcccggttcatatctggagtagtacttggtgacagctagcggaggtgaagggtgatagcgttggctgctgcattgtttgcatcatcgagggcggttgcatgtgtgtgtatatgtgtacatacatgggacatgcatatgattgattcggttcaggggagtttctaacttccctgttcctgtttcttcattcgtttattgtaagggttccttccgtagcggttactgtgctagaggcggcagtgtatggtggagcagtggtactgtaataaaaaaaatgcccattggtagtgtctgtgtaagccattcatcaaaagaaattgaataagtttacaaaaaaa

SEQ ID NO: 5367 - DNA, 1482 bp, Brachypodium distachyon
cctccttcctgtacacacaacagagaagaacagcggagagatagttgtccttccagtagagactagagaggaagaagtagcgagcgtgagagagtatcgaagatgagcggcggacaggacctgcagctgccgccgggcttccgcttccacccgacggacgaggagctcgtcatgcactacctctgccgccgctgcgccggcgcgcccatcgccgtccccatcatcgccgagatcgacctctacaagttcgacccatggcagctccccaagatggcgctgtacggcgagaaggagtggtacttcttctccccgcgggaccgcaagtacccgaacgggtcgaggcccaacagggcggccgggtcggggtactggaaggccacgggggccgacaagcccgtgggctcgcccaagcccgtggccatcaagaaggcgctcgtcttctacgccgggaaggcgcccaagggcgagaagaccaactggatcatgcacgagtaccgcctcgccgacgtcgaccgctccgcccgcaagaagaacagcctcaggttggacgattgggtcctgtgccgcatctacaacaagaagggcgggctggagaagccggcggccgcggaccagaagccgccgctgatgggcggctacggggctgccgccatggcgagctcccctccagagcagaagcccctggtgggttccggcatggccccgccggctttccccgactacgcggcgtactacgaccggccgtcggactcgatgccgcggctgcacgcggactcgagctgttcggagcaggccgccgtgctgtcgccggaccagttcccgggcggcggcgaggtgcagagccagcccaagatcagcgagtgggagcgctccttctccaccaccaccgccgacaacccggcatccgccggcggcgggctcgggctcggcggcgacccgctgctccaggacatcctcatgtactggggcaagccgttctaagcaacaaagcgatcaaaatcatggcatccatcgttagttcttgggaggcaatgacgttcgcgggcgagccgccggagttgacccgatcgagcacgggataattttaagaagaatttagaagagggattagatggttgataagacaaaggcaggtgtcgttggtgatgtcgactcgaattgaagggcggcgatgagtccgtggaggggcctcccggttcatatctggagtagtacttggtgacagctagcggaggtgaagggtgatagcgttggctgctgcattgtttgcatcatcgagggcggttgcatgtgtgtgtatatgtgtacatacatgggacatgcatatgattgattcggttcaggggagtttctaacttccctgttcctgtttcttcattcgtttattgtaagggttccttccgtagcggttactgtgctagaggcggcagtgtatggtggagcagtggtactgtaataaaaaaaatgcccattggtagtgtc

SEQ ID NO: 5368 - DNA, 1569 bp, Avena sativa
ccctctacaagcactagctagtaggaaatcatcatccaagagaagagaaatctttcttcgtcagaagtaaaattcagcagtcagcagcagcggcgagctgatcgagtgagagaatctgcgcgcgcgagcttgcttcagtggtggtgtcggatcgagaatctgcgcccgatcggatcgatgatgagcggcggcggacaggagctgcagctgcccccggggttccggttccacccgacggacgaggagctggtcacgcactacctctgccgccgctgcgacggcgcgcccatcgccgtccccatcatcgccgagatcgacctctacaagttcgatccatggcagctcccaaagatggcgctgtacggcgagaaggaatggtacttcttctccccgcgggaccgcaagtaccccaacgggtccaggcccaacagggccgccggatccggctactggaaggccacgggggccgacaagcccattggcacgcccaagccgctcgccatcaagaaggcgctcgtcttctacgccggcaaggcgcccaagggagagaagaccaactggatcatgcacgagtaccgactcgccgacgtcgaccgatccgcccgcaagaagaacagcctcaggttggacgactgggttctgtgccgaatctacaacaagaagggcgggctggagaagctggagcccgcggagcggaagccggtggtgaccggcaactacgcgggtcctggggtcatggtgagctccccgccggagcagaagcccgtcctggggatgccacccaccaacggcggtggcgtgccggcgttcccggactacgcggcgtactacgaccggccgtccgactcgatgccgcggctgcatgcggactcgagctgctcggagcaggtgctgtcgggcgagcggggcggcggcggggaggtgcagagccagcccaagatcagcgagtgggagcgctctttcgccaccgtttctgaccccgtcaatcctgcggcgggcggcctcggcctcggcggcgacccgctcctccaggacatcctcatgtactggggcaagccgttctaagcgaaaacaagcgatcggtccatccatggaagccagtactctactcctatccttggcgtttgtggtggcattggggcgatgatgcaggcgagccgccgttgctgacctgatgaacaggacattatttaagcagatactagttggaagatgaagacgaaaaatcaggtgcttgatgacgacttgaatgaagcaggcggcgatgataccgcgggtccccgggcctggagatgacgcggcgatgatagcaatgtgatcgtgcggagcatcatcgggcggttgtgcgaagcatgtgtgtgtatatgtgtacatacatggaacatgattgattcggtgcaggggtattcctctcctgctcctgctagtctcttcattgcttaattttatggttctacaataaacatcggcacaagtgtccgatcgtgcccactgtccactggtgcgatggtactgtatttcatcaaagattgaaactgaataatagtcatgtgccagttggttgatttc

SEQ ID NO: 5369 - DNA, 1533 bp, Leymus cinereus x Leymus triticoides
  misc_feature (27)..(27): n is a, c, g, or t
  misc_feature (903)..(903): n is a, c, g, or t
aattcagtagcagtagaattcagagcngcagcagcggcgagctgatccagcgagagagttacagtgagaggtttgttggatcgaggcttgcgtcgccgacccgaccggagatgagcggcggacaggagctgaatctgccgccgggcttccggttccacccgacggacgaggagctggtcatgcactacctctgccgccgctgcgccggcgcgcccatcgccgtccccatcatcaccgagatcgacctctacaagttcgacccctggcacctcccaaagatggcgctgtacggcgagaaggaatggtacttcttctccccgcgggaccgcaagtacccgaacggctccaggcccaaccgggccgcggggtccgggtactggaaggccacgggggccgacaagcccgtgggcacccccaagccggtggccatcaagaaggcgctcgtcttctacgccggcaaggcccccaagggcgagaagaccaactggatcatgcacgagtaccgcctcgccgacgtcgaccgctccgcatccgcccgcaagaagaacagcctcaggttggatgattgggtgctgtgccgcatctacaacaagaagggcggcatggagaagccggcgtccgtggaccggaagccggcggcggtgggcggctacgggggccctgtggccatggtgagctccccgccggagcagaagcccgtcatggggatgaacaccaacggcggcggcggcgtccagccgttcccggacttcgcggcgtactacgaccggccgtccgactcgatgccgcggctgcacgcggactcgagctgctcggagcaggtgctgtctccgggcgagcgcgtcggcggggaggtgcagagccagcccaagatcatcgagtgggagcgctcattcgcctccngcggcgaccctgtcaacccggcggccggctccatcctcgagcccaacggcggcttcggcggcgacccgctcctccaggacatcctcatgtactggggcaagccattctaagcagcaaagaaaccgatcgatcgatcgaagcgagtattacctcctatccttggcgtttgtggtggccttggggcgatgacgcgggcgagccgccattgttgacctgatggacgggatacaatttaagaagatattagatgggagataagacaaaatcaggtgcttgatgacgacgacgtggaagattggaaggtggcgatgataccgtgggtccccgggctctcaccagcatgacatgacgccgagatgcttcaaagcgttcgccgcattgcatcatcgggcggttgtgcgcaagcatgtgtgtgtgtgtgtataggtgtacatacatggaaaacatgattgattcggtgcaggggttgctgtctgctcctgtttcttgattggttagttgcaagggttttctctaccagtgctagcagcagcagcagccgtgcatggtgctctggctgtagtcgatggtagtgtaagccattcatcaaatgaaactgaataatagtacaatattattcttgctcctcca

SEQ ID NO: 5370 - DNA, 1614 bp, Hordeum vulgare
cagtgagcagagtgacgaagcctcctctcctccctccctcccctagaccagctcaacagcacaagaattatccagtagcagcagcagcagtagaattcagagcagcagcaggactgcagcgagcgagagcttcgttggatcaaggatccgatcgaccggagatgagcggcggacaggagctgaatctgccgccgggcttccggttccacccgacggacgaggagctggtgatgcactacctctgccgccgctgcgccggcgcgcccatcgccgtccccatcatcaccgagatcgacctctacaagttcgacccctggcagctcccaaagatggcgatgtacggcgagaaggagtggtacttcttctccccgcgggaccgcaagtaccccaacgggtccaggcccaacagggccgccgggtccgggtactggaaggcgacgggggccgacaagcccgtgggcacccccaagccgctggccatcaagaaggcgctcgtcttctacgccggcaaggcgcccaagggcgagaagaccaactggatcatgcacgagtaccgcctcgccgacgtcgaccgctccgcccgcaagaagaacagcctcaggttggatgattgggtgctgtgccgcatctacaacaagaagggcggcatggagaagccggcgtccgtggaccggaagccggtgaccatgggcggctacggggttggtcctggggccatggcgagctccccgcaggagcagaagcccgtcatggggatgaacgccaacggcggtggcagcggcggcgtgcagccgttcccggacttcgcggcgtactacgaccggccgtccgactcgatgccgcggctgcacgccgactcgagctgctcggagcaggtgctgtcgccggacttcccgggcgagcgcggcggcggggaggtgcagagccagcccaagatcagcgagtgggagcgctcattcgcctccggcggcgaccctgtgaacccggctgccggctccatcctcgagccccacggcggcttcggcggcgacccgctcctccaggacatcctcatgtactggggcaagccgttctaagcagcaaagaaaccgatcgatcgatcgatcggagcgagtactcctatccttggcgtttgtgttggccttggccttggggcgatgaagcgggcgagccgccattgttgacctgatgaaggggagataatttaagaaagatattagacgggagataagacaaaatcaggtgcttgatgacgacgactgcgaagattggaaggtggcggcgatgataccgtgggtccccgggctctcaccagcatgacatgacgtgcgccaagatgcttcaaagcgttcgccgcattgcatcatcgggcgggcggttgtgcgcaagcatgtgtgtgtgtgtgtctatatggccatatgggtgtacatacatggagaacatgattgatttggtgcaggggttgctgtttcttgattggttagttgtaagggtttattgataagttcataccggtgctagcagcagcagcggccgttggtagctatagctatagtccgatgggtagtagtgtaagccattcatcaaatgaaactgaataatattattcttgcc

SEQ ID NO: 5371 - DNA, 2134 bp, Hordeum vulgare
tggaagcctcctctcctccctccctcccctagaccagctcaacagcacaagaattatccagtagcagcagcagcagtagaattcagagcagcagcaggactgcagcgagcgagagcttcgttggatcaaggatccgatcgaccggagatgagcggcggacaggagctgaatctgccgccgggcttccggttccacccgacggacgaggagctggtgatgcactacctctgccgccgctgcgccggcgcgcccatcgccgtccccatcatcaccgagatcgacctctacaagttcgacccctggcagctcccaaagatggcgatgtacggcgagaaggagtggtacttcttctccccgcgggaccgcaagtaccccaacgggtccaggcccaacagggccgccgggtccgggtactggaaggcgacgggggccgacaagcccgtgggcacccccaagccgctggccatcaagaaggcgctcgtcttctacgccggcaaggcgcccaagggcgagaagaccaactggatcatgcacgagtaccgcctcgccgacgtcgaccgctccgcccgcaagaagaacagcctcaggttggatgattgggtgctgtgccgcatctacaacaagaagggcggcatggagaagccggcgtccgtggaccggaagccggtgaccatgggcggctacggggttggtcctggggccatggcgagctccccgcaggagcagaagcccgtcatggggatgaacgccaacggcggtggcagcggcggcgtgcagccgttcccggacttcgcggcgtactacgaccggccgtccgactcgatgccgcggctgcacgccgactcgagctgctcggagcaggtgctgtcgccggacttcccgggcgagcgcggcggcggggaggtgcagagccagcccaagatcagcgagtgggagcgctcattcgcctccggcggcgaccctgtgaacccggctgccggctccatcctcgagccccacggcggcttcggcggcgacccgctcctccaggacatcctcatgtactggggcaagccgttctaagcagcaaagaaaccgatcgatcgatcgatcggagcgagtactcctatccttggcgtttgtgttggccttggccttggggcgatgaagcgggcgagccgccattgttgacctgatgaaggggagataatttaagaaagatattagacgggagataagacaaaatcaggtgcttgatgacgacgactgcgaagattggaaggtggcggcgatgataccgtgggtccccgggctctcaccagcatgacatgacgtgcgccaagatgcttcaaagcgttcgccgcattgcatcatcgggcgggcggttgtgcgcaagcatgtgtgtgtgtgtgtctatatggccatatgggtgtacatacatggagaacatgattgatttggtgcaggggttgctgtttcttgattggttagttgtaagggtttattgataagttcataccggtgctagcagcagcagcggccgttggtagctatagctatagtccgatgggtagtagtgtaagccattcatcaaatgaaactgaataatattattcttgcccctgcaaaaaaaaaaaaaaaaaaaaaaaaaaaaaaaataaaaaaaaaaaaaaaagaaaaaaagaaagacctcggggggggacccgaaacccaataatacctgtgagtaagaataaaacaatggcctgcccaagtaataacaaccgtgaaactgagtaacccctaacaaacccgagttagcccgcctatcgtatcatacctcttaagtccactattgtacccctcacaaccgctggaaacaaaccacttagataaaatgcaaaatcggcattattataataagcacgacagtatagataggaacagtacaggataaattaaaggtgtaataactttttcgatatagaacgcaaagaacggtatactatatattcgggtaccgggcccaagagtaattttgacgtccactttatttcggtaattataagtagaactgatctaccacgcccgcaatatccgttttcttttatgaaacagaaatactatacattataacagtatcacaatgtgttgagaatcataaaacaatagccgc

SEQ ID NO: 5372 - DNA, 2671 bp, Zea mays
cgaggtgctgccgccgcccgcgcgcgggacgctcaaaacagccgcttccccaaccaaaaggcgcaagaaaactcgtccccgccgctcaaaaatctcccgcctcccgcggatgggatggcatccagtttcacagaccacacgcccacccgctccgccgctcgcgcccaaaaattttcgttcagccggctgcctgccccccaccaccacttccctcccgttccgaaaccccgattagccgccgacccgccgtctccccacgtatttgactggtgctagagccagcgcccagatcaaccttcctgagtccatcggcaccgcatctgcctcgcgatccgtctctctctctgtcccctcacggccgtagaccttttcgagggcggtatcggagggaggagagggggaggcgaaggcgggagtagtagaaactaggaagggccgttcgtgtcttgcggagaagatggagaacctgaggaggttcctgaacccgctggtgctcaacctgcagaagatggagctggagctcacctgccccgtctgcctgaagttgctcacctcgcccacaacgctgccgtgttaccacacatcctgcagcaagtgtgcccttacaccgacttcaaaaggctacagctgtgccatttgcaaatcaggctattgttctcaagatttaaggccagcttctcaccttgagtcgatagtgagcattcataggagcctcagctctaccgtcagcaccatgattgaacaacaggattctcaaattaacattcatgttgcaaaggcagcatctcatggaacaccagaatcaggaaacagaagtggggtggaggagaaatctgaccagatgaaatcttacaaccctgttgcttcaaagctagtatataaccaaccaactggacctgcatttgggaacattgatagtgttcaagcaaaagatcctgcatttgagaacaatgctggtgccgcagctgttgcaccaatggcttttgtacgaaagggtcattctgggtcacaatcttctgatggccctggagatttggactgtgacagcaatgacctcgaaggagaactgatgacaagcctatcacctcttcaaactgcattgaaacgagaggcaaatgcaatggatgatcataccagagaattgaagaagcaaaaatcaaatgatcaagttcaaagacaaacaaacatggccagtgcttggaaatgtgagttctgtcattcttcccaagttactgagtgtactggccctttgtcacattatttgaatggggagccagtagaagctgatcaagcttggaaatcaagtgttcagcatgtccatgagaaatgcattgaatgggctcctcaagcattctttactggtgacaccgcaaacaacttggggcctgagttggcccgtgcttctaagatcaaatgcagtgtttgtggcttaaaaggcgcagcacttggctgccttgtgaagagctgccgcaaaagttttcatgtcccatgtgcctacaacatcaaaggctgcaaatgggatcaagagaactttgttatgctgtgtcctacacattcgtcaaaaaagttgccttgtgagagattaaagccaaaaaagaaggccaagctgcagcaaccatcttccgacattgatggtccgatttcaccctctccgatgcaaagggctgaactttggactgcctcaccttttctgactagtgaatgggtgatatgtggatctgcgctcgttggccatgagaaggaaatcttggatcagtttgagtgtcacactggcatcacagtaaccaacacctggagttcagatgtgactcatgtgattgctaatacggatgaacgtggggcatgtgcacggacactcaaggtcctcatggctattttagctgggaagtgggttctcaatgtgaattggctgaaagcctgtatggaggctagggaaccagtcccagaagagccctacgagataaggtgtgatgttcatggctctgtcgacggccctcgctcaggaaggctccgagcgatgcagcaggcaccaggtctgtttgctgggttgaccttctacttcagtggccatttcatgccgggatacagggccaacctcgaagatttgatcgccgcagcagggggctccgttctggagaaggccgagctctctagcacgtccttgatcctctacagcatggaggcgccgccgccccacaacaacctagacgccctcgagaccatcaacaagagattagccgaggcccaggaactggcgaccacggctggctgcaaagccattcctcacacatggcttctggactgtatcgcgtcgtgcgcggttgagttgaacgtgtcgtgttctactgcctaggttcaaacataggaatgcgacatctgctgctgtttttttttgaaaaaaaggagattaagagacgattggcttgttgtcttgatccaaagtatctttagacgttgtagcatgaaagcggaatttagtcggaataagcctgtgtatcttagtcaacgttactgtcggtgatgtcatccacatgtttcacctactgacaggtgcagtttgtctgattttttttcttcttgatttctatctaaaaaaacataaaaggatgcactcaggtcaggtttactccactttttcttgaattgacgttggaaaaaaaaaagagattta

SEQ ID NO: 5373 - DNA, 4019 bp, Zea mays
atggagccgccttcgcctccggcgacccactccgcggccgtccgtgtcctctcccgcactcctccgccgacctccccgaacccctcctccacgggcccggcggccccgtcgcccgcctcccgcgacggggtcgtcgccgtcggcttcgtgggcgccgcggggaccgcccgcctcgcggaccggatcctcgacgcccacgtcttctctcccggtggctcggcggggagcctcgcgggaagggtaaggtaccaccgcgacgccggcaagaggatggtgttccttcacctcacgccgccgccgcccgcgccgctcgaggcggtggcaggatgctgcgatgacggcgaactaccggagatgctcttcatgttctctgtctgccacgtaattatatttctgcaacaaggcttcagatttaacacacaaaccttaaagaagttccgactgctgcaatcttcaaagcatgctctcgctccatttgtcaagccattggtggcagctgcaatgcctgccagaactgttgcctctgacaccccaacaagagcaacccacagggcttcttccgtctcccctccaacacgccgaggaggtcacgctgggcgtcagtcctcggctatctcacttatgtctggaaccagttcaactccttctgtcttgccaggccaatgcattcctgtattgctctttgtctttgaggatgatgcggttgatgtttcaagtgctgcagcaagtcccgatgatataggtgatgcatcttcatcaaatcagggttctacccctgatggactaccaaaacagagcttagcttcaaaaagttctggttcagtaattatgctttcccgggcagcaaacaaatctgagggcagttcaggcaaaaaactgcattcgtcactggagggacagatccgtgtcttgatcaagaagtgcagggtgcttgcaggcatggagcctggacatattggcccaaggggcgtaagtaacatgagtcatcatttacccctgttctcactcgatacctcgagggtagttgcactgttggaacggtatattaataagaaacaggaaccactggacaccattgcaggactatttgaagattctttgtgctccaaatcgccattggatattctttcgctcgaaaacaactaccatccaacaaaccatgatgactttcagttgatcaaggattttatatttcggcagtctgatgcgctgagagggaaagggggatattcaagcaatgcaagtgccgggtctgttgcaggtgttggcatggtggctgctgctgctgcagcagctgcagcatcagctgcatctgggaaaccagttaatgcacctgacctccctacttttgataaatggttgtccataagtacctctattctaactgcactgttgagtggaagaaatgtgctgagatgtcagtctgaaagcaagactcatacaagtcctactgagaagaatggccaacttcctgtaggatctaatgctattgagatcgcattatcgtgcttggaaagtaacaatgggctgaacatgaaattttcttcatcatggtgtcaaagggtgcttccagctgctaaggagatatacctgaaaggtttgcctgccttttaccccacaagaatgcatgaagtgcagctacagaaggcattgcggtcctttggctcaatggttaaaggaccagcagtcagggtattctcaaagaagctagaagatgagtgccgggcaatatgggaatctggaaggcagcaatgtgacgctgttagcctaactggcagaccatgtaagcaccgcaggcatggcgatttcttttcatcagatgcaatggagcaacattctagtggatatgtcttcctccatgcatgttcctgtggccggtcacgccgccttagagatgatccttttgactttcagacagccaacgtgtcttttaattgtttccaaaattgcgatgacctattacctacccttgcgcttccaagaggcagcaatgatggttcattttcagtatcctcttggtgcttggtgcgtcttggaggagcaaggtactacaagccaacaaaaggactccttcaaagtggatttagctccaaggagaggtatcttctaaggtggattgtatctgttcataaggggcaagtgagaaatgacattcgttctaatactattacttcatccgcaagatctggtatgaacccgcagactcccccaatagtcactggtgaagtaaaatctgccataacccaagtcacagcacaaattaaatatgcaaagcttgaaaattctggaaaacaagctgaagttgaaccagtgagcaacttaggcattaattttggtaaaggtctgccaaattttactatgaaaaagcccttttctgaagttgttgctggcaccacatcaaaagataccgagtttcctgctcttcagcagacaaggccaccaaaacctggtggtcgaaaagatgagcagcgtcaaatgaatatagtagaccagactaatggccgaggtcatgtggctgtcagccaagggtctgtagctgaaactgaatcggcaaaagcaagcagaaacaagagtagtgaaaatgctgatgggaagccctttttacagatagggagcaatatagtaccagtgattgctggaaatgagactagagaaactagtcagccagtacaacagtttgttgtgtatattggatttgagcatgagtgtccctatggtcatcgcttcttactgtcagagaaacatatgaaggagatcgagtcttcctgtttgcagtatcaaagacctcatctaaacaaagaagcagaagtcaagcatgcacaaaagttgctccaaaatgcatctggtttaatagcatctgcagtggacataaacagtgcacggaaaaacagtaagccattggaatcatcagggagaaacagccagcagcaatcactgcagctgaggattgatgcagagacctcacagccttctcctcggctttcagatccacagaatgccaaaaggtgggagcattattttcgaagcgttacaattgatgatggtggagaagcattttcactgatgaacagaaacttgccaatatatatgcgctgtccacattgcaaggtctcagaaaggaaggaacatcaagatgtaaagtttgctggtgttgtgtctcaacttcagcggattttcattgtgacacctgatttccctgttctgttggcaagctgcccacttgtacagtttgaggcaagggtcatgtttgccatcaaatgtctctgatcatgatcgagaaggatcattcagtattgggtgccgagttatcctcccacctgagagctttcttactatgaggcttccctttgtctatggtgttgagacaaaggagggaagtaaatttcccctcaaatactttgagcgacaaccagaactcacagcatggcttgttgcaggcacagccctgcaaatcgtgtcggtaggggatgtcactgagaaagaaaccgttatgaagtgatagacatgtcatataaagctttactggctttagcatgttctagtcatatatcagtgatttgctatcggcattgaataggtctgttgatggttatattctgtctgaagttttcacttctactcctgaacttgtgctgctaagctgttgacacaactattgcttgctttcactgtgctggaagcattgtgaaatagaagttccgctgatatctgcctgacctggatggtgtatatagatgcaagcagagggggcaggcccacaggcaatcgcgccgttcttgtctttgtacatgaaaggtgccaggaggttaagtttagctggttatgtaaaggtccgctttttgaggacctgtccagtggatcaatcccattcctagactggtttgccttgaggcttggagattttgtagtaagactattagttcaattgagctgtttgtccagttgatgagttgttttattcctaggcttgttgagaaatctggccttggaatatagaacccagaagaaaggatttttct

SEQ ID NO: 5374 - DNA, 1265 bp, Zea mays
aaaaaaaacagaagtactaacgccccgcccctgcctggggttttaaccctacccaaccgccgcccatggcgtccatctcggagcccgctgctagggagaagcccatcgtcgtccgggtcaagcgcaaaccttcgcaaaaccgcccggacgctttctggctagagattaatgagaggccggcaaagaaggcggcgattgatttctcccgcctttccatctccgaaccctcctcgtcctctgccagtgtcaaagcttcagaggaaccacgggttaagaaaattcttgtccagcacatcgagacagtacaccactctgaagctgtcgaagatgttttacaatctcttttgcttgttgactcaaattccaaggagacaaagagcaagacaaaggagtggaatgacagaatcaagcaagacaaaaaaccagagcaactacgatcagctgccagacagaggcatgaggatatgggaagaaatgctcggtttgcacaaatatggaagagtcgaaaaggagaaaaggctgatgctggtgactcattgagagaaatatgccatctttatgatgctgtccaagtagatcccgatgatgagaagcatccagcagaaccacggattacatcttttgaagagggtgctgttctatgcaactttcttccacttatacgggaatacttgccatcaactgccgaggaaattgaggcggatataatttcattggcgcaatcagaagattctgaagtttatgatatctatactgtcaaggaggtggatgacacaatggaggccacgtcagcagcttcatatccaaggttacaagtggatgatggagaagatgaatgctacgaagattgtccatatgacacagatgattccaatgccgaagacaatcctctttttgattatcctgatgaatcttccgaggacgaggatgatggtaggaacgacgaggatccttttggagacaaagaaggttctgactcagattacgagaaggaagaagtagaggtggaagaggatgagtaacggtgaagggaagttgtgatgaaacgtgcggttgtagaatgtagatgcagggcagcaggggagctgactgatgaatgtttgtgttgctttatgctgtctaagaaacgggacttgtctcgacgctttgtgccagttagcatagcacatcgtgtgcagtatccggaggaagaattgggaaaaaacaatatttggaagcgtcagctagacacaggcgaatcgtaataattggtattttgccacttg

SEQ ID NO: 5375 - DNA, 2279 bp, Zea mays
gctagcggcggtacggtagagtttggccgcttggcatttgcccatgggagacggagacggagggagacgcaccacgtgaccttgttttgcaccagctgtaccaaacaatccccttctccgctgccgtcggtggtgtggttcgcctcccactcacgctaccagctgggctgggagggactgggccaaaccaagaccatcccatacctcttctcccctgccggtggtgtggttcacctcccacttactcactcactcactcgcggacactgccacaaacttccgccccagatctccgtatataacacgccggcggcccgtccgtccgggctcctgactccggatccaccgccgccgcgccgcactctccctctcactccaccgccgaagtactccccgcctgccactgccagcctgtgcctgcacaaaagcaaaaatggcgccttggccgcggcggcccgtgctgacgctggtgctgctcctgctgctcgcgctcctgtgctcccatgtcgcgctctgctcctccgccgaaccggggaaacccaagcccaagcccaaggtctccggcagccgcaaggcgctgcttgcggacaacgacggcgacgaggtgcccgccgccaagccgggcaagtcggccgcggcggggaagaccaaaaagaagctgctcgccggcgacgccacttccaagaaccagaccaaggttgccaaggctaagaagccagagtcagctgccgcggcgaaaggggccgccaagaagcccgctggcaaagcggctgcggctgcgggtggtgacgccgccattgccaaggtctccaaggcccccaagacccccaaggcggacaaggccaaggtgccgaagccggacaaggcggcgactgcggcggcggctggtgccaagaccaagggcgccgattcggccaagcctgccaaggtttccaagacgggcgccaaggcggtgaagccgcccaagacggccaaatctgaggctgccaccgcggttgggaaggcaaagaaaccgccgccggcaaattcgaccgtggatgccggtgccaagacggccaaatccggcaagaaggctccggtggtcgtcgacgccgaggtgaaggcgaatgcgaccgtcgtgagcaaggagaagtcagcggcgacggagacggtggagatggaggatgaggaggaggtggtgttggccaaggaggcgggggagggcacggacgatctcatctccgaattccgggacctacccagtcggctgcaggagacgctgatgccggacctggcgcgcctctcgcaccactccaaggcgtacctgtccgcggcgaacgccgggatcgccgacggcgtgcgcccgatcctgggcggccggtgggcggcggtggccgcctccgcggcgtcggtggcggtgctgctgctgccgctcttcatgctcaccgcgctggtgcgccggatgggcccgtacctgccgctcctccaccgcgcgctgctgctggcgcaggcgtacctcgccatctactttgccacgctcgcgctcgccgcggccgccacggggctggagccgctgcgcttcttccacgcggcctcccccgccgcctacgcctggacgcaggccgcgcagtccctcggcttcatgggctacctcgtgctccagatggtggacctcgttgctgtcttctcggacgccgcctcccccgaggacgaaggcaacggggacgctgccaaggcgctcggccttgcgcagatggtggtgggcctcgccgtcggtctgcactactacgccgccgtcttccaccgcgcggcggcgggagaggcgccccgcgccaactggcgcgtctacgccgtgtacgccgcctgcttcgccatcgtgtgcgcctgcgcgcgtgccgagaggaggaagaaggcctacctcgcgggcaccgacggcgccgcggaggagtggaagaagagctgagctgcttatctcaggatacacgactagatcagaattcgggactcagtaaggatttgtctgaaaaagatcccaatatggttatggtgaaaactcagaatttaggaagaaaaggagggtataaaaggaaaaaaactggaagctgtgattcttttccttttctacatttattattattcatataagatgttccccctttcgtgttaagttattggttcgagtacagagggataataaactcataaacctgtatggaacgaccaggtttatttcatggatttcactggctctggccatgtcaacttcactgctctgttcgtgaacgtgcatttatcagata

SEQ ID NO: 5376 - DNA, 1758 bp, Saccharum officinarum
cacatgcgtgttgtttcagcatagccaccgcgagagatagggaaggaagacgatggccgacggcggcgaggcaacgacgccgttgctggaggggaagcccaaggtgtacttcgacggctgccccgggtgtgccaacgaccggaggaaggcagagaacccgggaattccctacgggcaattcttccatatctggatcatcatcctcgtctcctgtttgccaatatcattgttatttcccttcatatatttcatgataagagacttgcatattgccgaaagggtagaagatatcggattctatgctggttttgtaggtgcttcatatatgcttggtagagctctaacttccactgcttggggaatgatagcagatcgtattgggaggaagcccgttatcattcttgcaattatctccacgcttttgttcaacactttgttcgggttaagtgtaaagtattggatggcgatagcaacaagattccttctaggttctttaaatggtttgcttggcccaataagagcttatgctgttgaagtatgccgaactgagcatcaagctattggactgacacttgttagcacatcatgggcaataggtcttattattgggccagctattggtggatacctcgcacagccagttgaaaaatacccaaagttatttccagccaattcaatatttgggaggttcccatatttcttaccatgtttgtgtgtatcgtttttctgtttggttatcctcataagctgcatttggctcccggagacattgcataagcacaaacttcacaaaactgaagatcaaggaatcgaagagtttcctgagcaacaaaatagttcaactacaaataagagcttgcttaagaactggccattgatgtcatccattatcttattctgtgtcaccgcttttgatgatatggcctacacagagatattttctctatgggccgaaagcgacaaaaagtatggaggactaggtttctcgtccgaggatgtcggtcaagtgcttgcagttacaggtgctagcatccttttgtaccaaacatttgtttatccacgtattgtaaaagtccttgggccagtcaatgcttcccgtattgcagctattctagctatggtactccttttcacttatccaccaatgacacgtttgtcaaaaccgtggttatcagttgtagtgaatattgcatcagtgttgaaaaacaatttagttgttaccattgtgacatgctcttttattcttcagaataattcagtgcctcaagagcaaagagcaactgcaaatggcttagcaactacgttaatgtcctttttcaaggcatttgccccagcaggagctggtgttgtattttcatgggcacaaaaacgccaacatgctttcctctttccaggtgatcagatggtgttcttccttctggacattgtcatctttgttgagctcatttggacattcaagccattcctagccattcgagagcaaatctcctgaagttagccttcatgcttcatctctactggtgtttattgtggatggattgatatcggataacaattgggatatctatttcttgtgcaatgtgatggaactataatgatatttccaatgtacatatacatggtgtttgtataaccatctaagtattccatgtcatgctaaacagcatgattgaccaaccatcatatataatttatactaactgtaacttgcattgtaaaccataatctaaatgaaactatattgtttcagagtttggc

SEQ ID NO: 5377 - DNA, 1758 bp, Saccharum officinarum
  misc_feature (175)..(175): n is a, c, g, or t
  misc_feature (442)..(442): n is a, c, g, or t
  misc_feature (908)..(908): n is a, c, g, or t
  misc_feature (1096)..(1096): n is a, c, g, or t
  misc_feature (1123)..(1123): n is a, c, g, or t
  misc_feature (1476)..(1476): n is a, c, g, or t
cacatgcgtgttgtttcagcatagccaccgcgagagatagggaaggaagacgatggccgacggcggcgaggcaacgacgccgttgctggaggggaagcccaaggtgtacttcgacggctgccccgggtgtgccaacgaccggaggaaggcagagaacccgggaattccctacggncaattcttccatatctggatcatcatcctcgtctcctgtttgccaatatcattgttatttcccttcatatatttcatgataagagacttgcatattgccgaaagggtagaagatatcggattctatgctggttttgtaggtgcttcatatatgcttggtagagctctaacttccactgcttggggaatgatagcagatcgtattgggaggaagcccgttatcattcttgcaattatctccacgcttttgttcaacactttgttcggnttaagtgtaaagtattggatggcgatagcaacaagattccttctaggttctttaaatggtttgcttggcccaataagagcttatgctgttgaagtatgccgaactgagcatcaagctattggactgacacttgttagcacatcatgggcaataggtcttattattgggccagctattggtggatacctcgcacagccagttgaaaaatacccaaagttatttccagccaattcaatatttgggaggttcccatatttcttaccatgtttgtgtgtatcgtttttctgtttggttatcctcataagctgcatttggctcccggagacattgcataagcacaaacttcacaaaactgaagatcaaggaatcgaagagtttcctgagcaacaaaatagttcaactacaaataagagcttgcttaagaactggccattgatgtcatccattatcttattctgtgtcaccncttttgatgatatggcctacacagagatattttctctatgggccgaaagcgacaaaaagtatggaggactaggtttctcgtccgaggatgtcggtcaagtgcttgcagttacaggtgctagcatccttttgtaccaaacatttgtttatccacgtattgtaaaagtccttgggccagtcaatgcttcncgtattgcagctattctagctatggtnctccttttcacttatccaccaatgacacgtttgtcaaaaccgtggttatcagttgtagtgaatattgcatcagtgttgaaaaacaatttagttgttaccattgtgacatgctcttttattcttcagaataattcagtgcctcaagagcaaagagcaactgcaaatggcttagcaactacgttaatgtcctttttcaaggcatttgccccagcaggagctggtgttgtattttcatgggcacaaaaacgccaacatgctttcctctttccaggtgatcagatggtgttcttccttctggacattgtcatctttgttgagctcatttggacattcaagccattcctagccattcnagagcaaatctcctgaagttagccttcatgcttcatctctactggtgtttattgtggatggattgatatcggataacaattgggatatctatttcttgtgcaatgtgatggaactataatgatatttccaatgtacatatacatggtgtttgtataaccatctaagtattccatgtcatgctaaacagcatgattgaccaaccatcatatataatttatactaactgtaacttgcattgtaaaccataatctaaatgaaactatattgtttcagagtttggc

SEQ ID NO: 5378 - DNA, 1892 bp, Glycine max
tctgggtttgaatgatacttgtaaaaaaagagggacctgagtgaaacaagtggtggggttctctcacaaacatggaagaggaaaatgttaagcagccattgttggagaggaagtaccacgagaactgccctggttgcaaagtggatcaagccaaagagttgagtgagggaaagggtgtacccgttacaaatcttttcatcatatggatggtggtgttgtgtgctgcgctgcctatatcgtctctctttccattcctttatttcatggtaagggattttaatattgcgaaaacagaagctgacattagttcttatgctggttatgttggttctgcattcatgtttggcagatgtttgacatctgtattatggggtattatagctgatcgctacggtcgaaagcctgttatagttatagggattattgtagttgtcattttcaacacactatttggccttagcacaagtttttggatggcagttatcatgagatttcttctgggaagtttaaatggtttgcttggaccagtgaaggcctatgccactgaactttttcgggaagaacaccaagctctaggactctcaactgtcagtgcagcttggggcataggtttaatcattggcccagcattgggaggctatttagctcagcccgtagagaagtacccacatatatttccaaaggattccttctgggataagtttccttacttgcccaactttataatatctgcagttgcatttgtagtagttattggctgtatctggattccggaaacacttcacaaccacaaatgtagaaatgaatccatagacaatgctgaaactttaaaaaatggaggcaatgtggctggtaaagacaagataatccaaaagaaggaaaacctcctcctgaattggcccttaatgtcatcggtcattgtttattgtgttttcgcacttcatgatattgcgtatcaagaggttttctcgatatgggctgtgagtcctcaaaggctgggggggttgaactttacaactgatgatgttggtaatgttctttcaatatcaggtcttgcgcttatcatttaccaacttatcatatacccatatgtggaaaaagctagtggacctattgttattggtcgcatctccgggatgatatccataccacttttgcaaagttaccccttcatagcattgttgtctggcttagcactatacatagtgttaagtgttgcttcaattctgaagaatcttctgtctgtaaccattaatactggtctgttccttctacaaaaccgagcagtggaacaacaccagaggggggcagctaatggcatttccatgacaggcatgtctctattcaaatctattggccctgctacaggtggtgcaatattaacttggtcacaaaagcggatggatgcttcattcctcccaggcacccatatggtcttctttgtcttgaacatagttgaaggacttggaatactaatgttgttcaaaccattccttgttgaaaagaagaaaacgcactccaatcagttacattgataaattagaaaaaagctcagttgtgtgaaattatgcaaaatttcctataatcagatttgtgagaaacaaatataaatgtggaataatcacacaattgataatggagtttagccaattatgcctatgtctctaggctgctgcagaccttttttattgaaagagaaaaaaatgtaaaataggtgtttataaaacactcaacccacaacccaattatacccaaaaaaataagtataatattttctatttgtgaaggttttctccctctcattgttattctctctcattattggaatatatataataaagattccaaggggtgctatttatataggtatgtagaagttatctttcatacat

SEQ ID NO: 5379 - DNA, 1741 bp, Vigna unguiculata
  misc_feature (41)..(41): n is a, c, g, or t
gtttgaacagtgcatgttgtagtttaggaaagagggtcatntcagaaataatggaagaggagaaaggtaagcagccattgttggagaggaagaagtactatgagaactgtcccggttgcaaagtggataaagcaaaagagttgagtgagggacagggtgtgccttttaccgagctttttatcatgtggatggtggccttgagtgctgcactgccaatatcatctctcttcccgttcctctatttcatggtaagggactttaatatagcaaaaacagaagctgatattagtacttatgctggttatgtgggttctgtattcatgcttggaagatgtttgacatcttttctgtggggaactatagcagatcgttttggtcgaaaacctgctatacttataggggttacttcagttgtcattttcaacacattatttggcctcagcacaagtttttggatggctattatcacgagatttcttctgggaagtttcaatggttatctaggaccagtgagggcctatgcttctgaactttttagagaagaacaccaggctctaggactgtcaactgtaagctcagcttggggcataggtttaataattggcccatcattgggaggctatttggctcagccagtagagaagtacccaaatatttttccaaaggattccttttgggataagtttccatacttcttgcccaacctcataacatcaacatttgcctttgtagtagcaattggctgcatctggattccagaaacacttcacaatcacaaatgtggcaatgaatccacagaggatgctgaagctttagaaaatggaagtggtggcacagacaatgaaaagataacaaaaaagaatgaaaaccttttcctgaattggcccttaatgtcatctgtcattacttattgtgtcttctcacttcatgatatggcttatcaagagattttctccttatgggcagtgagtcctcaaaagctcgggggtttgaactttaccactaatgatgttggtaacattctttcagtatcaggtcttgcacttataatttaccaacttgccttgtacccttttgtgcaaagaaaaagtggagctattggtagtgcccgcatttcagctatgttatccatacctcttttgcaaagctaccccttcattgcattgttctcaggcttagcactatacgtagggttgagtactgcttcaattctcaagaatattctgtctatcactatcgtgaccggtttattccttcaacaaaaccgattagtggaacaacaccaaagaggtgctgctaatggcatttctatgacaggcatgtctctgttcaaagctattggccctgcaacaggtggtgcagtactagcttggtcagaaaaacggatggattcttcattcctgccaggcacacatatggtgttctttgtcttgaacatagtagaagcagttggattattaatgatgttcaaaccattccttggtgagaaaaagaaacctgatcaattacagtgatagcaatcaattttgcacaaggcaaatggcatcactatgagctattgttgtctgttattggagtaacaactgatggtaaacaagctaggtacaacaagtttgacatcattgattggaattattgattatgaacaaatattgtgtttttatttcaattcaaaatactttccatacatacatatatatatatatatatatatatatatatatatatatatatatatata

SEQ ID NO: 5380 - DNA, 1914 bp, Solanum phureja
cctcagagttgtttagcttcttccacttgccacctgactctttgtccttctttttcacccccttcagtaagtagcacacagaaaaccagaaaaagaaaaaaagaatgttcaagaaaatgtacagctgctacaacaccaaaatgggcttgttcagattttttgcttccaccatacttgtactattcttgctttcttccttcagcttccattcaacagatgcctttgatccacttgatccaaatggaaacattactataaaatgggatgtgatcagctgggcacctgatggatatgtggctgtggtgacaatgtacaactttcaacaatataggcatattcaagcaccgggctggagtttgggctggacatgggcaaagaaggaagtcatatggaccatgatgggaggtcaaacaacagagcagggagattgttcaaaatataaaggaaatattccacattgctgtaagaaagatccaacagttgttgacatgctgcctggaactccttacaaccaacagattgcaaattgttgcaagggaggagtgatcaactcatggggacaagatccggccaacgctgttagctcatttcaaattagtgttggtgctgctggaacaaccaataaaacagtgcgagtacctaagaacttcacattaaaggctccagggcctggttatacttgtggacctgctaaaattgtaaaaccgactaagttcgtctctgcagatgggagaagagtgacacaggctatgatgacttggaatgtcacatgcacttactcacagttcctagctcaaaagactcctacatgttgtgtgtccctctcatccttctacaacgacacgattgtgccctgcccgacgtgcacttgtggctgtcagagtaatggcactcagcgtgggagttgtgtagatccagaaacgccacacctagcttcagttgtatcagaccatgggaagaacaattacgttcctttggtacaatgcacaaagcatatgtgcccaattaggattcattggcatgtgaaactcaattacaaggaatattggagagtgaagatcactataacaaacttcaattaccggatgaattatacacaatggaacttagttgtccaacatccaaactttgacaacctcactacattattcagctttaattacaagtcactaactccgtatggatcaatcaatgacactgctatgctatggggtgtgaaattctacaatgatctgctcatgcaagcaggtccttcaggaaatgtccagtcagagctactattccggaaggatgcatcaactttcacttttgagaagggttgggcttttcctcacagaatttatttcaatggagacaactgtgtgatgcctcctcctgatgcatatccatacttgccaaatgctggttcacgatgggaggtgtctctgattacattagtggtgacactgatagcttcgatggcagttgtccttacatacatttaaaaaattatcatctgtgtatagtgcaatgtatatctgttttagtttgttatctctgggttgacactcgtgctattgccaagaatggcgtgtgagttggtatggctgagcaatggccatgcgttctaactggtggtgtgcatatattagtttcatgctaaaagggctgctaccatagtctcctttagcagttgtgtcacatggtttttgtattttgtaggtttgtcaagttcatagcgtgtctaggcagtatggaagtaaagaccaattcagaaacacatgtaactgcttatattagatactttgatactcttgttttctctactaatgtcttgtaatggctttctacattgtaaaaaagatactttgcagcaggagttgcattttgttcgatctgcggtggtgcgattttgctgtatatctcagctgaggt

SEQ ID NO: 5381 - DNA, 1843 bp, Solanum lycopersicum
tcttaagaaacattattaaagtccactttagcttcaatagactaagttgccatgtgagctcacttccagctgccactcaccgccaagatttttctcctcctcttttactctcattttagcagatcttgaacagacattgcctacagagaaaatctgctgcagctaaagaagggtctatggagttcttcagatctaccatattattagtcttcttgttgtcatgcttcagcttttcagcaacagatgctttcgacgcacttgaccccaatgggaacatcacaatcaaatgggatgtcatcagctggacacctgatggatatgttgctgttgtgactatgtttaacttccaacaatacagacatattcaagcaccaggttggacgttgggatggacatgggcgaagaaggaggtgatatggggcatgatgggagctcaaacaacagagcaaggagattgttcaaaatttaaaggaaacattccccattgctgcaagagggatccaaccgtcgtcgatttactgcccggaactccttacaatcagcagattgcaaattgctgtaagggaggagtgatcaactcatggggacaagatcctgaaactgccgttagctcattccaagtcagtgttggtgcagctgggacaacaaataaaacagttagagttcctaagaatttcacccttaaggcaccagggcctggttatacttgtggacccgctaaagttgttaaacccaccaagttctctagtggtgatgggagacgaataacacaagccatgatgacttggaatgtcacatgcacatactcacagttcctagctcaaaagactcctacatgctgtgtctccctttcatccttctacaatgacaccattgtaccgtgtccaacatgcacttgtggctgccagaagaatggtacccagcatggaaattgtgtagatcaagacgaaccacacttagcttcagttgtttcaggccttggaaaaaacaattatgctcctttggttcagtgcactagtcatatgtgccctattagaattcactggcatgtgaaactcaactacaaggagtattggagggtgaaggtcactataactaacttcaattacaatatgaattatacgcaatggaacttagttgtccagcatcccaatttcgacaacctcactcagttattcagctttcattacaagtcattaactccttatggagcaataaatgacactgctatgctctggggtatgaaattctacaacgatctgctcatgcaagctggtccattaggaaatgtccagtctgagcttctattccgcaaggatatgtcgactttcacttttgagaaggggtgggctttcccacacagagtttatttcaacggtgataactgtgtcatgcctcaacctgattcatatccgtatatgccaaatgctggtactgtatggaaggtttcttcgctaaagctagtggtgacgttgatcctctctatggcattcttctttgcaactgtctagaaaccggataaacaccttgttactgtctcagtaagttatctttgggttgattcgcttgcacagccgaggaaactgattggagagttagatatctgagcagagtgatgctgaccattattatggatattcgggtatgcttgttcttgaagggctggtgaaaatggtgccataattttcattcagcagtttgtatcaaatgtttttttctactgtggtaaggttatttttgttatgtagaatttctttagttcacagttatatcagggttgtatgagaataaagactattcataaacagatagagttaattatatgatattctttagttctctt

SEQ ID NO: 5382 - DNA, 1879 bp, Solanum lycopersicum
ctaagttgccatgtgagctcacttccagctgccactcaccgccaagatttttctcctcctcttttactctcattttagcagatcttgaacagacattgcctacagagaaaatctgctgcagctaaagaagggtctatggagttcttcagatctaccatattattagtcttcttgttgtcatgcttcagcttttcagcaacagatgctttcgacgcacttgaccccaatgggaacatcacaatcaaatgggatgtcatcagctggacacctgatggatatgttgctgttgtgactatgtttaacttccaacaatacagacatattcaagcaccaggttggacgttgggatggacatgggcgaagaaggaggtgatatggggcatgatgggagctcaaacaacagagcaaggagattgttcaaaatttaaaggaaacattccccattgctgcaagagggatccaaccgtcgtcgatttactgcccggaactccttacaatcagcagattgcaaattgctgtaagggaggagtgatcaactcatggggacaagatcctgaaactgccgttagctcattccaagtcagtgttggtgcagctgggacaacaaataaaacagttagagttcctaagaatttcacccttaaggcaccagggcctggttatacttgtggacccgctaaagttgttaaacccaccaagttctctagtggtgatgggagacgaataacacaagccatgatgacttggaatgtcacatgcacatactcacagttcctagctcaaaagactcctacatgctgtgtctccctttcatccttctacaatgacaccattgtaccgtgtccaacatgcacttgtggctgccagaagaatggtacccagcatggaaattgtgtagatcaagacgaaccacacttagcttcagttgtttcaggccttggaaaaaacaattatgctcctttggttcagtgcactagtcatatgtgccctattagaattcactggcatgtgaaactcaactacaaggagtattggagggtgaaggtcactataactaacttcaattacaatatgaattatacgcaatggaacttagttgtccagcatcccaatttcgacaacctcactcagttattcagctttcattacaagtcattaactccttatggagcaataaatgacactgctatgctctggggtatgaaattctacaacgatctgctcatgcaagctggtccattaggaaatgtccagtctgagcttctattccgcaaggatatgtcgactttcacttttgagaaggggtgggctttcccacacagagtttatttcaacggtgataactgtgtcatgcctcaacctgattcatatccgtatatgccaaatgctggtactgtatggaaggtttcttcgctaaagctagtggtgacgttgatcctctctatggcattcttctttgcaactgtctagaaaccggataaacaccttgttactgtctcagtaagttatctttgggttgattcgcttgcacagccgaggaaactgattggagagttagatatctgagcagagtgatgctgaccattattatggatattcgggtatgcttgttcttgaagggctggtgaaaatggtgccataattttcattcagcagtttgtatcaaatgtttttttctactgtggtaaggttatttttgttatgtagaatttctttagttcacagttatatcagggttgtatgagaataaagactattcataaacagatagagttaattatatgatattctttagttctcttatttctattcagtatatcactatgtaaccacttctattttgtaaaaaaagattatttgctacacggttttcatatgc

SEQ ID NO: 5383 - DNA, 1947 bp, Nicotiana tabacum
  misc_feature (2)..(2): n is a, c, g, or t
  misc_feature (101)..(101): n is a, c, g, or t
  misc_feature (219)..(219): n is a, c, g, or t
  misc_feature (760)..(760): n is a, c, g, or t
  misc_feature (889)..(889): n is a, c, g, or t
  misc_feature (1609)..(1609): n is a, c, g, or t
  misc_feature (1946)..(1946): n is a, c, g, or t
gnatacggcacgaggctcaccgccaagatttttctcctttctcttttaacccatatttcagtagcatatttagcagatcttaagcagagagtgtcccaaangaaaaaagcacaagaaaatctgtacaagctacaaggggcctatggagttcttcagatctcttcctagatttactgctactgctgttttattagtcttcttgctgtcctgcttcagctntaaatcaacagatgccttcgacccacttgatcccaacgggaacatcacaataaaatgggatgtcatcagctggacaccggatggatatgttgctgttgtgactatgttcaacttccagcaatataggcatattcaagcaccaggctggactttgggatggacttgggcgaagaaggaggtaatatggaacatgatgggagctcaaacaacggagcaaggagattgttcgaaatttaaaggaaacattccccattgctgcaagaaggatccaaccattgttgacttactgcccggaactccttacaaccagcagattgcaaattgctgcaagggaggagtgatcaactcatggggacaagatactgcaactgctgttagctcattccaagtcagtgtaggtgctgccggaacaaccaataaaacagttagagttcctaagaacttcaccttaaaggcaccagggcctggttatacttgtggacccgctaaaattgttaaacctactaagtttgttactcaagatgggagacgagtaacacangccatgatgacttggaatgtcacatgcacatactcacagttcctagctcaaaaaactccgacatgctgcgtctctatctcatccttctacaatgacacaattgtaccgtgcccaacatgtacttgtggntgccagaagaatggcactcagcatggaaattgcgtagatcaagacgaaccgcacctagcttcagttgtttctgatcatggaaagaagaatacgtatgctcctttggttcagtgcacgaatcatatgtgccctattagaattcactggcatgtgaaactcaactacaaggagtattggcgagtgaaggtcactataactaacttcaattacaatatgaattatacacaatggaacttagttgtccagcatcccaactttgacaacctgactcagttattcagcttcaattacaagtctttaacaccttatggagcaataaatgacactgccatgttatggggaatgaaattctacaacgatctgctcatgcaagcgggtcctttaggaaatgtccagtcagagcttctattccgcaaggatttatcgacttttacttttgacaaggggtgggcttttccccgcagagtttacttcaatggtgataactgtgtcatgccgcctcctgattcatatccatatatgccgaatgttggtactgtatggaaggtttcttcactaaagttagtggtgacgctgatgctctctacagccttcttctttgcatctatttagaagcctctcgtttggataaatgccaagtgcctgtctcagtaagttatctttggattgattcactcccactgctgataaaactgattggagtactgcctgagcagtgangtcgaccattcttatggattcgggtaatacatgttcgaggcaaatattagtttcatctgcatactcgtaagggctggtggaatggctgccataatttccttcagcagttgtatccaatgtgtttctactgtggtgtattcatttttgttatgtagatttctcaaattcgtagttatctcagatttgtatgagaataaagaccatttacaaacagatagagttaaattatttgatattctttagtgctctatttttctgtgccatcaccatgtaaccactttctacattgtaaaaaagattctgtgtttttccagcgtttatagtacataccataatna

SEQ ID NO: 5384 - DNA, 1826 bp, Solanum tuberosum
ccagctgccactcaccgccaagattttctcctcctttttactctcattttctacaccattttagcagatcttgaacgtacattggttacaaaaacctcgaagaaaatctgttgcagctacagaggggtatatggagttcttcagatctaccatattattaggcttcttgctgtcatgcttcagcttttcagcaacagatgccttcgatgcacttgatcccaatgggaacatcacaattaaatgggatgtcatcagctggacacctgatggatatgttgctgttgtgactatgttcaacttccaacaatatagacatattcaagcacctggttggacgttgggatggacatgggcgaagaaggaggtgatatggggcatggtgggagctcaaacaacagagcaaggagattgttcaaaatttaaaggaaacattccccattgctgcaagagggatccaacagtcatcgatttactacccggaactccttacaatcagcagattgcaaattgctgtaagggaggagtgatcaactcatggggacaagatcctgaaactgccgttagctcattccaagtcagtgttggttcagcaggaacaacgaataaaacagttagagttcctaagaacttcacccttaaggcaccagggcctggttatacttgtggacccgctaaagttgttaaacccactaagttccttactaatgatgggagacgagtaacacaagccatgatgacctggaatgtcacatgcacatactcacagttcctagctcaaaaaactcctacatgctgtgtctccctttcatccttctacaatgacaccattgtaccgtgcccaacatgcacttgtggctgccagaagaatggcactcagcatggaaattgtgtagatcaagacgaaccacacttagcttcagttgtttcaggccttggaaaaaacaattatgctcctttggttcagtgcacaagtcatatgtgccctattagaattcactggcatgtgaaactcaactacaaggagtattggagggtgaaggtcactataactaacttcaattacaatatgaattatacgcaatggaacttagttgtccagcatcccaactttgacaacctcactcagttattcagctttcattacaagtcattaactccttatggagcaataaatgacactgctatgctctggggtatgaaattctacaacgatctgctcatgcaagctggtccactaggaaatgtccagtctgagctgctattccgcaaggatatgtcgactttcacttttgagaaggggtgggcttttccacacagagtttatttcaatggtgataattgtgtcatgccacaacctgactcatatccatatatgccaaatactggtactgtatggaagttttcttcgttaaagctagtggtgacgttgatgctctctatggcattcttctttgcaactgtctagaaaccggataaacaccaagttcctgtctcagtaagttatctttgggttgatttacttgcacagccgaggaaactgattggagagttagatgtctgagcagagtgatgctgaccatttttatggattcgggtatatgcttgttgaagacgaattttaatttcctctgtatgctgtttgaagggctggtgaaaatggtgccatgattttcattcagcagtttgtatcaaatgtttatctactgtggtaaagtcatttttgttatgtagattttcttaagttcacagttatatcagggttgtatgagaataaagactattcagaaacagatagagttaattatatgatattttttagttctctt

SEQ ID NO: 5385 - DNA, 1895 bp, Solanum tuberosum
ccagctgccactcaccgccaagattttctcctcctttttactctcattttctacaccattttagcagatcttgaacgtacattggttacaaaaacctcgagaaaatctgttgcagctacagaggggtatatggagttcttcagatctaccatattattaggcttcttgctgtcatgcttcagcttttcagcaacagatgccttcgatgcacttgatcccaatgggaacatcacaattaaatgggatgtcatcagctggtcacctgatggatatgttgctgttgtgactatgttcaacttccaacaatatagacatattcaagcacctggttggacgttgggatggacatgggcgaagaaggaggtgatatggggcatggtgggagctcaaacaacagagcaaggagattgttcaaaatttaaaggaaacattccccattgctgcaagagggatccaacagtcatcgatttactacccggaactccttacaatcagcagattgcaaattgctgtaagggaggagtgatcaactcatggggacaagatcctgaaactgccgttagctcattccaagtcagtgttggttcagcaggaacaacgaataaaacagttagagttcctaagaacttcacccttaaggcaccagggcctggttatacttgtggacccgctaaagttgttaaacccactaagttccttactaatgatgggagacgagtaacacaagccatgatgacctggaatgtcacatgcacatactcacagttcctagctcaaaaaactcctacatgctgtgtctccctttcatccttctacaatgacaccattgtaccgtgcccaacatgcacttgtggctgccagaagaatggcactcagcatggaaattgtgtagatcaagacgaaccacacttagcttcagttgtttcaggccttggaaaaaacaattatgctcctttggttcagtgcacaagtcatatgtgccctattagaattcactggcatgtgaaactcaactacaaggagtattggagggtgaaggtcactataactaacttcaattacaatatgaattatacgcaatggaacttagttgtccagcatcccaactttgacaacctcactcagttattcagctttcattacaagtcattaactccttatggagcaataaatgacactgctatgctctggggtatgaaattctacaacgatctgctcatgcaagctggtccactaggaaatgtccagtctgagctgctattccgcaaggatatgtcgactttcacttttgagaaggggtgggcttttccacacagagtttatttcaatggtgataattgtgtcatgccacaacctgactcatatccatatatgccaaatactggtactgtatggaagttttcttcgctaaagctagtggtgacgttgatgctctctatggcattcttctttgcaactgtctagaaaccggataaacaccaagttcctgtctcagtaagttatctttgggttgatttacttgcacagccgaggaaactgattggagagttagatgtctgagcagagtgatgctgaccatttttatggattcgggtatatgcttgttgaagacgaattttaatttcctctgtatgctgtttgaagggctggtgaaaatggtgccatgattttcattcagcagtttgtatcaaatgtttatctactgtggtaaagtcatttttgttatgtagattttcttaagttcacagttatatcagggttgtatgagaataaagactattcagaaacagatagagttaattatatgatattctttagttctcttatttttacacagttatcaccatgttaacccacttcttctattttgtaaaaaaaggtttcattttgttcgc

SEQ ID NO: 5386 - DNA, 1829 bp, Solanum phureja
tcttaagagactttattaaagtccactttaacttcaataagccatgtgagctcacttccagctgccactcaccgccaagatttttctcctcttttactctcattttctgtaccattttagcagatcttgaacagtcattggctaaaaaaccctcaagaaaatctgcagcagctacagaggggtctatggagttcttcagatctaccatattattagtcttcttgctgtcatgcttcagcttttcagcaacagatgccttcgatgcacttgatcccaatgggaacatcacaattaaatgggatgtcatcagctggtcacctgatggatatgttgctgttgtgactatgttcaacttccaacaatatagacatattcaagcacctggttggacgttgggatggacatgggcgaagaaggaggtgatatggggcatggtgggagctcaaacaacagagcaaggagattgttcaaaatttaaaggaaacattccccattgctgcaagagggatccaaccgtcatcgatttactacccggaactccttacaatcagcagattgcaaattgctgcaagggaggagtgatcaactcatggggacaagatcctgaaactgccgttagctcattccaagtcagtgttggttcagcaggaacaacgaataaaacagttagagttcctaagaacttcacccttaaggcaccagggcctggttatacttgtggacccgctaaagttgttaaacccactaagttctttactaatgatgggagacgagtaacacaagccatgatgacctggaatatcacatgcacatactcacagttcctagctcaaaaaactcctacatgctgtgtctccctttcatccttctacaatgacaccattgtaccgtgcccaacatgcacttgtggctgccagaagaatggcactcagcatggaaattgtgtagatcaagacgaaccacacttagcttcagttgtttcaggccttggaaaaaacaattatgctcctttggttcagtgcacaagtcatatgtgccctattagaattcactggcatgtgaaactcaactacaaggagtattggagggtgaaggtcactataactaacttcaattacaatatgaattatacgcaatggaacttagttgtccagcatcccaactttgacaacctcactcagttattcagctttcattacaagtcattaactccttatggagcaataaatgacactgctatgctctggggtatgaaattctacaacgatctgctcatgcaagctggtccactaggaaatgtccagtctgagctgctattccgcaaggatatgtcgactttcacttttgagaaggggtgggcttttccacacagagtttatttcaatggtgataattgtgtcatgccacaacctgactcatatccatatatgccaaatactggtactgtatggaagttttcttcgttaaagctagtggtgatgttgatgctctctacggcattcttctttgcaactgtctagaaaccggatacacaccaagttcctgtctcagtaagttatctttgggttgattcgcttgcacagccgaggaaaactgattggagagttagatgtctgagcagagtgatgctgaccatttttatggattcgggtatgctgtttgaagggctagtgaaaatggtgccatgattttcattcagcagtttgtatcaaatgtttttctactgtggtaaagtcatttttgttatgtagattttcttaagttcacagttatatcagggttgtatgagaataaagactattcagaaacagatagagttaattatatga

SEQ ID NO: 5387 - DNA, 1525 bp, Triphysaria pusilla
  misc_feature (1511)..(1511): n is a, c, g, or t
aacactaggcactctgtttttctccctccactctctctctctagatcttaaatctcactgatcaagaaaatctgctactgagtggaatggaaatgtgcttcagatctctgttgagagtcacttataccaccatcttgctgtttttcttggtttcatgcttctccattacttcaacagatgcttatgatgcccttgatccaaatggaaatatcacaataaaatgggatgttatcagttggacagctgatggctatgttgctaccgtcacgatgttcaactttcaacaataccgtcacatccaagctccgggctggactttgggctggacttgggccaaaaaggaagtgatttggagcatgatgggagcccaaaccaccgagcaaggagattgttcgaaattcaaagggaatattccacattgttgtaagaaagatccgacagttgtcgacttattgcccgggacaccttacaatcaacagattgctaattgttgtaaaggcggtgtgattaattcttttgctcaagatccggataattccgctagctcgtttcaagttagcgttggctcagccgggaccactaataaaacggttagggtgccaaaaaacttcaccttgaatgcacctggcccggggtatacttgtgggcccgcgaaaatcgtgaagcctactaagtttgttacgcaagatggacgaagagttacacaagccatgatgacgtggaatattacgtgcacatattcacagttcttggctcaaaaaactccgacttgctgtgtttcactctcgtctttttataatgacacaattgtcccttgcccgacttgtacttgtggatgccaaaataatattactcacccgggaagctgtgtgaatccagattcgccatacattgcctcggttgtttcggatcatggcaaggcaaatagttttgcgcctctagtccaatgtacgtctcatatgtgccctattcgagtccattggcacgtaaaggtaaactacaaggaatattggcgagtaaaagttactataacaaacttcaattaccgaatgaattacacacaatggaacttagtcgctcaacatcccaacttcgataatcttacacagcttttcagcttcaactataagccgcttaatccgtatcaaaatataaatgatactgcaatgttgtggggtgtgaaattctataacgactttctaaaccaagcgggcccactaggaaacgtacagtcggagcttctatttcgaaaggacaaatccactttcacgttcgaaaagggatgggcttttccgaggcgaatctacttcaatggcgataattgcgttatgccacctcctgacgcgtatccttatttaccgaacatcggattacgagaaaaaatgtccatgtttatgttaacaatcactctgttgtcatctacgatattctactttggatgtatttgagaatcttacatcgtcaaaaatattccgaacataattgtatttgtataacttgtaatttgtagngatttatgctgaca

SEQ ID NO: 5388 - DNA, 1597 bp, Triphysaria pusilla
ctctctctagatattagttgcagatcttaaatctcactgatcaagaaaatctgctactgagtggaatggaaatgtgcttcagatctctgttgagagtcacttataccaccatcttgctgtttttcttggtttcatgcttctccattacttcaacagatgcttatgatgcccttgatccaaatggaaatatcacaataaaatgggatgttatcagttggacagctgatggctatgttgctaccgtcacgatgttcaactttcaacaataccgtcacatccaagctccgggctggactttgggctggacttgggccaaaaaggaagtgatttggagcatgatgggagcccaaaccaccgagcaaggagattgttcgaaattcaaagggaatattccacattgttgtaagaaagatccgacagttgtcgacttattgcccgggacaccttacaatcaacagattgctaattgttgtaaaggcggtgtgattaattcttttgctcaagatccggataattccgctagctcgtttcaagttagcgttggctcagccgggaccactaataaaacggttagggtgccaaaaaacttcaccttgaatgcacctggcccggggtatacttgtgggcccgcgaaaatcgtgaagcctactaagtttgttacgcaagatggacgaagagttacacaagccatgatgacgtggaatattacgtgcacatattcacagttcttggctcaaaaaactccgacttgctgtgtttcactctcgtctttttataatgacacaatcgtcccttgtccgacttgtacttgtggatgccaaaataaccttactcaaccgggaagctgtgtgaatccggattcgccgtacctttcctcggttgtttcggatcacggcaagaaaaatagttttacgcctttagtccaatgcacgtctcatatgtgccctattcgtgtccattggcacgtgaaagtaaactacaaggaatattggcgtgtaaaggtcaccataacgaacttcaattacagaatgaattactcacaatggaatttagtcgctcaacatccgaatttcgacaatttgacacaactattcagcttcaactacaagccgctcaatccgtaccaaaatataaatgatacagcaatgttatggggtgtgaagttttacaacgactttttaagccaagcgggcccactaggaaacgtgcagtcggagcttttattccaaaaggagaaatctactttcacgttcgaaaagggttgggcttttccgagaagaatctactttaatggagataactgtgttatgccgcctcctgacgcgtatccgtatctaccaaacgccggtataagagaaaatgcatcactggttatgctaatgatcactctgttcttatccgttatgttccattttgcgtgtgtttgagttcaaatataccgagtttctgttgtaacttatgtttatggttattatttatgacgattttgtccttaaaggtgcttaacatgtattgctacattgccctgtactaatgttcataacttttggagtttctgtttatataaatgtacttgaggcaaaaaaaaaaaaaaaaa

SEQ ID NO: 5389 - DNA, 1913 bp, Populus trichocarpa
ttgacagccaataattaagtatttaacctctctcggattttttatactcctacttgtcttccacagtcgtctctttctctctccctctctctgctttcatgcagatcttgagctgaaccagaggcataagcatcccattttcaacacatcaagaaatggagccttcttcctcattagtcactgtatccgttaccaagatttccgcttttaccattttgcttcttttcttgatttcgtgctcaactctcacttctacagaagcgtatgacgctcttgatccaaatgggaatatcactatcaaatgggacgtaatacagtggactccagatggctatgttgcagttgttacaatgtataacttccagcaatatcgccacattcaggcgccgggttggactttggggtggacatgggcaaagaaggaagtgatctggaacatgatgggagcccaaaccaccgaacaaggcgattgttcaaaattcaagggaaacataccgcattgctgtaagaaggatccaactgttgtggatttgttgccaggaaccccttacaaccagcagattgccaattgctgtaaagggggagtgataaattcgtgggcacaggacccagccaatgcggtgagttcctttcaaattagtgttggtgcagctggaaccactaacaaaactgttagggtgccaaagaacatcaccttgaaagcaccagggcctggatatacttgtgggccggcaaagattgtgagaccaactaaatttatatcggctgacaaaaggagaatcactcaagctttaatgacctggaacattacttgcacttattcacaattccttgctcaaaagacacctacctgttgtgtttctctctcctccttttataatgacacaatagtaagctgccctacttgtgcttgtggctgtcaaaatactactggagctgggagtggaacttgtgtgcacccggacactccacacttagcctcagttatttcacctcctggaaaatctgacaatacacctctggtccagtgtaccagccatatgtgtccaatccgagtccactggcatgttaaactcaattacaaggagtattggcgggtgaaggttacagtcaccaatttcaattaccgaatgaactactcactgtggaatatggttgtgcaacaccccaactttgataacctcaccaagatttttagctttcagtacaagtcactaactccttacgaagggctaaatgatacagccatgttatggggtgtcaagttctacaatgattttctctcacaagctggtcctctcgggaatgttcagtcagagctactgttccgaaaggacaaatcaactttcacttttgaaaagggatgggctttccctaggaggatttacttcaatggtgataattgtgtcatgccacccccagatgcctacccatggttaccaaatgatagttctcgcccagttatctctctacttcttccagtcatgacattatttttgtctatggcattcctatttgctcatgtgtgatgaatcatgtctatgccagtctttaaactatctgttgttctagcaatcaagaaatcccatcttgtttgagttacattgctgggatttaagggaatccagtcaaaggcttgaatgtgtaagatcagcaagttatggcaatgcaagtggatttggagcaccataaccatgttaccaccaatatgttaattggcaattagaaatcttttgtcacgttctcttttttatattgggaattagtggttcttctacatgtgtatttatgttgtacactcgatcattttgtttgtggaatatcaacatattatttgttcgtatccttgtaataaggaactccacgaagaatttacagctgataaatggatttttattcgtagttttttttga

SEQ ID NO: 5390 - DNA, 1913 bp, Populus trichocarpa
ttgacagccaataattaagtatttaacctctctcggattttttatactcctacttgtcttccacagtcgtctctttctctctccctctctctgctttcatgcagatcttgagctgaaccagaggcataagcatcccattttcaacacatcaagaaatggagccttcttcctcattagtcactgtatccgttaccaagatttccgcttttaccattttgcttcttttcttgatttcgtgctcaactctcacttctacagaagcttatgacgctcttgatccaaatgggaatatcactatcaaatgggacgtaatacagtggactccagatggctatgttgcagttgttacaatgtataacttccagcaatatcgccacattcaggcgccgggttggactttggggtggacatgggcaaagaaggaagtgatctggaacatgatgggagcccaaaccaccgaacaaggcgattgttcaaaattcaagggaaacataccgcattgctgtaagaaggatccaactgttgtggatttgttgccaggaaccccttacaaccagcagattgccaattgctgtaaagggggagtgataaattcgtgggcacaggacccagccaatgcggtgagttcctttcaaattagtgttggtgcagctggaaccactaacaaaactgttagggtgccaaagaacatcaccttgaaagcaccagggcctggatatacttgtgggccggcaaagattgtgagaccaactaaatttatatcggctgacaaaaggagaatcactcaagctttaatgacctggaacattacttgcacttattcacaattccttgctcaaaagacacctacctgttgtgtttctctctcctccttttataatgacacaatagtaagctgccctacttgtgcttgtggctgtcaaaatactactggagctgggagtggaacttgtgtgcacccggacactccacacttagcctcagttatttcacctcctggaaaatctgacaatacacctctggtccagtgtaccagccatatgtgtccaatccgagtccactggcatgttaaactcaattacaaggagtattggcgggtgaaggttacagtcaccaatttcaattaccgaatgaactactcactgtggaatatggttgtgcaacaccccaactttgataacctcaccaagatttttagctttcagtacaagtcactaactccttacgaagggctaaatgatacagccatgttatggggtgtcaagttctacaatgattttctctcacaagctggtcctctcgggaatgttcagtcagagctactgttccgaaaggacaaatcaactttcacttttgaaaagggatgggctttccctaggaggatttacttcaatggtgataattgtgtcatgccacccccagatgcctacccatggttaccaaatgatagttctcgcccagttatctctctacttcttccagtcatgacattgtttttgtctatggcattcctatttgctcatgtgtgatgaatcatgtctatgccagtctttaaactatctgttgttctagcaatcaagaaatcccatcttgtttgagttacagtgctgggatttaagggaatccagtcaaaggcttgaatgtgtaagatcagcaagttatggcaatgcaagtggatttggagcaccataaccatgttaccaccaatatgttaattggcaattagaaatcttttgtcacgttctcttttttatattgggaattagtggttcttctacatgtttatttatgttgtacacttgatcattttgtttgtggaatatcaacatattatttgttcgtatccttgtaataaggaactccacgaagaatttacagctgataaatggatttttattcgtagttttttttga

SEQ ID NO: 5391 - DNA, 1907 bp, Manihot esculenta
ggagctgaagcactctctctcccatgtgagaagaaagtccacaccaatttccaccgtcgtccctctctttttctctctctctctgttatgcagatcttgagctaagccagtcgtaaacatcagtgttgcatcacgaatctggcaatggattcccacttctcatcactcactggatccattactaagctctgctccttcaccattttgcttctcttcttgctttcttgctccactttcactcctacagatgcctatgatgctcttgatccaaatggtaatatcactatcaaatgggacgtaataagctggactccagatggctatgttgcagtcgttacaatgtacaacttccagcaataccgccacattcaagctccaggttggacattgggttggacatgggcaaaaaaggaggtaatctggagcatgatgggagcccaaactacagagcaaggggattgttccaagtacaaaggaaatgtcccccattgctgtaagaaggatcctaccgttgtggatttattgccaggaactccttacaaccagcagattgcaaattgctgcaaaggaggagtaataaactcgtgggcacaggaccctgctactgcagtaagctccttccaagttagtgtaggtgctgctggaacctcaaacaaaacagttagattgccaaagaacttcaccttgaaagcaccagggcctggatacacttgtgggccagcaaagattgtgagaccaaccaaatttatttcagcagataaaaggagagtcactcaagctttaatgacctggaatgttacttgtacgtattctcaattcctggctcagaagacacccacctgttgtgtttcgctgtcctccttctacaatgacacaatagtaggttgtccaacttgtgcttgtggctgtaaaaacagcacaaatggggggagctgtgtgaatccagacacaccgcatttagcttctgtggttagttcaggcaagaatgacatgtcacctttggtgcagtgtactagccatatgtgtccaatccgagtccattggcatgttaagctcaattacaaggagtattggcgggtgaaggtcacaattacaaatttcaattaccgaatgaactacacacagtggaatatagttgtgcaacacccgaactttgataatctcacacagattttcagctttcattataaaccactgactccttatgatggattaaatgatactgctatgttatacggagttaagttctacaatgattttctctcacaagctggccctttcgggaatgtacagtcggagctgcttttccgaaaggacaagtcaactttcacttttgaaaagggatgggctttccctaggaggatttattttaatggtgataactgtgtgatgccacctccagatgcctacccatggttgcctaatgacggttctcgtctgagcatatctctacttagtccagtcatgacattcttggtgtatattgtcttctttttggcatgcatgtgatgaagccaaactactaaagctgtctgttcttctaacgatctgtaaacctgatctggcttagcacatacgggaacataaagaaatccagtcttcgggcccagaatttagatctgtcaagtgctgcaagttaatgcaatgcaagtgctcaaggtgcactattgcctggtcttaagtttatgaatcgtcagttagttactttcttcttttttcttttttcccactttttccttatataatttatttgttaagcaaactatattatatttctgtatggttatttgtgtgatacacttaaatcatttcgtctgtagaatatcgatagcatatgtaagtcatttttcgttgtaataagtgaccgtgtgaggaatttatagttgatcaatggatttgttcctgcc

SEQ ID NO: 5392 - DNA, 1507 bp, Orobanche aegyptiaca
attccgttacagatcttgagaggaaaatatctgcaactaaaatggaactctgcttcagatctctactgagattcacaattccaactattttgctcatgttattgctctttagctccagcttcacttcaactgaagcatatgatgcacttgatccactcggaaatatcacgataaaatgggacgtcatcaattggacacccgatggctatgtggctgtggtaacgatgttcaacttccaacaataccgtcacatccaagcaccgggctggagtttgggctggtcttgggccaagaaggaggttatatggaccatgatgggtggtcaaactaccgaacaaggcgattgctccaagtataaagggaataccccacattgttgcaagaaagatccgatggttgtcgatttattgcccgggaccccttacaatcaacagattgctaattgttgtaaaggaggggttatcaattcgtgggcccaagatccgactaatgccgcgagctcgttccaagttagtgtcggtgctgccgggaccactaataagacggttagggtccccaggaattttacgttgaaagctcccggccccgggtacacttgtgggcccgcgaaaatcgtgaagccgactagatttgttacgcaagatgggagacgagtgacacaggctatgatgacatggaatgttacatgtacatattcgcagtttctagctcaaaaaactccgacgtgttgcgtctcactctcgtccttctacaatgacactattgtcccttgcccgacttgtacctgtggatgccaaaataaccttactcagccaggaagctgtgtgaatcccgattcgccatatcttgcttcggttgtttcggaacgagggaagagtaataacctggcgcctctggtccaatgcaccagtcatatgtgcccgattcgggtacactggcacgtgaaggtgaactacaaggagtattggcgtgttaaggtcactataacaaatttcaattacaggatgaattatacgcaatggaacttagtcgttcaacatcccaatttcgacaatttgacggagattttcagcttcaactacaggccactaaatccataccagaatataaatgataccgcgatgttatggggtgtcaaattctacaacgacttcctctcgcaagcgggcccgttaggaaatgtccagtcggagcttctattccggaaggacaaaaacacgttcactttcgacaagggttggggttttccgagaagaatctatttcaacggcgataactgcgtcatgccgcctcccgatgcgtatccgtacttaccaaacgccagctggcgcctgaacgtatcatttttggcgctactgatcactctgttatcgtccgtggcgttccattttgcatgtgtttaagaaatcggtcaaatagaagggtgattttcattcgtggcgttttgctaatagggactagagagcaaattggaagaacttatgtacctcagggatgtctcttttag

SEQ ID NO: 5393 - DNA, 1873 bp, Vitis vinifera
ggcctctcaaaagtctatctctcaaactggacttgccatgtgaccttgtgactttgtgagcagaagccagctacacacagcctgcctacaagctcctctccttttcttctctaccttcctcaagtctgctgcagatcttggagtatctcacaagacaatctacacaatctgcagcaacgaaatggggttttgtttgtcactcatcagcagatccatttccagtttctgtggttgcaccattttgcttctttttctgctttcttgctcctgctttacttctacagaagcctatgatgcactggatcccaatggaaatatcacgatcaaatgggatattatgagctggactccagatggctatgttgctgttgtcactatgtacaatttccagcaatatcgtcacattcaatcgccaggatggtcactgcaatggacatgggcaaaaaaggaggtgatatggagcatgttgggaggccaaactacagagcaaggggattgttctagatttaagggaaatgtaccacattgttgtaaaaaagatcctactgttgtggatctattgccaggaactccctacaatcagcagattgcaaattgctgcaagggaggtgtagtcagttcatgggtgcaggatcctgccaatgcagcaagctcattccaggttagtgtaggttcagctggtaccaccaacaaaacagttcgacttcctaagaacttcaccctgaaagcaccagggcctggctatacttgtggacctgcgaagatcgttaaacctactagatttgtgacacaagatggaaggagagtcactcaagctttgatgacatggaatgttacatgcacatattcacaattcctgtctcagaaaacccccacttgctgtgtctcgctctcatctttctacaatgacacaattgtaccctgcccaacatgcacctgtggttgccagaacaacattactcagccagggagctgtgtagaggaagactcgccatatttggcttcagttgtctcaggttctgggaagaatagctatactcctctagtccagtgtacgaagcatatgtgtcccattcgagtccattggcatgttaagcttagctacaaggagtattggcgagtgaaggtcacaattacgaatttcaattacaggatgaattatacacagtggaacttagttgtccagcaccccaactttgataatctgacccagattttcagctttaactacaagtcattgacaccctatgcagctataaatgatactgccatgctatggggggttaagttctacaatgatctgctcatgcaagctggccctcttggaaatgtacagtcagagctactctttcggaaggataaatcaactttcacttttgagaagggttgggctttccctcgaagaatctatttcaatggagataattgtgtcatgcctcctcctgattcctatccgtggttgccaaatgccacctcacggacaagtacctccctacttactctaataatggttctcttgtcagccttgctattgttgaatgcacatgtttaaaattctaccagtggcatagagtaacacttgtcagtcccaaaatttccaaccgaatcagttggacccataaattatggcaacaattgaagtacatatatacgatttgccaatgacttccatctattatgtgcacgatcatttggcaaaacatactttagtttcttttcatgtatgggtaggctgattcctgtgccagtttttgttactcctagctgttgtattgcatacttattaatgtacttaatcatcattttttgtgctttgtaataaaaccaagaaccatttagcaggaaaattaaagctaattactgtttttgtact

SEQ ID NO: 5394 - DNA, 1369 bp, Lotus japonicus
atttgcattttgcagcaaggaaaaatgggattctctttgtcatcaacagcagcaagtacttgcattttgttcttgttcctactctcttgcacttgcttcacttcaacagatgcttatgatccgcttgatcctaatgggaatatcacaatcaaatgggatattataacctggacatcagatggttatgttgcggttgttacaatgaacaacttccaacaatatcgtcatatcgctgcacctggctggtcattaggatggacatgggccaaaaaggaggtaatatggagcatggtgggggggcaggccactgaacaaggggattgttcaaaatttaagggatcgattccacattgctgtaaaaaggaccccacagtagtagatttacttcccggaacaccttacaatatgcaattctcaaattgctgcaaaggtggggtacttagttcatgggcacaagatccaaccaatgcagtagcatcatttcaagtcagtgttggtagagctggaacaacaaataaaactgtcaaagtccccaaaaacttcactttgaaagcaccaggaccaggttatacatgtgggccagcaaaaattgtgaaacccactaaattcattcaaccagataaaaggagggtgactcaagcactcatgacatggaatgtgacatgcacgtattcacaatttctagctcagaaaactcccacttgctgtgtctccctctcatctttttataatgataccatcgtaccctgcccaacatgtgcttgtggttgccagagtaactcatctcgatcagggagctgtatagaggcagatacaccacatttagcatcggttgttgccggttctggaaagaatacacctttggttcaatgcactaggcatatgtgccccgtccgaatacattggcatgttaagcttaactacaaagagtactggcgtgtgaaggtcactattactaattttaattacaaaatgaactattctgagtggaacttggttgctcaacacccgaacttcgacaatctaactcagttattcagtttcaactacaagtcattaactccttatggttcaataaatgatacagcattgctttggggagtgaagttctataatgattttctcaatgaagctggccctagtggtaatgttcagtcagagctactcttccgaaaggacaaatcaacttttacttttgagaagggctgggcttttcctcggaggatctacttcaatggtgacaactgtgttatgccctcgcctgatgcttatccatggttacctaatgctggttctcggcaagaggtttctttgtttgctttagtgatggcctctttggtagctgtggtattatgtttcgcacaggcat

SEQ ID NO: 5395 - DNA, 1699 bp, Lactuca sativa
ggactttctattttaataacgaatcgtcactgatttgtgagagaaagcccgctctactctctttttctctcttacacaaacacgctcgctcaagaaaacgggctggaaacgcaaacggatctagtaaatcttggaaagcagtaatggattactgcttcagatctctcaccagagtatcaatttccaccattcttctcgccatattgctttcttcattcagtttcacttgcacagaagcctatgatgcactcgacccaaatggaaacatcacaatcaagtgggatatcataagttggacacctgatggctatgttgctgttgtgacaatgtataacttccagcaatatcggcacatttcacctccagggtggacattaggttggacatgggctaaaaaggaggtgatatggagcatgatggggagtcaaaccactgaacaaggagattgttcaagatacaaaagtgcaccaccacattgctgcaagaaaactccaactgttgttgatttattaccaggaaccccttacaatcaacaaattgcaaactgctgcaaaggaggtgtcatcaactcgtgggcccaagatcccaacaattatgccagctcattccaggtcagcgtgggtgcagccggaaccactaacaaaactgtcaaaccgcccaagaactttaccttgcttgcacccggtccaggctatacgtgtgggcccgctgttgttggtaaaccaacaaagtttattactccagatggaagaagagtaactcaagccatgatgacatggaacgttacatgtacatattcacagtttcttgctcaaaaaactcccacttgctgtgtatctctctcttctttctacaatgacacaatcgtaccctgcccaacctgcacatgtggatgccaaaacaatattactcaccctggaagctgtgtaaacccaaactcaccatatctagcttcagttgttaatgggcctggtaagaacagcttaacacctctggttcaatgcactaaacatatgtgccctattcgagttcattggcatgtgaagcttaattacaaggaatactggcgtgtgaaagtcacgattacaaatttcaactacaggatgaattactctcaatggaatttggttgttcaacaccccaattttgataaccttactcaaattttcagctttaactacaaaccattgactccttattcttctataaatgatactgctatgttgtggggtgttaagttctacaatgattttctgaatcaagctggaccattggggaatgttcaatcagagttactctttcgtaaagataaatcaacatttacatttgaaaagggttgggcttttccaagaagaatctatttcaatggtgataactgtgtgatgccacctcccgatgcatacccttatctcccaaatgccagctcacgtctaagcttctcgttattcactctattgatggggtctttggtctttttctttgcctttgtttgaggtttaagtagcccttgaagattgtctgcatgtggttcatcttaaacaagaaggtttaagtgtgtaatgtgggtgaattcacctgtttgtcaatgttgtgttacatttttattgtgttgtagagtagttgaagttatagtgttgcttacagttgtataattaaaacccacaagtgataatttaaaacagatattcaattttggtta

SEQ ID NO: 5396 - DNA, 1699 bp, Lactuca sativa
  misc_feature (1076)..(1076): n is a, c, g, or t
  misc_feature (1082)..(1082): n is a, c, g, or t
ggactttctattttaataacgaatcgtcactgatttgtgagagaaagcccgctctactctctttttctctcttacacaaacacgctcgctcaagaaaacgggctggaaacgcaaacggatctagtaaatcttggaaagcagtaatggattactgcttcagatctctcaccagagtatcaatttccaccattcttctcgccatattgctttcttcattcagtttcacttgcacagaagcctatgatgcactcgacccaaatggaaacatcacaatcaagtgggatatcataagttggacacctgatggctatgttgctgttgtgacaatgtataacttccagcaatatcggcacatttcacctccagggtggacattaggttggacatgggctaaaaaggaggtgatatggagcatgatggggagtcaaaccactgaacaaggagattgttcaagatacaaaagtgcaccaccacattgctgcaagaaaactccaactgttgttgatttattaccaggaaccccttacaatcaacaaattgcaaactgctgcaaaggaggtgtcatcaactcgtgggcccaagatcccaacaattatgccagctcattccaggtcagcgtgggtgcagccggaaccactaacaaaactgtcaaaccgcccaagaactttaccttgcttgcacccggtccaggctatacgtgtgggcccgctgttgttggtaaaccaacaaagtttattactccagatggaagaagagtaactcaagccatgatgacatggaacgttacatgtacatattcacagtttcttgctcaaaaaactcccacttgctgtgtatctctctcttctttctacaatgacacaatcgtaccctgcccaacctgcacatgtggatgccaaaacaatattactcaccctggaagctgtgtaaacccaaactcaccatatctagcttcagttgttaatgggcctggtaagaacagcttaacacctctggttcaatgcactaaacatatgtgccctattcgagttcattggcatgtgaagcttaattacaaggaatactggcgtgtgaangtcacnattacaaatttcaactacaggatgaattactctcaatggaatttggttgttcaacaccccaattttgataaccttactcaaattttcagctttaactacaaaccattgactccttattcttctataaatgatactgctatgttgtggggtgttaagttctacaatgattttctgaatcaagctggaccattggggaatgttcaatcagagttactctttcgtaaagataaatcaacatttacatttgaaaagggttgggcttttccaagaagaatctatttcaatggtgataactgtgtgatgccacctcccgatgcatacccttatctcccaaatgccagctcacgtctaagcttctcgttattcactctattgatggggtctttggtctttttctttgcctttgtttgaggtttaagtagcccttgaagattgtctgcatgtggttcatcttaaacaagaaggtttaagtgtgtaatgtgggtgaattcacctgtttgtcaatgttgtgttacatttttattgtgttgtagagtagttgaagttatagtgttgcttacagttgtataattaaaacccacaagtgataatttaaaacagatattcaattttggtta

SEQ ID NO: 5397 - DNA, 1866 bp, Solanum phureja
tgacttcctttatatcggggtcctcattgtatctgccattgatttctcttctctcttctctctctgtttactgcatttaatttttccggcaatggttctgtaaactgcatattttttctgagtggggactaaaaattaaaggcctcttcagtttctgaagttgtctttgcttgttttaaaagtgtgaatggcagaggtctgttttggagttgtagctgaaactgattcatcgtcaccgtgtgaatcaagttcacgggcggtgaggaggaggagaatggagcttcgaaagataaaagtcatcgctggagttactcaacccggaacagagaatggaattaaacgtccaaaattgaaacttatttccggttctgtttcaaggatttgtgataacgctgtggaaagttctagcaccgacgatgatgaagaacaactgagattagtagagacgaaagggtcaccgccaactattattttgacaccatttttgggtccttcgaattctactctccttgttcaagcagtggcttacccaaagtttggcttcgcctctgtttgtggaaggaggagagatatggaagatgcagtcgcaattcatccttcattttgccaaatggaacaaggaaacagtggagaattgcattactttgccgtttacgatggtcatggctgctctcatgtggcgaccaagtgtaaagagaggttacacgagctggtgaaggaggagctggagaacaaagaaggagatcatgaagagtgggagcattcaatgaaccgaagcttcaatcgaatggacaaagaagtgattgaatggaacaatagcgtaaccggcgccacatgccggtgcgaacttcatacaccggaatgtgacgccgtcggttcaacggcggtagtcgcagttgttacgccggacaagattattgtcgcgaattgtggtgattccagagctattctttgccgaaatggcaaagctattcctctttctaacgatcaaaaaccggatcgtccggatgaacttaaccgcatccaggaagctggtggcagagtaatctactgggacggccctcgtgtttcaggcgttttggctatgtcaagagccattggtgataattatttgaagccgtatgtgatctgcgagccagaagtgacggtaactgatcgcacggcggaggatgactgtttgattttagcaagtgacggattatgggacgtagtctcaaacgacactgcatgtggcgttgccggtatgtgcctgaaaaggaatgcatcgccggcgtctacgtcgggaaatggagccgacggcgagatgaattccgaccaatgttgctctgatgcatcgatgcttttgactaaactagcccttgctaggcggagctacgacaacgtcagcgttgtcgtgattgatctgaagcactacacgtagagagcattgaagcttttttttctttcttgcagccttttttggctttatgctttaacatttcagtgtgtttattttgggtggcgttcagttttagattagttctttagacggttgaaattggaagaaaatgacttgggggaaaaaagggattcaacaaatgagagttttaggttttgttatccttgttctgcactgctttaaattatccaagggatttagtatgtacaaattaagactataatatcaagtttacaaatgcccccaaaaaaataaatccgcaaagaatcaaagtttttcattagtatcttctagtatggtaggtctttctgttaattctgatgaatttgatactccctcccctgagttaaatgatagagtttaaattatatgaattgtaatttataatatttttcataaagtttttaaatatctaatttttttatttt

SEQ ID NO: 5398 - DNA, 1871 bp, Solanum tuberosum
aagtgacttcctttatatcggggtcctcattgtatctgccattgatttctacgtttctcttctctctctgtttactgcatttaatttttccggcaatggttctgtaaactgcatattttttctgagtggagactaaaaattaaaggcctcttcagtttctgaagttgtctttgcttgttttaaaagtgtgaatggcagaggtctgttttggagttgtaactgaaactgattcatcgtcaccgtgtgaatcaagttcacgggcggtgaggaggaggagaatggagcttcgaaagataaaagtcatcgctggagtaactcaatccggaacagagaatggaattaaacgtccaaaattgaaacttatttccggttctgtttcaaggatttgtgataacgctgtggaaagttctagcaccgacgatgatgaagaacaactgaggttagtagagacgaaagggtcaccgccaactattattttgactccatttttgggtccttcgaattctactctccttgttcaatcagtggcttacccaaaatttggcttcgcctctgtttgtggaaggaggagagatatggaagatgcagtcgcaattcatccttcattttgccaaatggaacaaggaaacagtggaaaattgcattactttgccgtttacgatggtcatggctgctctcatgtggcgaccaagtgtaaagagaggttacacgagctggtgaaggaggagctggagaacaaagaaggagatcatgaagagtgggagcattcaatgaaccgaagcttcaatcgaatggacaaagaagtgattgaatggaacaatagcgtaaccggcgccacatgccggtgcgaacttcatacaccggaatgtgacgccgtcggttcaacggcggtagtcgcagttgttacgccggacaagattattgtcgcgaattgtggtgattccagagctattttttgccgaaatggcacagctattcctctttctaacgatcaaaaaccggatcgtccggatgaacttaaccgcatccaggaagctggtggcagagtaatttactgggacggccctcgtgtttcaggcgttttggctatgtcaagagccattggtgataattatttgaagccgtatgtgatctgcgagccagaagtgacggtaactgatcgcacggcggaggatgactgtttgattttagcaagtgacggattatgggacgtagtctcaaacgacactgcatgtggcgttgccggtatgtgcctgaaaaggaatgcatcgccggcgtctacgtcgggaaatggagccgacggcgagatgaattccgaccaatgttgctctgatgcatcgatgcttttgactaaactagcccttgctaggcggagctacgacaacgtcagcgttgtcgtggttgatctgaagcactacacgtagagagcattgaagcttttttttctttcttgcagcctttttttgctttatgctttaacatttcagtgtgtttattttgggttgtgttcagttttagattagttctttaaacggttgaaattggaagaaaatgacttggggggggaaaaagggattcaacaaatgagagttataggttttgttatccttgttctgcactgctttaaattatccaatggatttagtatgtacaaattaagactataatatcaagtttacaaatgccccccaaaaaaaaatatccgcaaagaatcaaagtttttcattagtatcttcaagtatggtaggtctttctgttaattctgatgaatttgatactccctccgctgagttaaatgatagagtttatgatatgaattgtaatttataatatttttcattaagtttttaaatatataatttttttatttt

SEQ ID NO: 5399 - DNA, 2492 bp, Solanum tuberosum
caaagttcacaacattgatcgtatataaataaaattcccattttttctcttctccaaattctcctaagtaaaatttctccattacaattctagccattttcttgatctaatggcatcaattgcacaaaatggacatgttaatggagaagttgtagccatggaattatgcaagaaatcaattaatgttgatgatccattgaattgggaaatggctgctgaatctttaagagggagtcatttggatgaagtgaaaaagatggtggatgaatttagaaagccaattgtgaaacttgggggtgaaactttgacagttgcacaagttgcatccattgcaaatgctgataataaaagcaatggggtcaaagtggaactttctgaaagtgcaagggctggtgtgaaagctagtagtgattgggttatggatagtatgagtaaaggtacagatagttatggtgttactactggatttggtgcaacatctcatagaagaaccaaaaatggtggtgcccttcaaaaggaacttattaggttcttgaatgctggagtttttggcaatggaacagaatcatctcacactttgccacattcagcaacaagggcagctatgcttgttaggatcaatactctgcttcaaggatactctggcattagatttgaaatcttggaagcaattactaagttgatcaacagcaacatcaccccatgtttgcccctccgtggcacaatcactgcctcaggtgatcttgtccctctgtcctacatagctggtttgctcactggcaggcctaactccaaggctgttggaccaaatggtgagaaacttaatgctgaggaagcgttccgcgtcgctggtgttagtggtggatttttcgagttgcagcctaaagaaggacttgcacttgtgaatggtacagcagttggttctggtatggcatcaatggtcctgtttgattccaacattcttgctgtcatgtctgaagttttatcggcgatttttgctgaagtgatgaatggaaagcccgaattcactgactatttgacacacaagttgaagcatcaccctggtcagattgaggctgctgctattatggaacacattttggatggcagctcttatgtcaaggcagctcagaagctccatgaaatggatcctcttcaaaaaccaaagcaagatcgttatgctctccgaacatctccacagtggcttggccctcaaattgaagtcatccgtgcagcaactaagatgattgagagggagattaactcagtgaatgacaacccattgatcgacgtttcaagaaacaaggccttacatggtggcaacttccaaggtacccctattggtgtctccatggataatacaagattggcccttgcatcaattgggaaattgatgtttgcccaattttcggaacttgtcaacgactattacaacaatgggctgccatctaatctcacagcaggaaggaatccaagcttggactatggactcaagggagctgaaattgcaatggcttcttactgctcggaacttcaatttttggcaaatccagtgactaaccatgtccaaagtgctgagcaacacaaccaagatgtgaattcattgggcttaatctcagcaaggaaaaccgctgaggctgttgacatcttgaagctaatgtcatcaacctatctcgtggcgctttgccaagctatcgacttaaggcatttggaggaaaacttgaggaatgctgtcaagaacacggtgagccaagtagctaagagaactttgacaatgggtgctaatggtgaacttcatcctgcaagattctgcgagaaggaattgcttcgagtcgtggacagggaatacgtgtttgcctatgctgatgatccctgcagttcaacctaccctttgatgcagaagctgagacaagtccttgttgatcatgcaatgaataatggtgaaagtgagaagaatgtgaacagctcaatcttccaaaagattgtagctttcgaggacgaattgaaggcaatgttgcctaaagaagttgagagtgcaagagctgttcttgaaagtggcaacccttcaattcctaacaggatcacagaatgcagatcatatccattgtacaagttggtgagacaagaacttggatcagaactgttgacaggtgaaaaagttcgatcgcccggtgaggagattgacaaggtgttcacagcaatgtgcaatggacagattattgatccattgttggagtgtctccagagctggaatggtgctcctcttccaatctgctaaatgtttgccagataaaggaccagttgttaatgcttgtctagtgctatttttcagattctttttttactctatggtgaattactatcataacatgttgtgaacttacgtcttttttggttaacttgagagagtgtttaaactctcttaaatatgaatgtctcttttcagtaaaaaacttaaatgaaaagtgacagtgtgcttgtgtctaattcaa

SEQ ID NO: 5400 - DNA, 2462 bp, Solanum tuberosum
tttttatataaataaaattcccattttttctcttctccaaattctcctaagtaaaatttctccattacaattctagccattttcttgatctaatggcatcaattgcacaaaatggacatgttaatggagaagttgtagccatggaattatgcaagaaatcaattaatgttgatgatccattgaattgggaaatggctgctgaatctttaagagggagtcatttggatgaagtgaaaaagatggtggatgaatttagaaagccaattgtgaaacttgggggtgaaactttgacagttgcacaagttgcatccattgcaaatgctgataataaaagcaatggggtcaaagtggaactttctgaaagtgcaagggctggtgtgaaagctagtagtgattgggttatggatagtatgagtaaaggtacagatagttatggtgttactactggatttggtgcaacatctcatagaagaaccaaaaatggtggtgcccttcaaaaggaacttattaggttcttgaatgctggagtttttggcaatggaacagaatcatctcacactttgccacattcagcaacaagggcagctatgcttgttaggatcaatactctgcttcaaggatactctggcattagatttgaaatcttggaagcaattactaagttgatcaacagcaacatcaccccatgtttgcccctccgtggcacaatcactgcctcaggtgatcttgtccctctgtcctacatagctggtttgctcactggcaggcctaactccaaggctgttggaccaaatggtgagaaacttaatgctgaggaagcgttccgcgtcgctggtgttagtggtggatttttcgagttgcagcctaaagaaggacttgcacttgtgaatggtacagcagttggttctggtatggcatcaatggtcctgtttgattccaacattcttgctgtcatgtctgaagttttatcggcgatttttgctgaagtgatgaatggaaagcccgaattcactgactatttgacacacaagttgaagcatcaccctggtcagattgaggctgctgctattatggaacacattttggatggcagctcttatgtcaaggcagctcagaagctccatgaaatggatcctcttcaaaaaccaaagcaagatcgttatgctctccgaacatctccacagtggcttggccctcaaattgaagtcatccgtgcagcaactaagatgattgagagggagattaactcagtgaatgacaacccattgatcgacgtttcaagaaacaaggccttacatggtggcaacttccaaggtacccctattggtgtctccatggataatacaagattggcccttgcatcaattgggaaattgatgtttgcccaattttcggaacttgtcaacgactattacaacaatgggctgccatctaatctcacagcaggaaggaatccaagcttggactatggactcaagggagctgaaattgcaatggcttcttactgctcggaacttcaatttttggcaaatccagtgactaaccatgtccaaagtgctgagcaacacaaccaagatgtgaattcattgggcttaatctcagcaaggaaaaccgctgaggctgttgacatcttgaagctaatgtcatcaacctatctcgtggcgctttgccaagctatcgacttaaggcatttggaggaaaacttgaggaatgctgtcaagaacacagtgagccaagtagctaagagaactttgacaatgggtgctaatggtgaacttcatcctgcaagattctgcgagaaggaattgcttcgagtcgtggacagggaatacgtgtttgcctatgctgatgatccctgcagttcaacctaccctttgatgcagaagctgagacaagtccttgttgatcatgcaatgaataatggtgaaagtgagaagaatgtgaacagctcaatcttccaaaagattgtagctttcgaggacgaattgaaggcaatgttgcctaaagaagttgagagtgcaagagctgttcttgaaagtggcaacccttcaattcctaacaggatcacagaatgcagatcatatccattgtacaagttggtgagacaagaacttggatcagaactgttgacaggtgaaaaagttcgatcgcccggtgaggagattgacaaggtgttcacagcaatgtgcaatggacagattattgatccattgttggagtgtctccagagctggaatggtgctcctcttccaatctgctaaatgtttgccagataaaggaccagttgttaatgcttgtctagtgctatttttcagattctttttttactctatggtgaattactatcataacatgttgtgaacttacgtcttttttggttaacttgagagagtgtttaaactctcttaaatatgaatgtctcttttcagtaaaaaacttaaatgaaaagtgacagtgtgctt

SEQ ID NO: 5401 - DNA, 2499 bp, Solanum lycopersicum
ataacaaaaatttttataagttcacaacattttttttgttatataaaaataatctctagccattttgttttcactaaaatttctccattacaaatcaaaccattttttgttggtccaatggcatcatcaattgtacaaaatggacatgttaatggagaagctatggatttatgtaagaaatcaattaatgttaatgatccattgaattgggaaatggctgctgaatcattaagagggagtcatttggatgaagtgaaaaagatggtggatgaatttagaaagccaattgtgaaacttgggggtgaaactttaacagttgcacaagttgcatccattgcaaatgttgataacaaaagtaatggggtcaaagtggaactttctgaaagtgcaagggctggtgtgaaagctagtagtgattgggtaatggatagtatggggaaaggtacagatagttacggtgtgactactggatttggtgcaacatctcatagaagaactaaaaatggtggtgcacttcaaaaggaacttatcaggttcttgaatgctggagtttttggaaatggaacagaatcatctcatactttgccacattcagcaacaagggcagctatgcttgttaggatcaacactctgcttcaaggctactctggcattagatttgaaatcttggaagcaattactaagttgatcaacagcaacattaccccgtgtttgccccttcgtgggacgatcactgcatcgggtgatcttgtcccgttgtcatacattgctggtttgctcactggcaggcctaattcaaaggctgttggacctaatggcgagaagcttaatgctgaggaagcgtttcgtgtggctggtgttactagtggatttttcgagttgcagcctaaggaaggacttgcacttgtgaatggtactgcagttggttctggtatggcatcaatggtactgtttgagtccaacattcttgctgtcatgtctgaagtcttgtcagcgattttcgctgaagtgatgaacggaaagcctgaattcactgactatttgacacacaagttgaagcatcaccctggccagattgaggctgctgctattatggaacacattttggatggcagctcttatgtcaaagaagctcagaagctacatgaaatggatcctcttcaaaaaccaaagcaagatcgttatgcgctccgaacatctccacaatggcttggacctcaaattgaagtcatccgtgcagcaactaagatgatcgagagggagatcaactcagtgaacgacaatccattgattgacgtttcaagaaacaaggccttacatggtggaaacttccaaggaacccctattggtgtgtccatggataatacaagattggcccttgcatctattgggaaattgatgtttgcccaattttcggaacttgtcaacgactattacaacaatgggttgccatctaatctcacagcaggaaggaatccaagcttggattatggactcaagggagctgaaattgcaatggcttcttactgctcggaacttcaattccttgcaaatccagtgactaaccatgtccaaagtgctgagcaacacaaccaagatgtgaattcgttgggcttaatctcagcaaggaaaaccgctgaggctgttgacatcttgaagctaatgtcatcaacctatctcgtggcgctttgccaagctatcgacttgaggcatttggaggagaatttgaagaatgctgtgaagaacactgtaagccaagtagccaaaaagactctggcaatgggtgctaatggtgaacttcatcctgcaagattctgcgagaaggaattgcttcgagttgtggacagggaatacgtgtttgcctatgctgatgatccctgcagctccacctaccctttgatgcagaagctgagacaagtccttgttgatcatgcaatgaagaatggtgaaagtgagaagaatgtgaacagctcaatcttccaaaagattgtagctttcgaggacgaattaaaggccgtgttgcctaaagaagttgagagtgcaagagctgttgttgaaagtggcaaccctgcaattcctaacaggatcacagaatgcagatcatatccattgtacaggttggtgagacaagaacttggatcagaacttttgacaggtgaaaaagttcgatcgcccggtgaggagattgacaaggtgttcacagcaatgtgcaatggacagatcattgatccattgttggagtgtctcaagagctggaatggtgctcctcttccaatctgctagatgcttgccagaaaaaaagaccagttgtgaatgcttgtctagtgctatttttcagattctttttttgctttatggtgaattactatcataatatgttgtgaacttacatcttttttggttaacttgagagagtgttaaactctcttaaatatgaatatgtctcttttcagtaaaaaacttaaatgaaaagtgacagtgtgcttatgtctattcaat

SEQ ID NO: 5402 - DNA, 2414 bp, Solanum tuberosum
  misc_feature (2387)..(2387): n is a, c, g, or t
tataaataaaattcccattttttcccttctccaaattctcctaagtaaaacttctccattacaattctagccattttcttgatctaatggcatcaattgcacaaaatggacatgttaatggagaagttgtagccatggaattatgcaagaaatcaattaatgttgatgatccattaaattgggaaatggctgctgaatctttaagagggagtcatttggatgaagtgaaaaagatggtggatgaatttagaaagccaattgtgaaacttgggggtgaaactttgacagttgcacaagttgcatccattgcaaatgctgataacaaaagtaatggggtcaaagtggaactttctgaaagtgcaagggctggtgtgaaagctagtagtgattgggttatggatagtatgagtaaaggtacagatagttatggtgttactactggatttggtgcaacatctcatagaagaaccaaaaatggtggtgcccttcaaaaggaacttattaggttcttgaatgctggagtttttgggaatggaacagaatcatctcacacattgccacattcagcaacaagggcagctatgcttgttaggatcaatactctgcttcaaggctactctggcattagatttgaaatcttggaagcaattactaagttgatcaacagcaacatcaccccgtgtttgcccctccgtggcacgatcactgcctcgggtgatcttgtccctctgtcctacattgctggtttgctcactggcaggcctaactccaaggctgttggaccaaatggagagaaacttaatgctgaggaagcattccgcgtggctggtgttactggtggatttttcgagttgcagcctaaagaaggacttgcacttgtgaatggtacagcagttggttctggtatggcatcaatggtcctgtttgattccaacattcttgctgtcatgtctgaagttttatcggcgattttcgctgaagtgatgaatggaaaacccgaattcactgactatttgacacacaagttgaagcatcaccctggtcagattgaggctgctgctattatggaacacattttggatggcagctcttatgtcaaggaagctcagaagctccatgaaatggatcctcttcaaaaaccaaagcaagatcgttatgctctccgaacatctccacaatggcttggccctcagattgaagtcattcgtgctgcaactaagatgattgagagggagatcaactcagtgaacgacaatccattgatcgatgtttcaagaaacaaggccttacacggtggcaacttccaaggcacccctattggtgtctccatggataatacaagattggcccttgcatcaattggaaaattgatgtttgcccaattctcggagcttgtgaacgactattacaacaatgggttgccatctaatctcacagcaggaaggaatccaagcttggactatggtttcaaaggagctgaaattgcgatggcttcttactgctcggaacttcaattcttggcaaatccagtgactaaccacgtccaaagtgccgagcaacacaaccaagatgtgaattccttgggcttaatctcagcaaggaaaactgctgaggctgtggacatcttgaagctaatgtcatcaacctatctcgtggcactttgccaggctatcgacttgaggcatttggaggagaacttgaagaatgctgtcaagaacactgtaagccaagtagccaaaaagactttgacaatgggtgctaatggtgaacttcatccagcaagattctgcgaaaaggaattgctacaagttgtggaaagggaatacttgtttgcctatgctgatgacccatgcagctgcacctaccctttgatgcagaagctgagacaagtccttgttgatcatgcaatgaagaatggtgaaagtgagacgaatgtgaacagctcaatcttccaaaagattgtagctttcgaggaagaattaaatgttgtgttgcctaaagaagttgagagtgcaagagctatgcttgagagtggaaacccttcaattcctaacaggatcacagaatgcagatcatatccattgtacaggttggtgagacaagaacttggatcagaactgttgacaggtgaaaaagttcgatcgcccggtgaggagattgacaaggtgttcacagcaatgtgcaatggacagattattgatccattgttggagtgtctcaagagctggaatggtgctcctcttccaatctgctaaatgtttgccagataaaggaccagttgttaatgcttgtctaagtgctatttttcagattctttttttactctatggtgaattactatcataacatgttgtgaacttacgtcctttttttggttaacttgagangagtgtttaaactcctctttaaatatg

SEQ ID NO: 5403 - DNA, 2404 bp, Solanum phureja
taccacaaccaaaacaaaaagttttgtaagttcacaacatttttttatatatatacacaaataaactctaaccattttctcttcactaaaatttcttcattacaaatataaccatttcttgatccaatggcaccatcaattgcacaaaatggacatattaatggagaagctatggatttgtgcaagaaatcaaattatgatccattaaattgggaaatggctgctgattctttaagagggagtcatttggatgaagtgaaaaagatggtggatgaatttagaaagccaattgtgaaacttgggggtgaaactttgacagttgcacaagttgcatccattgcaaatgttgataacaaaagtaatggggtcaaagtggaactttctgaaagtgcaagggctggtgtgaaagctagtagtgattgggtgatggatagtatgagtaaaggtacagatagttatggtgttactactggatttggtgcaacatctcatagaagaacaaaaaatggtggtgctcttcaaaaagaacttattaggttcttgaatgctggagtttttggtaatggaacagaaacatctcacacattgccacattcagcaacaagggcagctatgcttgttaggatcaacactctgcttcaaggctactctggcattagatttgaaatcttggaagcaattactaagttgatcaacagcaacatcaccccgtgtttgcccctccgtggtacgatcaccgcctcgggtgatcttgtacctttgtcctacattgctggtttgctcactggcaggcctaactccaaggttgttgggcccaatggtgagaaacttaatgctgaggaagctttccgtgtggctggtgttactggtggatttttcgagttgcagcctaaggaagggcttgcacttgtgaatggcacagcagttggttctgctatggcatcaatagtcctgtttgagtccaacattcttgctgttatgtctgaagttttatcagcgatttttgctgaagtgatgaacggaaagcccgaattcactgactatttgacacacaagttgaagcatcaccctggtcagattgaggctgctgctattatggaacacattttggatggcagctcttatgtcaaggcagctcagaagctccatgaaatggatcctcttcaaaaaccaaagcaagatcgttatgctctccgaacatctccacaatggcttggccctcagattgaagtcattcgtgctgcaacaaagatgatcgagagggagatcaactcagtcaacgacaatccattgatcgatgtttcaagaaacaaggccatacatggtggcaacttccaaggcacccctattggtgtctccatggataatacacgattagcccttgcatcaattggtaaattgatgtttgcccaattctcagagcttgtcaacgactattacaacaatgggttgccatctaatctcacagcaggaaggaatccaagcttggactatggtttcaagggagctgaaatcgcgatggcttcttactgctcggaacttcaattcttggcaaatccagtgactaaccacgtccaaagtgccgagcaacacaaccaagatgtgaattccttgggcttaatctcagccaggaaaacagttgaggctgttgatatcttgaagctaatgtcatcaacctatctcgttgcgctttgccaagctatcgacttaaggcatttggaggagaacttgaggaatgcagtcaagaacacagtaagccaagtagctaagagaactttgacaatgggtgctaatggggaacttcatccagcaagattctgtgagaaggaattgcttcgagtcgtggatagggaatacttgtttgcctatgcagatgacccctgcagctccaactaccctttgatgcagaagctgagacaagtccttgttgatcaagcaatgaagaatggtgaaagtgagaagaatatcaacagctcaatcttccaaaagattggagctttcgaggacgaattaatcgctgtgttgcctaaagaagttgagagtgcaagagctcttcttgaaagtggcaacccttcgattcctaacaggatcacagaatgcagatcatatccattgtacaggttggtgagacaagaacttggaacagaattgttgacaggtgaaaaagttcgatcacccggtgaggagattgacaaggtgtttacagcaatgtgtaatggacagattattgatccattgttggagtgtctcaagagctggaatggtgctcctctgccaatctgctaaatgtgttattttttcaaattctttttttaccttatggtgaattactagaatcataataacgttatgaacttatataatttttttattttctttttgactgtatgtaatattggctcaa

SEQ ID NO: 5404 - DNA, 2585 bp, Solanum tuberosum
acaacattttttttatatatatacaaataaactctaaccattttctcttcactaaaatttattcattacaaatctaaccattttcttgatcaatggcaccatcaattgcacaaaatgaacatattaatggagaagtaaaagaagtggctatggatttgtgcaagaaatcaaattatgatccattaaattgggaaatggctgctgattctttaagagggagtcatttggatgaagtgaaaaagatggtggatgaatttagaaagccaattgtgaaacttgggggtgaaactttgactgttgcacaagttgcatccattgcaaatgttgataacaaaagtaatggggtcagagtggaactttctgaaagtgcaagggctggtgtgaaagctagtagtgattgggtgatggatagtatgagtaaaggtacagatagttatggtgttactactggatttggtgcaacatctcatagaagaacaaaaaatggcggtgctcttcaaaaagaacttattaggttcttgaatgctggagtttttggcattggaacagaatcatctcacacattgccacattcagcaacaagggcagctatgcttgttaggatcaacactctgcttcaaggctactctggcattagatttgaaattttggaagcaatcactaagttgatcaacagcaacatcaccccgtgcttgcctctccgtggtacgatcactgcctcgggtgatcttgtacctttgtcctacattgctggtttgctcactggcaggcctaattccaaggctgttggacccaacggtgagaaacttaatgctgaggaagctttccgcgtggctggtgttactggtggatttttcgagttgcagcctaaggaaggacttgcacttgtgaatggcacagcagttggttctgctatggcatcaatagtcctgtttgagtccaacattcttgctgttatgtctgaagttttatcagcgatttttgctgaagtgatgaatggaaagcccgaattcactgactatttgacacacaagttgaagcatcaccctggtcagattgaggctgctgctattatggaacacattttggatggaagctcttatgtgaaggcagctcagaagctccccatgaaatggatcctcttcaaaaaccaaagcaagatcgttatgctctccgaacatctccacaatggcttggccctcagattgaagtcatccgtgctgcaactaagatgatcgagagggagattaactcagtgaacgacaatccattgatcgacgtttcaagaaacaaggccttacatggtggcaacttccaaggcacccctattggtgtctccatggataatacacgattggcccttgcatcaattggtaaattgatgtttgcccaattctcagagcttgtcaacgactattacaacaacgggttgccatctaatctgacagcaggaaggaatccaagcttggactatggtttcaagggcgctgaaattgcgatggcttcttattgctcggaacttcaattcttggcaaatccagtgactaaccatgtccaaagtgctgagcaacacaaccaagatgtgaattccttgggattaatctcagccaggaaaacagccgaggctgttgatatcttgaagctaatgtcatcaacctatctcgtggcgctttgccaagctatagacttgcggcatttggaggagaacttgaagagtgctgtcaagaacacagttagccaagtagctaagagaactttgacaatgggtgctaatggtgaacttcatccagcaagattctgcgaaaaggaattgcttcgagtcgtggacagggaatacttgtttgcctatgcagatgacccctgcagctccaactaccctttgatgcagaagctgagacaagtccttgttgatcaagcaatgaagaatggtgaaagtgagaagcatttcaacagctcaatcttccaaaagattggagctttcgaggatgaattaatcgctgtgttgcctaaagaagttgagagtgtaagagctgttgttgaaagtggcaacccttcaattcctaacaggatcacagaatgcagatcatatccattgtacagattggtgagacaagaacttggaacagaattgttgacaggtgaaaaagttcgatcgcccggtgaggagattgacaaggtgtttacagcaatgtgtaatggacagattattgatccattgttggagtgtctcaagagctggaatggtgctcctcttccaatctgctaaatctgttttttttttcaaattccttttttaccttttagtgaattactagaatcataatatttttttcaattttatctttctttttgactgtatgtaatattggctcaaagaagctgttggaagatttccaaattctatgttgaatcaatatcttcatatttggtaagaacgaacagttgaagaaattgatgtatttcttaaatttaaggtggaatggattagaaaacctttgtacttgattgtaggatgtataactgatacctctcatttggtggaatggattagaagacctatgggattatctatgttatactgttcc

SEQ ID NO: 5405 - DNA, 2459 bp, Solanum phureja
caaagttcataacatttttttatataaataaaattcccattttttctcttctccaaattctcctaagtaaaatttctccattacaattctatccattttcttgatctaatggcatcaattgcacaaaatggacatgttaatggagaagttgtagccatggaattatgcaagaaatcaattaatgtccatgatccattaaattgggaaatggctgctgaatctttaagagggagtcatttggatgaagtgaaaaagatggtggatgaatttagaaagccaattgtgaaacttgggggtgaaactttgacagttgcacaagttgcatccattgcaaatgctgataacaaaagtaatggggtcaaagtggaactttctgaaagtgcaagggctggtgtgaaagctagtagtgattgggttatggatagtatgagtaaaggtacagatagttatggtgttactactggatttggtgcaacatctcatagaagaacaaaaaatggtggtgcccttcaaaaagaacttattaggttcttgaatgctggagtttttggcaatggaacagaatcatctcacactttaccacattcagcaacaagggcagctatgcttgttaggatcaacactctgcttcaaggctactctggcattagatttgaaatcttggaagcaattactaagttgatcaacagcaacatcaccccgtgtttgcccctccgtggcacaatcactgcctcgggtgatcttgtccctctttcctacattgctggtttgctcactggcaggcctaactccaaggctgttggaccaaatggtgagaaacttaatgctgaggaagcgtgtggctggtgttagtggtggatttttcgagttgcagcctaaggaaggacttgcacttgtgaatggtacagcagttggttctggtatggcatcaatggtcctgtttgattccaacattcttgctgtcatgtctgaagttttatcggctgaagtgatgaacggaaagcccgaattcactgactatttgacacacaagttgaagcatcaccctggtcagattgaggctgctgctattatggaacacattttggatggcagctcttatgtcaaggcagctcagaagctccatgaaatggatcctcttcaaaaaccaaagcaagatcgttatgctctccgaacatctccacagtggcttggccctcaaattgaagtcatccgtgcatgatcgagagggagatcaactcagtcaatgacaatccattgatcgatgtttcaagaaacaaggccatacatggtggcaacttccaaggtacccctattggtgtctccatggataatacaagattggcccttgcatcaattgggaaattgatgtttgcccaattttcggaacttgtcaacgactattacaacaatgggctgccatctaatctcacagcaggaaggaatccaagcttggactatggactcaagggagctgaaattgcaatggcttcttactgctcggaacttcaatttttggcaaatccagtgactaaccatgtccaaagtgctgagcaacacaaccaagatgtgaattcattgggcttaatctcagcaaggaaaaccgctgaggctgttgacatcttgaagctaatgtcatcaacctatctcgtggcgctttgccaagctattgacttaaggcatttggaggaaaacttgaggaatgctgtcaagaacacagtgagccaagtagctaagagaactttgacaatgggtgctaatggtgaacttcatcctgcaagattctgcgagaaggaattgcttcgagtcgtggacagggaatacgtgtttgcctatgctgatgatccctgcagttcattgatgcagaagctgagacaggtccttgttgatcatgcaatgaagaatggtgaaagtgagaagaatgtcaacagctcaatcttccaaaagattgtagctttcgaggacgaattgaaggctgtgttgcctaaagaagttgagagtgcaagagctcttcttgaaagtggcaacccttcgattcctaacaggatcacagaatgcagatcatatccattgtacaggttggtgagacaagaacttggatcagaactgttgacaggtgaaaaagttcgatcgcccggtgaggagattgacaaggtgttcacagcaatgtgcaatggacagattattgatccattgttggagtgtctcaagagctggaatggtgctcctcttccaatctgctaaatgtttgccagataaaggaccagttgttaatgcttgtctagtgctatttttcagattctttttttactcttatggtgaattactatcataatatgttgtgaacttacatcttttttggttaacttgagagagtgtttaaactctcttaaagatgaatatgtctcttttcagtaaaaaacttaaatgaaaagtgacagtgtgcttatgtctattca

SEQ ID NO: 5406 - DNA, 2472 bp, Solanum tuberosum
tatatatatacaaataaactctaaccattttctcttcactaaaatttattcattacaaatctaaccattttcttgatcaatggcaccatcaattgcacaaaatgaacatattaatggagaagtaaaagaagtggctatggatttgtgcaagaaatcaaattatgatccattaaattgggaaatggctgctgattctttaagagggagtcatttggatgaagtgaaaaagatggtggatgaatttagaaagccaattgtgaaacttgggggtgaaactttgactgttgcacaagttgcatccattgcaaatgttgataacaaaaattaatggggtcagagtggaactttctgaaagtgcaagggctggtgtgaaagctagtagtgattgggtgatggatagtatgagtaaaggtacagatagttatggtgttactactggatttggtgcaacatctcatagaagaacaaaaaatggcggtgctcttcaaaaagaacttattaggttcttgaatgctggagtttttggcattggaacagaatcatctcacacattgccacattcagcaacaagggcagctatgcttgttaggatcaacactctgcttcaaggctactctggcattagatttgaaattttggaagcaatcactaagttgatcaacagcaacatcaccccgtgcttgcctctccgtggtacgatcactgcctcgggtgatcttgtacctttgtcctacattgctggtttgctcactggcaggcctaattccaaggctgttggacccaacggtgagaaacttaatgctgaggaagctttccgcgtggctggtgttactggtggatttttcgagttgcagcctaaggaaggacttgcacttgtgaatggcacagcagttggttctgctatggcatcaatagtcctgtttgagtccaacattcttgctgttatgtctgaagttttatcagcgatttttgctgaagtgatgaatggaaagcccgaattcactgactatttgacacaccaagttgaagcatcaccctggtcagattgaggctgctgctattatggaacacattttggatggaagctcttatgtcaaggcagctcagaagctccccatgaaatggatcctcttcaaaaaccaaagcaagatcgttatgctctccgaacatctccacaatggcttggccctcaaattgaagtcatccgtgcagcaactaaaatgattgagagggagattaactcagtgaacgacaacccattgatcgacgtttcaagaaacaaggccttacacggtggcaacttccaaggcacccctattggtgtctccatggataatacaagattggcccttgcatcaattggaaaattgatgtttgcccaattttcggaacttgtcaacgactattacaacaatgggttgccatctaatctcacagcaggaaggaatccaagcttggactatggactcaagggagctgaaattgcaatggcttcttactgctcggaacttcaatttttggcaaatccagtgactaaccatgtccaaagtgctgagcaacacaaccaagatgtgaattcattgggcttaatctcagcaaggaaaaccgctgaggctgttgacatcttgaagctaatgtcatcaacctatctcgtggcgctttgccaagctattgacttaaggcatttggaggaaaacttgaggaatgctgtcaagaacacagtgagccaagtagctaagagaactttgacaatgggtgctaatggtgaacttcatcctgcaagattctgcgagaaggaattgcttcgagtcgtggacagggaatacgtgtttgcctatgctgatgatccctgcagttcaacctaccctttgatgcagaagctgagacaagtccttgttgatcatgcaatgaagaatgctgaaagtgagacgaatgtgaacagctcaatcttccaaaagattgtagctttcgaggacgaattgaaggctgtgttgcctaaagaagttgagagtgcaagagttgctcttgagagtggaaacccttcaattcctaacaggataacagaatgcagatcatatccattatacaggtttgtaaggaaagaagttggaacacaagtgttgacaggtgaaaaagttcgatcgcccggtgaggagattgacaaggtattcacagcattttgcaatggacaaatcattgatccattgttggaatgtctcaagagctggaatggtgctcctcttccaatttgctagatgtttgtcaagttgttaatttttcaaattctttttttaccttatactgaattactagatcataatatatatgttgtgaagttatatcatttaattttcttttggacagtatgtaatattggctcaactaaggtgccaagtttatcccaatatgagaatcagaatattctctacatgacttaaaagaagctgttgaaagcatttccaaaaaaaaaag

SEQ ID NO: 5407 - DNA, 2573 bp, Solanum tuberosum
taacagaagaagaaagtttataagttcacaacttttttttattatcatatatctatatatacaaataaactctaaccattttctcttcactaaaatttcttctattacttttcttgatccaatggcaccatcaattgcacaaaatggacatgttaatggagaagtagaagaagttttgtgcaagaaatcaattcatgatccattgaattgggaaatggctgctgattctttaagagggagtcatttggatgaagtaaaaaagatggtggatgaatttagaaagccaattgtgaaacttgggggtgaaactttaactgttgcacaagttgcatccattgcaaatgctgataacaaaactagtggggtcaaagtggaactttctgaaagtgcaagagctggtgtgaaagctagtagtgattgggttatggatagtatgagtaaaggtacagatagttatggtgttactactggatttggtgcaacatctcatagaagaaccaaaaatggtggtgctcttcaaaaggaacttattaggttcttgaatgctggagtttttggcaatggaacagaatcatctcacactttgccacattcagcaacaagggcagctatgcttgttaggatcaacactctgcttcaaggctactctggcattagatttgaaatcttggaagcaattactaagttgatcaatagcaacattaccccgtgtttgcccctccgtggaacggtcactgcctcaggtgatcttgtccctctgtcctacattgctggtttgctcactggcaggcctaattccaaggctgttggacccaatggtgagaaacttgacgctgatgaagcgttccgtgtggctggtgttagtggtggatttttcgagttgcagcctaaggaaggacttgcacttgtgaatggtacagcagttggttccggtatggcatcaattgtcctgtatgactccaacattcttgctgttatgtctgaagttttatcagcgattttcgctgaagtgatgaacggaaagcccgaattcactgactatttgacacacaagttgaagcatcaccctggtcagattgaggctgctgctattatggaacacattttggatggcagctcttatgtcaaggcagctcagaagctccatgaaatggatcctcttcaaaaaccaaagcaagatcgttatgctctccgaacatctccacaatggcttggccctcagattgaagtcattcgtgctgcaacaaagatgatcgagagggagatcaactcagtcaacgacaatccattgatcgatgtttcaagaaacaaggccatacatggtggcaacttccaaggtacccctattggtgtctccatggataatacaagattggcccttgcatcaattgggaaattgatgtttgcccaattctcggagcttgtcaacgactattacaacaatgggttgccatctaatctcacagcaggaaggaatccaagcttggactatggtttcaagggagctgaaatcgcgatggcttcttactgctcggaacttcaattcttggcaaatccagtgactaaccatgttcagagtgccgagcaacacaaccaagatgtgaactccttaggcttaatctcagcaaggaaaacagctgaggctgtcgacatcttaaagctaatgtcatcaacctatctcgtggcactttgccaagctatagacttgaggcatttggaggagaacttgaagagtgttgtcaagaacacagttagccaagtagctaagagaactttgacaataggtgctattggtgaacttcatccagcaagattctgcgagaaggaattgcttcgagtcgtagacagggaatacttgtttacctatgctgatgacccctgcagctccacctatcctttgatgcagaagctgagacaggtccttgttgatcatgcaatgaagaatggtgaaagtgagaagaatatcaacagctcaatcttccaaaagattggagctttcgaggacgaattaaatgctgtgttgcctaaagaagttgagagtgcaagagctcttcttgaaagtggcaacccttcgattcctaacaggatcacagaatgcagatcatatccattgtacaggttggtgagacaagagcttggaacagaactgttgacaggtgaaaaagttcgatcgccgggcgaggagattgaaaaggtgttcacagcaatgtgcaatggacagatcattgatccattgttggagtgtctcaagagctggaatggtgctcctcttccaatctgctagatgtttgtcaagtgttaatttttcaaattctttttttaccttttggtgaattattagaatcataatataattttattgtcttttggactgtatgtaatatagacatgttgaaatgaaggaaaaaattaaaatgtagcaacaattctggaaggatgtattgactatccttaaaaggatatattgactaatcatgaatcaattaaagattttgattttgagccggctagtttatgcatatggtctttataggtaattatttagattctgtaagtacgtgtaaatgtacttg

SEQ ID NO: 5408 - DNA, 2590 bp, Solanum tuberosum
ttcacaacattttttttattatcatatatctatatatatacaaataaactctaaccattttctcttcactaaaatttcctctattacttttcttgatccaatggcaccatcaattgcacaaaatggacatgttaatggagaagtagaagaagttttgtgcaagaaatcaattcatgatccattgaattgggaaatggctgctgattctttaagagggagtcatttggatgaagtaaaaaagatggtggatgaatttagaaagccaattgtgaaacttgggggtgaaactttaactgttgcacaagttgcatccattgcaaatgctgataacaaaactagtggggtcaaagtggaactttctgaaagtgcaagagctggtgtgaaagctagtagtgattgggttatggatagtatgagtaaaggtacagatagttatggtgttactactggatttggtgcaacatctcatagaagaaccaaaaatggtggtgctcttcaaaaggaacttattaggttcttgaatgctggagtttttggcaatggaacagaatcatctcacactttgccacattcagcaacaagggcagctatgcttgttaggatcaacactctgcttcaaggctactctggcattagatttgaaatcttggaagcaattactaagttgatcaatagcaacattaccccgtgtttgcccctccgtggaacggtcactgcctcaggtgatcttgtccctctgtcctacattgctggtttgctcactggcaggcctaattccaaggctgttggacccaatggtgagaaacttgacgctgatgaagcgttccgtgtggctggtgttagtggtggatttttcgagttgcagcctaaggaaggacttgcacttgtgaatggtacagcagttggttccggtatggcatcaattgtcctgtatgactccaacattcttgctgttatgtctgaagttttatcagcgattttcgctgaagtgatgaacggaaagcccgaattcactgactatttgacacacaagttgaagcatcaccctggtcagattgaggctgctgctattatggaacacattttggatggcagctcttatgtcaaggcagctcagaagctccatgaaatggatcctcttcaaaaaccaaagcaagatcgttatgctctccgaacatctccacaatggcttggccctcagattgaagtcattcgtgctgcaacaaagatgatcgagagggagatcaactcagtcaacgacaatccattgatcgatgtttcaagaaacaaggccatacatggtggcaacttccaaggtacccctattggtgtctccatggataatacaagattggcccttgcatcaattgggaaattgatgtttgcccaattctcggagcttgtcaacgactattacaacaatgggttgccatctaatctcacagcaggaaggaatccaagcttggactatggtttcaagggagctgaaatcgcgatggcttcttactgctcggaacttcaattcttggcaaatccagtgaccaaccatgttcagagtgccgagcaacacaaccaagatgtgaactccttaggcttaatctcagcaaggaaaacagctgaggctgtcgacatcttaaagctaatgtcatcaacctatctcgtggcactttgccaagcaatagacttgaggcatttggaggagaacttgaagagtgttgtcaagaacacagttagccaagtagctaagagaactttgacaataggtgctattggtgaacttcatccagcaagattctgcgagaaggaattgcttcgagtcgtagacagggaatacttgtttacctatgctgatgacccctgcagctccacctatcctttgatgcagaagctgagacaggtccttgttgatcatgcaatgaagaatggtgaaagtgagaagaatatcaacagctcaatcttccaaaagattggagctttcgaggacgaattaaatgctgtgttgcctaaagaagttgagagtgcaagagctcttcttgaaagtggcaacccttcgattcctaacaggatcacagaatgcagatcatatccattgtacaggttggtgagacaagagcttggaacagaactgttgacaggtgaaaaagttcgatcgccgggcgaggagattgaaaaggtgttcacagcaatgtgcaatggacagatcattgatccattgttggagtgtctcaagagctggaatggtgctcctcttccaatctgctagatgtttgtcaagtgttaatttttcaaattctatttttaccttttggtgaattattagaatcataatataattttattgtcttttggactgtatgtaatatagacatgttgaaatgaaggaaaaaattaaaatgtagcaacaattctggaaggatgtattgactatccttaaaaggatatattgactaatcatgaatcaattaaagattttgattttgagccggctagtttatgcatatggtctttataggtaattatttagattctgtaagtacgtgtaaatgtacttgaaaattttccttttggccaatataaaatttttgctatt

SEQ ID NO: 5409 - DNA, 2590 bp, Solanum tuberosum
atacaaataaactccaaccattttatcttcactaaaatttcttcattacatatctaaccattttcttgatacaatggcaccatcaattgcacaaaatggacatgttaatggagaagtagaagcaagttgctatggaattatgcaagaaatcaataaatgtccatgatccattaaattgggaaatggctgctgattctttaagagggagtcatttggatgaagtgaaaaagatggtggatgaatttagaaagccaattgtgaaacttgggggtgaaactttgacagttgcacaagttgcatccattgcaaatgctgataacaaaagtaatggggtcaaagtggaactttctgaaagtgcaagggctggtgtgaaagctagtagtgattgggtgatggatagtatgagtaaaggtacagatagttatggtgttactactggatttggtgcaacatctcatagaagaacaaaaaatggtggtgctcttcaaaaagaacttattaggttcttgaatgctggagtttttggcaatggaacagaatcatctcacactttaccacattcagcaacaagggcagctatgcttgttaggatcaaacactctgcttcaaggctactctggcattagatttgaacatcttggaagcaattactaagttgatcaacaggcaacatcacccccaatgtttgcccctccgtgggcacaatcactgcctcgggtgatccttgtccctctttcctacatagctggtttggctcaactgggcaggcctaactccaaggctgttggaccaaatggtgagaaacttaatgctgaggaagcgttccgcgtggctggtgttactggtggatttttcgagttgcagcctaaagaaggacttgcacttgtgaatggtacagcagttggttctggtatggcatcaatggtcctgtttgattccaacattcttgctgtcatgtctgaagttttatcggcgattttcgctgaagtgatgaatggaaaacccgaattcactgactatttgacacacaagttgaagcatcaccctggtcagattgaggctgctgctattatggaacacattttggatggcagctcttatgtcaaggaagctcagaagctccatgaaatggatcctcttcaaaaaccaaagcaagatcgttatgctctccgaacatctccacaatggcttggccctcaaattgaagtcatacgtgctgcaactaagatgatcgagagggagatcaactcagtgaatgacaatccattgatcgacgtttcaagaaacaaggccttacacggtggcaacttccaaggcacccctattggtgtctccatggataatacaagattggcccttgcatcaattggtaaattgatgtttgcccaattctcagagcttgtcaacgactattacaacaacgggttgccatctaatctgacagcaggaaggaatccaagcttggactatggtttcaagggcgctgaaattgcgatggcttcttattgctcggaacttcaattcttggcaaatccagtgactaaccatgtccaaagtgctgagcaacacaaccaagatgtgaattccttgggattaatctcagccaggaaaacagccgaggctgttgatatcttgaagctaatgtcattccaacctatcctcgtggcgcttttgcccaagctatagaacttgacggcatttggaggagaactttgaagagtgctgtcaagaacacagttagccaagtagctaagagaactttgacaatgggtgctaatggtgaacttcatccagcaagattttgcgaaaaggaattgcttcgagtcgtggacagggaatacttgtttgcctatgcagatgacccctgcagctccaattaccctttgatgcagaagctgagacaagtccttgttgatcaagcaatgaagaatggtgaaagtgagaagcatttcaacagctcaatcttccaaaagattggagctttcgaggatgaattaatcgctgtgttgcctaaagaagttgagagtgtaagagctgttgttgaaagtggcaacccttcaattcctaacaggatcacagaatgcagatcatatccattgtacagattggtgagacaagaacttggaacagaattgttgacaggtgaaaaagttcgatcgcccggtgaggagattgacaaggtgtttacagcaatgtgtaatggacagattattgatccattgttggagtgtctcaagagctggaatggtgctcctcttccaatctgctaaatctgttttttttttcaaatttctttttttaccttttagtgaattactagaatcataataattttttcaattttatttttctttttgactgtatgtaatattggctcaaagaagctgttggaagatttccaaattctatgttcaatcaatatcttcatatttggtaagaacgaacagttgaagaaattgatgtatttcttaaatttaaggtggaatggattagaaaacctttgtacttgattgtaggatgtataactgatacctctcatttggtggaatggattagaagacctatgggattatctatgttatactgttcc

SEQ ID NO: 5410 - DNA, 2240 bp, Solanum phureja
tcttttttccattttctcctaagtaaaatttctccattacaaatctagccattttcttgatccaatggcatcatcaattgcacaaaatggacatgttaatggagaagtagaagaagttttgtgcaagaaatcaattcatgatccattgaattgggaaatggctgctgaatcattaagagggagtcatttggatgaagtgaaaaaaatggtggatgaatttagaaagccaattgtgaaacttgagggtgaaactttgactgttgcacaagttgcatccattgcaaatgctgataacaaaagtaatggggtcaaagtggaactttctgaaagtgcaagggctggtgtgaaagctagtagtgattgggttatggatagtatgagtaaaggtacagatagttatggtgtgactactggatttggtgacacatctcatagaagaacaaaaaatggtaatgctcttcaaaaggaccttattaggttcttgaatgctggagtttttggcaatggaacagaatcatctcacactttgccacattcagcaacaagggcagctatgcttgttaggatcaacactctgcttcaaggctactctggcattagatttgaaatcttggaagcaattactaagttgatcaacagcaacatcaccccgtgtttgccccttcgtggttcgatcactgcctcgggtgatcttgtcccgttgtcatacattgttgggttgctcactggcaggcctaattccaaggctgttggacccaatggtgagaagcttaatgctgaggaagcgttgcgcgtggctggtgttagtggtggattttttgagttgcagcctaaagaaggacttgcacttgtgaatggcacagcagttgcatctggtatggcatcaatagtcgtgtttgagtccaacattcttgctgttatgtctgaagttttatcagcaattttcgctgaagtgatgaatggaaagcccgaattcacagactatttgacacacaagttgaagcatcaccctggtcagattgaggctgctgctattatggaacacattttggatggcagctcttatgtcaaggaagctcagaagctccatgaaatggatcctcttcaaaaaccaaagcaagatcgttatgctctccgaacagctccacaatggcttggccctcaaattgaagtcatacgtgcagcaactaagatgattgagagggagattaactcagtgaacgacaatccattaatcgatgtttcaagaaacaaggccttgcacggtggcaacttccaaggaacccctattggtgtctccatggataatacaagattggcccttgcatcaatagggaaattgatgtttgcccaattatcggagcttgtgaacgactattacaacaatgggttgccatctaatctctcagcaggaaggaatccaagcttggactatggtttcaagggagctgaaatcgcaatggcttcttactgctcggaacttcaatttttggctaatccagtgactaaccatgtacaaagtgctgagcaacacaaccaagatgtgaattccttgggcttaatctcagcaaggaaaaccgccgaggctgtcgacatcttgaagctaatgtcatcaacctatctcgttgcgctttgccaagctatcgacttaaggcatttggaggagaacttgaggaatgcagtcaagaacacagtaagccaagtagctaagagaactttgacaatgggtgctaatggtgaacttcatcctgcaagattctgcaaaaaggaattgctacaagttgtggacaaggaatacctatttgcctatgttgatgatccttgcaactccaactatcctttgatgcagaagttgaggcaagtccttgttgatcatgctatgaacaatggtgaaagtgagaagaatgtcaacagctcaatcttccaaaagattgtagctttcgaggacgaattgaaggttgtgttgcctaaagaagttgagagtgcaagagttgttgttgaaagtggcaaccctgcaattcctaacaggatcacagaatgcagatcatatccattgtacaggttggtgagagaagaacttggaacagaagtgttgacaggtgaaaaagttcgatcgcccggtgaagagattgacaaggtgttcacagcaatgtgcaatggacagatcattgatccattgttggagtgtctcaagagctggaatggtgctcctcttccaatctgctagatgtttgtcaaga

SEQ ID NO: 5411 - DNA, 2390 bp, Capsicum annuum
aaatggagatattgtagccattgatttatgcaataaatcaattcatgatccattgaattgggaaatggctgctgaatcattaaaagggagtcatttggatgaagtgaaaaaaatggtggatgaatttagaaagccaattgttaaacttggaggtgaaactttgacagttgcacaagttgcatccattgcaaatgctgataacaaaacttgtggggttaaagtggagctttctgaaagtgcaagggctggtgtgaaagctagtagtgattgggttatggatagtatgtgtaaaggtacagatagttatggtgttactactggttttggtgcaacatcacataggagaaccaagaatggtggtgctcttcaaaaagaacttattaggttcttgaatgctggagtttttggaaatggaactggaagttgtcacacattgccacattcagcaacaagggcagctatgcttgttaggatcaacactttgcttcaagggtactctggcattaggtttgagatcttggaagcgataacgaagttgatcaacagcaacatcaccccatgtttgcccctccgtggcacgatcactgcctcgggtgatcttgtcccgttgtcctacattgctggtttgcttactggcagacctaatgccaaggctgttggtcccaatggtgagaaacttaatgcagaggaagcgttccgcgtggctggtgttagtggtggatttttcgagttgcagccgaaggaaggacttgcacttgtgaatggtacagcagttggttctggtatggcgtcgatggtcctgtttgagtccaacattcttgctgtcatgtctgaagttttgtcagcgattttcgctgaagtgatgaatggaaagcccgagttcacggaccatctgacacacaagttgaagcaccatcctggtcagattgaggctgctgctattatggaacacattttggatggcagctcttatgtcaaggcagctcaaaagctccatgaaatggatcctctccagaaaccaaagcaagatcgttatgctctccgaacatctccacaatggctaggccctcaaattgaagtcattcgcgctgcaactaagatgatcgagagggagatcaactcagtgaacgacaatccattgatcgatgtttcaagaaacaaggccttacacggtgggaatttccaaggcacccctattggtgtctccatggataacacaagattggcccttgcatcaattgggaaattgatgtttgctcagttctcagaacttgtcaacgactattacaacaatggtttgccatctaatctcacagcaggaaggaatccaagcttggactatggtttcaagggagctgaaatcgcgatggcttcttactgctcggaacttcaattcttggcaaatccagtgactaaccatgtccaaagtgccgagcaacacaaccaagatgttaactccttgggcttaatctcatcaaggaaaacagccgaggcagttgacatcttgaagctgatgtcatcaacctatctcgtggcgctttgccaagctatagacttgaggcacttggaagaaaacttgaagaatgcagtcaagaacacagtcagccaagtagctaagagaactttgacaatgggcgctaacggtgaacttcatccagcacgattctgcgaaaaggagttgcttcgagtcgtggacagggaatacttgtttgcctatgctgatgatccctgcagctcaacctaccctttgatgcagaagctgagacaagtcctcgttgatcatgcactgaacaacggtgaaagcgagaagaatgtgaacagctcaatcttccaaaagattgcagctttcgaggacgaattgaaggccgtattgcctaaagaagttgagagtgcaagaattactcttgaaagtggcaacccttcaattcccaacaggatcacagaatgcagatcatatccgttatacagacttgtgaggaaggaacttggaactgaactgttgacaggtgaaagagtccgatcgcccggtgaggagattgacaaagtgttcacagcaatgtgcaatggacagattattgatccattgttggagtgtctcaagagctggaatggtgctcctcttccaatctattaggtgtttgcttgcaaaaaaagatcttttgttactccttgtgaaatgctatttttcaaattgtttattttatcccatggtgaattactagaatcatcataatatatatgttgtcaatttaggagccagtctgctcctatatgtggatcagaccatgtaaactagaatatctaggtagttatgtttgttagattgtcttttgtcatggagttagcatactgcatgacataaaagaaacaatccaaagatttcaagattt

SEQ ID NO: 5412 - DNA, 2519 bp, Nicotiana tabacum
aaaacaagaaaaaacaatttcaattcttagccattttctcttctccaaatctcctcacaacctttaacatttctagccaattctttattttctagccaattcttgatcaaacaatggcatcaaatggtcatgttaatggaggagaaaactttgagttgtgcaaaaaatcagctgatccattgaattgggaaatggcagctgaatccttaagagggagtcatttggatgaagtgaaaaaaatggtgagtgaatttagaaaaccaatggtaaaacttggtggtgaaagtttaacagtggcacaagtggctgctattgctgttagggacaaaagtgcaaatggtgttaaagttgaactttctgaagaggcaagagctggtgttaaagctagtagtgattgggttatggacagtatgaataaaggaactgatagttatggtgttactactggttttggtgctacatctcataggagaaccaagaatggtggtgctcttcaaaaagaacttattaggttcttgaatgctggtgtttttggcaatggaacagaaacaagccacacattgccacattcagcaacaagggcagctatgcttgttaggatcaacacactcctacaaggctactctggcatcagatttgaaatcttggaagctattacaaaattgattaacagcaacatcactccatgtttacctctccgtggaacgatcactgcctcgggtgatcttgtccctttatcctacattgctggtttgctcactggtaggcctaattccaaggctgttggtcccaatggtgagacacttaatgctgaagaagcgttccgcgttgctggtgttaacggtggatttttcgagttgcagcctaaggaaggacttgcacttgtgaatggtacagctgttggttctggtatggcatcaatggtcctctttgattccaacattcttgctgtaatgtctgaagttttatcagcaattttcgctgaagtaatgaacggaaagcccgaattcactgaccatttgacacacaagttgaagcaccaccctggtcaaattgaggctgctgctattatggaacatattttggatggaagctcttatgtgaaggcggctcaaaagctacatgaaatggatcctctacaaaaaccaaagcaagatcgttatgctctccgaacatctccacaatggcttggccctcaaattgaagtcattcgcgctgcaactaagatgattgagagggagattaactcagtgaacgataaccctttgatcgatgtttcaagaaacaaggcgttacatggtggcaacttccaaggcactcctatcggtgtttccatggataatgcaagattggctcttgcatcaattgggaaattgatgtttgctcaattctcggaacttgtcaacgactattacaacaacggtttgccctctaatctcactgcatcaaggaatccaagcttggactatggtttcaagggagctgaaatcgccatggcttcttactgctcagaacttcaattcttggcaaatccagtgacaaaccatgtccaaagtgctgaacaacacaaccaagatgtcaactccttaggcttaatctcagcaaggaaaacagctgaagctgttgatatcttaaagctcatgtcatcaacttatctcgtggcactttgccaagctatagacttgaggcatttggaagaaaacttaaagaatgcagtcaagaacacagttagccaagtagctaagagaactcttacaatgggtgctaatggtgaacttcatccagcaagattctgtgaaaaggaattgcttcgaatcgtggatagggaatacttgttcgcctacgctgatgatccttgcagttgcaactaccctttaatgcagaaactgagacaagtacttgttgatcatgcaatgaataatggtgaaagtgagaagaatgtgaacagctcaatctttcaaaagattggagctttcgaagatgaattgaaggctgttttaccaaaggaagttgagagtgcaagagctgcattagaaagtggaaaccctgctattcctaacaggattacagaatgcagatcttatccattgtacaggtttgtgagaaaggagcttggaacagaattattgacaggagaaaaagtccgatcaccgggcgaggagtgtgacaaagtgttcacagcaatgtgcaatggacaaatcattgatccaatgttggagtgtctcaagagctggaatggtgctcctcttcctatctgttagttgtttgcttgatttcgcgcggcgggaacttttgttaatgtttgtcaattgctatttttcagattctttttttactctttggtgaattactatcataatatgttgtgaacttatagttttttggttaacttaaaaagagtgttagaactcttttaaatatgttggattgtagctgtaaatgtctcttttcagtataaacctaatgaaaagtgacagtgtgcttaaatcttactggcaagtcttcttctgttagcggcc

SEQ ID NO: 5413 - DNA, 2435 bp, Solanum phureja
tttctcttcactaaaatttcttgtattactcttcttgatccaatggcaccatcaattgcacaaaatggacatgttaatggagaagtagaagaagttttgtggaagaaatcaattcatgatccattgaattgggaaatggctgttgattctttaagagggagtcatttggatgaagtaaaaaagatggtggatgaatttagaaagccaattgtgaaactttggggtgaaactttaactgttgcacaagttgcatccattgcaaatgctgataacaaaactagtgggttcaaagtggaactttctgaaagtgcaagagctggtgtgaaagctagtagtgattgggttatggatagtatgagtaaaggtacagatagttatggtgttactactggattttgtgcaacatctcatagaagaaccaaaaatggtggtgctcttcaaaaggaacttattaagtaagttcttgaatgctggagtttttggcaatggaacagaatcaactcacactttgccacattcagcaacaagggcagctatgcttgttaggatcaacactctgcttcaaggctactctggcattagatttgaaatcttggaagcaattactaagttgatcaatagcaacattaccccgtgtttgcccctccgtggaacggtcactgcctcaggtgatcttgtccctctgtcctacattgctggtttgctcactggcaggcctaattccaaggctgttggacccagtggtagcaaacttgacgctgatgaagcgttccgtgtggctgctgttagtggtggatttttcgagttgcagcctaaggaaggacttgcacttgtgaatggtacagcagttggttctggtatggcatcaattgtcctgtatgactccaatattcttgctgttatgtttgaagttttatcagcgattttcgctgaagtgatgaacggaaagcccgaattcactgactatttgacacacaagttgaagcatcaccctggtcagattgaggctgctgctattatggaacacattttggatggcagctcttatgtcaaggcagctcagaagctccatgaaatggatcctcttcaaaaaccaaagcaagatcgttatgctctccgaacatctccacaatggcttggccctcagattgaagtcattcgtgctgcaacaaagatgatcgagagggagatcaactcagtcaacgacaatccattgatcgatgtttcaagaaacaaggccatacatggtggcaacttccaaggtacccctattggtgtctccatggataatacaagattggcccttgcatcaattgggaaattgatgtttgcccaattctcggagcttgtcaacgactattacaacaatgggttgccatctaatctcacagcaggaaggaatccaagcttggactatggtttcaagggagctgaaatcgcgatggcttcttactgctcggaacttcagttcttggcaaatccagtgactaaccatgttcagagtgccgagcaacacaaccaagatgtgaactccttaggcttaatctcagcaaggaaaacagctgaggctgtcgacatcttaaagctaatgtcatcaacctatctcgtggcactttgccaagcaatagacttgaggcatttggaggagaacttgaagagtgttgtcaagaacacagttagccaagtagctaagagaactttgacaataggtgctattggtgaacttcatccagcaagattctgcgagaaggaattgcttcgagtcgtagacagggaatacttgtttacctatgctgatgacccctgcagctccacctatcctttgatgcagaagctgagacaggtccttgttgatcatgcaatgaagaatggtgaaagtgagaagaatatcaacagctcaatcttccaaaagattggagctttcgaggacgaattaaatgctgtgttgcctaaagaagttgagagtgcaagagctcttcttgaaagtggcaacccttcgattcctaacaggatcacagaatgcagatcatatccattgtacaggttggtgagacaagaacttggaacagaactgttgacaggtgaaaaagttcgatcgccgggcgaggagattgaaaaggtgttcacagcaatgtgcaatggacagatcattgatccattgttggagtgtctcaagagctggaatggtgctcctcttccaatctgctagatgtttgtcaagtgttaatttttcaaattctttttttaccttttggtgaattattagaatcataatataattttattgtcttttggactgtatgtaatatagacatgttgaaatgaaggaaaaattaaaatgtagcaacaattctggaaggatgtattgactatccttaaaaggatatattgactaatcatgaatcaattaaacattttgattttgagccggctag

SEQ ID NO: 5414 - DNA, 2111 bp, Solanum phureja
tggctatggatttgtgcaagaaatcaaattatgatccattaaattgggaaatggctgctgattctttaagagggagtcatttggatgaagtgaaaaagatggtggatgaatttagaaagccaattgtgaaacttggggtgaaactttctgttgcacaagttgcatccattgcaaatgttgataacaaaagtaatggggtcaaagtggaactttctgaaagtgcaagggctggtgtgaaagctagtagtgattgggttatggatagtatgagtaaaggtacagatagttatggtgttactacaggatttggtgcaacatctcatagaagaacaaaaaatggtggtgctcttcaaaaagaacttattaggttcttgaatgctggagtttttggcaatggaacagaatcatctcacacattgccacattcagcaacaagggcagctatgcttgttaggatcaacactctgcttcaaggctactctggcattagatttgaaattttggaagcaatcactaagttgatcaacagcaacatcaccccgtgcttgcctctccgtggtacgatcactgcctcgggtgatcttgtacctttgtcctacattgctggtttgctcactggcaggcctaattccaaggctgttggacccaatggtgagaaacttgacgctgatgaagcgttccgtgtggctggtgttagtggtggatttttcgagttgcagcctaaggaaggacttgcacttgtgaatggcacagcagttggttctgctatggcatcaatagtcctgtttgagtccaacattcttgctgttatgtctgaagttttatcagcgattttcgctgaagtgatgaacggaaagcccgaattcactgactatttgacacacaagttgaagcatcaccctggtcagattgaggctgctgctattatggaacacattttggatggcagctcttatgtcaaggcagctcagaagctccatgaaatggatcctcttcaaaaaccaaagcaagatcgttatgctctccgaacatctccacaatggcttggccctcagattgaagtcattcgtgctgcaacaaagatgatcgagagggagatcaactcagtcaacgacaatccattgatcgatgtttcaagaaacaaggccatacatggtggaaatttccaaggcacccctattggtgtctccatggataatacaagattggcccttgcatcaattgggaaattgatgtttgcccaattctcggagcttgtcaacgactattacaacaatgggttgccatctaatctcacagcaggaaggaatccaagcttggactatggtttcaagggcgctgaaattgcgatggcttcttactgctcggaacttcaattcttggcaaatccagtgactaaccatgttcagagtgccgagcaacacaaccaagatgtgaactccttaggcttaatctcagcaaggaaaacagctgaggctgtcgacatcttaaagctaatgtcatcaacctatctcgtggcactttgccaagctatagacttacggcatttggaggagaacttgaagagtgctgtcaagaacacagttagccaagtagctaagagaactttgacaataggtgctattggtgaacttcatccagcaagattctgcgagaaggaatgagtcgtggacagggaatacttgtttgcctatgcagatgacccctgcagctccaactaccctttgatgcagaagctgagacaagtccttgttgatcaagcaatgaagaatgctgaaagtgagaagtgtgtcaacagctcaatcttccaaaagattggagctttcgaggacaaattaatcgctgtgttgcctaaagaagttgaagagtgcaagagctcttcttgaaagtggcaacccttcgattcctaacaggatcacagaatgcagatcatatccattgtacagattggtgagacaagaacttggaacagaattgttgacaggtgaaaaagttcgatctcccggtgaggagattgacaaggtgtttacagcaatgtgtaatggacagattattgatccattgttggagtgtctcaagagctggaatggtgctcctcttccaatctgcta

SEQ ID NO: 5415 - DNA, 2527 bp, Nicotiana tabacum
caacattatacccatccctctatttataccacaattcttagcttcaataaccaggatctttctacccatcctcacatttaattaataacccaattcttgtttccaaaaatataccttcaatttttcactagacaaaccaacccctttacacttttactccattttcttgaatcatttcattttatttcatctacacaaaaaaaaatggctggtgttgcacaaaatggtcaccaagaaatggatttttgcatgaaagtggatccattaaactgggaaatggcagctgattcattgaaaggaagccatttagatgaagtgaagaaaatggtggctgagtttaggaaaccagtagtgaaacttggaggtgagactttgacagtggctcaagttgcggctattgctgcaaaagataatgttaaaactgttaaagtggagctttctgaaggggcaagagctggtgttaaagctagcagtgattgggttatggacagtatgggtaaaggaactgatagttatggtgttacaactggctttggtgctacttcacataggaggaccaagaatggtggtgctcttcaaaaggaacttattaggttcttgaatgctggagtttttggcaatggaacagagtcatgtcacacattaccacaatcagggacaagggcagctatgttagttaggatcaacactctccttcaagggtactctggcatcagatttgaaatcttagaagcaatcactaaattgcttaaccacaatgttactccatgtttgccccttcgcggcaccatcaccgcctctggtgatctcgtccccttgtcctacattgccggtttactcactggtcggcctaattctaaagcagttggacctaatggcgaaaccctcaacgctgaagaagcgtttcgtgttgctggagttaacggtggatttttcgagttgcagcctaaggaaggccttgctcttgtgaatggtactgcagttggttctggtttggcctcaatggttctctttgatgctaatgttctcgcggtcttttctgaagttctctcagctatttttgctgaggtaatgaatggaaagcccgagttcactgaccacttgacacacaagttgaagcatcaccccggacaaattgaggctgctgctattatggaacacattttggatggtagctcttatgtgaaggcggctcagaagcttcacgaaacggatcctctccaaaaaccaaagcaagatcgttatgctcttagaacgtcgccccaatggcttggccctcaaattgaggtcatccgttctgcaaccaagatgattgagagggagattaattcagtgaacgacaaccctttgatcgatgtttcaagaaacaaggcattacacggtggcaacttccagggcactccaattggtgtctctatggacaatgctagattagcccttgcatcaatagggaaattgatgtttggccaattctccgagcttgtcaacgattactacaacaacggattgccatctaatctgacagcaggaaggaatcctagcttggactatggtttcaagggatctgagattgccatggcttcatactgttcagaacttcaattcttggcaaatccagtgactaaccacgtacaaagcgccgagcaacacaaccaagatgtgaactccttgggcttaatctcagctagaaaaacagctgaagccgtggacatcttaaagctaatgtcatccacatatctagttgcactttgccaagcaatagacttgaggcatttggaagaaaatctgaggaatgcagtcaagaacacggtgagccaagtcgcaaagagaactttaacaatgggtaccaatggagaacttcatccatcaagattctgtgaaaaggacttgcttcgagtcgtggacagggaatacgtcttcgcctatgctgacgacgcctgcagcgctaactacccactgatgcagaaactaaggcaagtcctcgtcgaccacgccttgcaaaatggcgaaaatgagaagaacgcaaacagctcaatcttccaaaagatactagcttttgaagacgagctaaaggccgtgttgccaaaagaagtcgagagtgcaagagccgcgctggaaagtgggaaccctgcaattgccaacaggataaaagaatgcagatcttatccactttacaggtttgttagaggagaacttggagctgaattattgacgggagaaaaagtcaggtcaccaggtgaagaatgtgacaaagtgttcacaacaatgtgcaatggacaaattattgattcattgttagaatgtctcaaggaatggaatggtgcacctcttccaatctgttagaagttggttctcaaacaacaggatctttgttaatgtttgtcaattacctgttatttttctatttttactttttctttttggggttgattaaatgtaaactctcttgaatatgttggtttgtagttgtattagtctcttttccgtacaaataaatgaaaagtgacaatgtgcttatatgttcttg

SEQ ID NO: 5416 - DNA, 2532 bp, Nicotiana tabacum
tctacccatcctcacatttaattaataacccaattcttgctccaaaatataccttcaatttttcactagacaaaccaacccctttacacttttgtccattttcttgaatcatttcatttcatctacaaaaagaaaaatggctggtgttgcacaaaatggtcaccaagaaatggatttttgcgttaaagtggatccattgaactgggaaatggcagctgattcattgaaaggaagccatttagatgaagtgaagaaaatggtggctgagtttaggaaaccagtagtgaaacttggaggtgagactttaacagtggcacaagttgcggctattgctgcaaaagataatgctaaaactgtaaaagtggagctttctgaaggagcaagagctggtgttaaagctagtagtgattgggttatggatagtatgagtaaaggaactgatagttatggtgttactactggttttggtgctacttcacataggagaaccaagaacggtggtgctcttcaaaaggaactaattaggttcttgaatgctggagtttttggcaatggaacagagtcatgtcacacattaccacaatcagggacaagggcagctatgctagttagaatcaacacactcctacaaggatattctggcatcagatttgaaatcttggaagcaatcactaaattgcttaaccacaatgtcactccatgtttgccccttcgcggcacaatcaccgcctctggtgatctcgtccccttgtcctacattgctggtttactcacaggtcggcctaattccaaagccattggacctaatggtgagaccctcaatgctgaagaagcgttccgtgttgctggagttaacagtggatttttcgagttgcagcctaaggaaggccttgctcttgtgaatggtactgcagttggttctggtttggcctcaatggtcctctttgatgctaacattctcgcggtcttttctgaagttctctcagctattttcgctgaggtgatgaatggaaagcccgagttcactgaccacttgacacacaagttgaagcatcaccccggacaaattgaggctgctgctattatggaacacattttggatggtagctcttatgtgaaggcgcctcagaagcttcacgaaacggatcctcttcaaaaaccaaagcaagatcgttacgccctcagaacatcaccccagtggcttggccctcaaattgaggtcatccgttctgcaaccaagatgattgagagagagattaactcagtgaacgacaaccctttgattgatgtttcaagaaacaaggcgttacacggtggcaatttccagggcacaccaattggtgtctctatggacaacgctagattagcccttgcttcaattgggaaattgatgtttgcccaattctccgagcttgtcaacgattactacaacaacgggttgccatctaatctgacagcaggaaggaatccaagcttggactatggtttcaagggatctgagattgccatggcttcatactgttcagaacttcaattcttggcaaatccagtgactaaccacgtacaaagcgccgagcaacacaaccaagatgtgaactccttgggcttaatctcagctagaaaaacagctgaagctgtggacatcttaaagctaatgtcatccacatatctagtcgcactttgccaagcgatagacttgaggcatttggaagaaaatctgaggaatgcagtcaagaacacggtgagccaagtcgctaagagaaccttgacaatgggtgccaatggagaacttcatccatcaagattctgcgaaaaggacttgcttcgagtcgtggacagggaatacgtctttgcttacgctgatgacgcctgcagcgccaactacccactgatgcagaaactaaggcaagtccttgtcgaccacgccttagaaaatggcgaaaatgagaagaacgcgaacagctcaatattccaaaagatactagcttttgaaggcgagttaaaggccgtgttaccaaaagaagtcgagagtgcaagaatctcgctggaaaatgggaaccctgcaattgccaacaggataaaggaatgcagatcttatccactctacaggtttgttagagaagaacttggagctgaattattgacaggagaaaaagtcaggtcaccaggtgaagaatgtgacaaagtgttcacagcaatgtgcaatggacaaattattgattcattattagagtgtctcaaggaatggaatggtgctcctcttccaatctgttagaagttggttctcaaacaacaggatctttgtttatgtttgtcaattacttgttatttttctattaatttttatatttactttttcttttgaggttgattaattgtaaactctgttgaatatgttggtttgtagttatataagtctcttttcagtaaaaataaatgaaaagtgacaatgtgcttatatgttcttgaaattttactctctcataatcattcgtccgatagggggaagggtccaaaaagggggcaccatgt

SEQ ID NO: 5417 - DNA, 2461 bp, Solanum tuberosum
gatatttaatttacatcattctcccttcaacaatctttgctctacacaaatttcttcaatcttttcactaaaccaaccaacccctttaccttttcttgaattttttcacaacccctttatattttcttgaatcttttcacataaaaatccaatcttttttacattttcttgaaaaaaaaatggctggtgctattgatggtcatcaagatttggacttttgcatcaaagtggatccattgaactgggaaatggcagcagagtcattgaggggtagccatttagatgaagtgaagaagatggtggcagagtttaggaagccagttgtgaaacttggtggtgaaacattgacagttgcacaagttgcttcaatagctgcaaaggttaatgttgaaaatgtgaaagtggagctttctgaggatgctagggctggtgttaaagctagtagtgattgggttatggaaagtatgagcaaagggactgatagctatggtgttactactggttttggtgctacatctcataggagaaccaaaaatggtggtgctttacaaaaggaacttattagattcttgaatgctggagtttttggcaatggtactgagtcatgtcacacattgccacaatcaagcacaagggcagccatgcttgttaggatcaatactcttcttcaggggtactctggcatcagatttgaaatcttggaagctatcactaagttgattaaccacaatgtcactccatgtttgcctcttcgtggcacaatcaccgcgtcgggtgatcttgttcccttgtcctacattgctggattgctcactggcaggtctaattccaaggctgttggacctaatggtgagacgttgaatgctgaggaagcgttccgtgttgctggagttaatggtggattttttgagctgcagcctaaggaaggacttgctcttgtgaatggtactgctgttggttctggtttggcttcgattgtgttgtttgatgctaatgtgctcgcggtattttctgaagttctctcggctatttttgctgaggtgatgaatggaaagcctgagttcactgatcatttgacgcataaattgaagcatcatcctggacaaattgaggcagctgcaatcatggaacacattttggatgggagtgcttatgtgaaggcagctcagaagctacatgaaatggatcctttgcagaaaccaaagcaagatcgttatgctcttagaacgtcaccacaatggcttggccctcagattgaagttattcgttctgcaaccaagatgatcgagagggagattaattcagtgaacgacaaccccttgatcgatgtttcaagaaacaaggctttacatggtggcaatttccagggcactccaattggtgtctctatggacaatgctagattagcccttgcatcaatagggaaattgatgtttgcacaattctccgagcttgtcaacgattactacaacaatgggctgccatctaatctgactgcaggtaggaatccaagcttggactacggtttcaagggatctgagattgctatggcttcatactgttcggagcttcaattcttggcaaatccagtgactaaccacgtacaaagcgcagagcaacacaaccaagatgtgaactccttgggcttaatctcagcaagaaaaacagctgaagcagtggacatcttgaagctaatgtcatccacatacctagtggcactttgtcaagctatagacttgaggcatttggaagagaatttgagaaatgctgtcaagaacacggtgagccaagtagctaagaggaccttgacaatgggtgccaacggagaacttcatccatcaagattctgcgagaaagacttgctccgcattgtggacagggaatacctcttcgcctatgctgatgacccctgcagtgctaactacccactgatgcagaaactgagacaagtcctcgtagaccatgccttgcaaaacggtgaaaatgagaagaatgcaaacagctcaatctttcaaaagattgtagcttttgaagaagagttgaagtctgttttaccaaaagaagtcgagagtgccagagtcgcgttggaaagtggaaaccccgcgattgcaaacaggatcaacgaatgcagatcataccccctctacaagtttgttagggaggagctcgggacggaattgttgacaggagaaagagtaaggtcaccaggtgaagaatgtgacaaggtattcacagcaatgtgcaatggacaaatcattgattcattgttagaatgccttaaggaatggaatggtgctccacttccaatctgttagaagtgaagcaacaggttttattatgttaatgtttgtcaattactttgccatttttgaattattttttacatttacttttggagttataactaaatatgaactctcttgaatatgttggtttgtagctatgtattattataagtctc

SEQ ID NO: 5418 - DNA, 2502 bp, Solanum tuberosum
gatatttaatttacatcattctcccttcaacaatctttgctctacacaaatttcttcaatcttttcactaaaccaaccaacccctttaccttttcttgaattttttcacaacccctttatattttcttgaatcttttcacataaaaatccaatcttttttacattttcttgaaaaaaaaatggctggtgctattgatggtcatcaagatttggacttttgcatcaaagtggatccattgaactgggaaatggcagcagagtcattgaggggtagccatttagatgaagtgaagaagatggtggcagagtttaggaagccagttgtgaaacttggtggtgaaacattgacagttgcacaagttgcttcaatagctgcaaaggttaatgttgaaaatgtgaaagtggagctttctgaggatgctagggctggtgttaaagctagtagtgattgggttatggaaagtatgagcaaagggactgatagctatggtgttactactggttttggtgctacatctcataggagaaccaaaaatggtggtgctttacaaaaggaacttattagattcttgaatgctggagtttttggcaatggtactgagtcatgtcacacattgccacaatcaagcacaagggcagccatgcttgttaggatcaatactcttcttcaggggtactctggcatcagatttgaaatcttggaagctatcactaagttgattaaccacaatgtcactccatgtttgcctcttcgtggcacaatcaccgcgtcgggtgatcttgttcccttgtcctacattgctggattgctcactggcaggtctaattccaaggctgttggacctaatggtgagacgttgaatgctgaggaagcgttccgtgttgctggagttaatggtggattttttgagctgcagcctaaggaaggacttgctcttgtgaatggtactgctgttggttctggtttggcttcgattgtgttgtttgatgctaatgtgctcgcggtattttctgaagttctctcggctatttttgctgaggtgatgaatggaaagcctgagttcactgatcatttgacgcataaattgaagcatcatcctggacaaattgaggcagctgcaatcatggaacacattttggatgggagtgcttatgtgaaggcagctcagaagctacatgaaatggatcctttgcagaaaccaaagcaagatcgttatgctcttagaacgtcaccacaatggcttggccctcagattgaagttattcgttctgcaaccaagatgatcgagagggagattaattcagtgaacgacaaccccttgatcgatgtttcaagaaacaaggctttacatggtggcaatttccagggcactccaattggtgtctctatggacaatgctagattagcccttgcatcaatagggaaattgatgtttgcacaattctccgagcttgtcaacgattactacaacaatgggctgccatctaatctgactgcaggtaggaatccaagcttggactacggtttcaagggatctgagattgctatggcttcatactgttcggagcttcaattcttggcaaatccagtgactaaccacgtacaaagcgcagagcaacacaaccaagatgtgaactccttgggcttaatctcagcaagaaaaacagctgaagcagtggacatcttgaagctaatgtcatccacatacctagtggcactttgtcaagctatagacttgaggcatttggaagagaatttgagaaatgctgtcaagaacacggtgagccaagtagctaagaggaccttgacaatgggtgccaacggagaacttcatccatcaagattctgcgagaaagacttgctccgcattgtggacagggaatacctcttcgcctatgctgatgacccctgcagtgctaactacccactgatgcagaaactgagacaagtcctcgtagaccatgccttgcaaaacggtgaaaatgagaagaatgcaaacagctcaatctttcaaaagattgtagcttttgaagaagagttgaagtctgttttaccaaaagaagtcgagagtgccagagtcgcgttggaaagtggaaaccccgcgattgcaaacaggatcaacgaatgcagatcataccccctctacaagtttgttagggaggagctcgggacggaattgttgacaggagaaagagtaaggtcaccaggtgaagaatgtgacaaggtattcacagcaatgtgcaatggacaaatcattgattcattgttagaatgccttaaggaatggaatggtgctccacttccaatctgttagaagtgaagcaacaggttttattatgttaatgtttgtcaattactttgccatttttgaattattttttacatttacttttggagttataactaaatatgaactctcttgaatatgttggtttgtagctatgtattattataagtctcttttttttcaatgaaaataaaagaaaagtgaacttgtgctt

SEQ ID NO: 5419 - DNA, 2606 bp, Solanum phureja
aggatctttctacccatcctcacatttaatttacatcattctcccttcaacaatctttgctctatacatatttcttcaatcttttcactaaaccaaccaacccctttacattttcttggaccatttcaccaaaaaaaacaacccctttaccttttcttgaattttttcacaaaccccttttcattttctcgagtcttttcaccaaaaaaaacaacccctttatattttcttgaatcttttcacataaaaatccaatcttttttacattttcttgaaaaaaaaaatggctggttttattgatggtcatcaagatttggacttttgcatcaaagtggatccattgaactgggaaatggcagcagagtcattgaggggtagccatttagatgaagtgaagaagatggtggcagagtttaggaagccagttgtgaaacttggtggtgaaacattgacagttgcacaagttgcttcaatagctgcaaaggttaatgttgaaaatgtgaaagtggagctttctgaggatgctagggctggtgttaaagctagtagtgattgggttatggaaagtatgagcaaagggactgatagctatggtgttactactggttttggtgctacatctcataggagaaccaaaaatggtggtgctttacaaaaggaacttattagattcttgaatgctggagtttttggcaatggtactgagtcatgtcacacattgccacaatcaagcacaagggcagccatgcttgttaggatcaatactcttcttcaagggtactctggcatcagatttgaaatcttggaagctatcactaagttgattaaccacaatgtcactccatgtttgcctcttcgtggcacaatcaccgcgtcgggtgatcttgttcccttgtcctacattgctggattgctaactggcaggcctaattccaaggctgttggacctaatggtgagacgttgaatgctgaggaagcgttccgtgttgctggagttaatggtggattttttgagctgcagccgaaggaaggacttgctcttgtgaatggtactgctgttggttctggtttggcttcgattgtgttgtttgatgctaatgtgctcgcggtattttctgaagttctctcggctatttttgctgaggtgatgaatggaaagcccgagttcactgatcatttgacgcataaattgaagcatcatcctggacaaattgaggcagctgcaatcatggaacacattttggatgggagtgcttatgtgaaggcagctcagaagctacatgaaatggatcctttgcagaaaccaaagcaagatcgttatgctcttagaacgtcaccacaatggcttggccctcagattgaagttattcgttctgcaaccaagatgatcgagagggagattaattcagtgaacgacaaccccttgattgatgtttcaagaaacaaggctttacatggtggcaatttccagggcactccaattggtgtctctatggacaatgctagattagcccttgcttcaatagggaaattgatgtttgcacaattctccgagcttgtcaacgattactacaacaatgggctgccatctaatctgactgcaggtaggaatccaagcttggactacggtttcaagggatctgagattgctatggcttcatactgttcggagcttcaattcttggcaaatccagtgactaaccacgttcaaagcgcggagcaacacaaccaagatgtgaactccttgggcttaatctcagcaagaaaaacagctgaagcagtggacatcttgaagctaatgtcatccacatacttagtggcactttgccaagctatagacttgaggcatttggaagagaatttgagaaatgctgtcaagaacacggtgagccaagtagctaagaggaccttgacaatgggtgccaatggagaacttcatccatcaagattctgcgagaaagacttgctccgcatcgtggacagggaatacctcttcgcctatgctgatgacccctgcagtgctaactacccactgatgcagaaactgagacaagtcctagtagaccacgccttgcaaaacggtgaaaatgagaagaactcaagcagctcaatctttcaaaagattgtagcttttgaagaagagttgaagtctgttttaccaaaagaagttgagagtgccagagtcgcgttggaaagtggaaaccctgcgattgcaaacaggatcaacgaatgcagatcatacccgctctacaagttcgttagggaggagctcgggacggaattgttgacaggagaaagagtaaggtcaccaggtgaagaatgtgacaaggtgttcacagcaatgtgcaatggacaaatcattgattcattgttagaatgccttaaggaatggaatggtgctccacttccaatctgttagaagtgaagcaacaggttttattatgttaatgtttgtcaattactttgctatttttgaattattttttacatttacttttggagttaaaactaaatatgaactctcttgaatatgttggtttgtagctatatattattaagtctctctttttttcaatgaaaataaaagaaaagtgaccttgtgctta

SEQ ID NO: 5420 - DNA, 2315 bp, Solanum phureja
atccaatggcctcatcaattgcgcaaaatgtacatgtcaatgttcatgatccattaaattgggaaatggctgctgaatctttaagagggagtcatttggatgaagtgaaaaagatggtgtatgaatttaggaagccaattgtgaaacttgagggtgagaatttgactattggacaagttgcatccattgcaaatgccaataacaaaactagtggggtcaaagtggaactttctgaaagttcaagggcttgtgtgaaagctagtagtgattggattatggatagtgtcagtaaaggaagagatatttatggtattactactggttttggtgctaattctaaaagaagaaccaaaaatggaggtggtcttcaaaaggaacttattaggttcttgaatgctggagtatttggcaatggaacagaaacttgtcatacattgccacattcagcaacaagggcagctatgcttgttaggatcaacactctgcttcaaggctactctggcattagatttgaaatcttggaagcaattactaagttgatcaacaacaacatcaccccgtgtttgcccctccgtggcacgctcactgcctcgggtgatcttgtccctctatcctacattgctggtttgctcattggtaggcctaattccaaggctgttggacccaatggtgagatccttaatgctgaagaagcgttccgtgttgctggtattagtggtggatttttcgagttccagcctaaggaaggatttgcaattacaaatagcacagcagttggctctggtatggcatcaattgtcctgtttgagtccaacattcttgctgtaatgtctgaagttttgtctgcgattttcgctgaagtgatgaatggaaagcctgaattcactgaccatttgacacacaagttgaagtatcatcctggtcaaattgaggctgctgctattatggaacacattttggatggcagctcttatgtgaaggcagctcaaaagcttcatgaaatggatcctcttcaaaaaccaaagcaagatcgctatgctctccgaacatctccacaatggcttggtcctcaaattgaagtcattcgcgctgcaactaagatgattgagagggagattaactcagtgaacgacaatccattgatcgatgtttcaagaaacaaggcattgcatggtggtaacttccaaggcacccctgttggtgtctctatggataatacaagattggctcttgcatcaattgggaagttgatgtttgctcagttctcggaacttgtcaacgactattacaacaatgggttgccatctaatctcacaggaggaagggatccaagcttggactatggtttcaagggagctgaaatcgcgatggcttcttactgctcagaacttcagttcttggcaaatccagtgactacccatgtccaaagtgctgagcaacacaaccaggatgtgaattccttgggcttaatctcagctaggaaaacagctgaggctgtcgatatcttgaagctaatgtcatcaacctatatagtggcactttgccaatctatagacttgaggcatttggaggagaacttgaagaatgcagtaaaggacacagttagccgagtagctaagagaactttgacaatggatgctaatggtgagcttcatccagcaagattctgcgaaaaggaattgcttctagtcgtggacagggaatacttgtttgcctatgctgatgatccttgcagttccaactaccctttgatgcagaagctgagacaagtccttgttgattatgcaatgaagaatggtgaaagtgagaagaatgtgaacagctcaatattccaaaagattggagctttcgaggacgaattaaaggttgtgttgcctaatgaggttgagaatgcaagagttattcttgaaagtggcaacccttcaattcctaacaggatcacagaatgcagatcatatccattgtacaggtttgtaaggaaagaacttggaacagaattgttgacaggagaaagagttcgatctcccggcgaggatattgacaaggtgttcacagcattgtgcaatggacaaatcattgatccattgttggagtgtctcaagagctggaatggtgctcctctgccaatctgttaggtgtttgcttgcaaaaggaggacctttttgtggaagtaatggtgaaaaagatgtattgtatttggatttggctttgtttttttcttgcatatgtttgtttcacgttgtttagacatctcatttaacacacgacaacaataaatatgtttcagtttcaaataagttgggtcgattttatga

SEQ ID NO: 5421 - DNA, 2136 bp, Ipomoea nil
atggactcagtgaagctgcagaataatggccaccaaaatggcttctgcgtcaaggttgatcctttgaactgggaggtggctgccgactcattgagggggagccacctggatgaagtgaaagtaatggtggccgagtttaggaagccggcggtgaagctcggcggagagacgctcacggtggctcaggtggcagctatcgcctcccgcgacaatgccgtcacggtggagctctccgaggagtcccgcgccggcgttaaggccagcagtgattgggtgatggatagcatgaacaaagggactgatagctacggcgtcaccaccggcttcggcgccacctctcaccgtagaaccaaacaaggtggcgctcttcagaaggagctcattaggtttttgaatgctggaatattcggcaatggaacagaatcatgtcacactcttccccattcagcaacaagagccgccatgcttgtcagaatcaacacccttcttcaaggatactctggcattagatttgaaatcttggaagcaatcactaaattgctgaaccacaacattaccccctgcctgcccctccgtggcacaatcactgcctccggtgaccttgtcccgttatcctacattgctggcttgatcaccggccgccccaactccaaggccgtcggacccaacggggagaccctcaacgcagaggaagctctgcggttagccggagtgaacggaggatttttcgagttgcagcccaaggaaggacttgccctcgttaatgggaccgccgttggttctggcatggcctctatggttcttttcgaggctaacgttcttgcagtgctgtctgaggttctgtcggctatttttgctgaagtcatgaacgggaaaccagaatttaccgaccatttgacgcataagttgaagcatcaccccgggcagattgaagctgctgctattatggaacatattttggacggcagctcttacgtgaaggcggctcagaagatgcacgaaatggatcctttgcagaaacccaaacaggatcgctatgccctccgcacttcgccgcaatggctcggccctcagattgaagtcattcgtgctgcaaccaaaatgattgagagggagatcaactctgtcaacgacaaccctctcatagatgttgccagaagcaaggccttgcacggtggcaacttccagggtacaccaatcggtgtgtctatggacaactcaagattagcccttgcatctatcggcaagttgttgtttgcccagttctctgagcttgtgaacgactattacaacaatgggttgccttctaatctcacagcagggaggaatccaagcttggattatggtttcaagggcgctgaaatcgccatggcttcttactgctccgagctgcaattcttggctaatccggttactaaccatgtccagagtgctgagcagcacaaccaggatgtgaactccttgggtttgatctcagctaggaagactgctgaagctgtggacgtgttgaaactcatgtcatccacttatctcgtggcgctttgccaagctattgacttgaggttcttggaggagaacttgaggaatgctgtgaagaatgcagttacacaggtagctaagaggactctcactatgggtgctaatggagaacttcatcccgcaaggttttgcgagaaagacttgctccgagtggtggaccgcgaatatgtctttgcatatgccgatgatccctgcagtgctaactacccactgatgcagaaactccgccaagccctggttgatcacgccttgcagaacggggaaagtgagaagaacaccggcacttcaattttcctaaaggttgcagcttttgaagatgaattgaaggctgttctgccaaaagaagttgaggctgcaaggatcgctgtagagagtgggaacccggctattccaaacaggattaaggagtgcaggtcttacccattgtacaagtttgttcgtgaaggcctgggcaccgagttgctgaccggagagaaggtccggtcaccgggcgaagagtgtgacaaggtgttcacagctatgtgtgagggaagtatcatagatcctttgctggaatgtcttaagagctgggatggtgctcctcttcctatctgttaa

SEQ ID NO: 5422 - DNA, 2625 bp, Solanum lycopersicum
acctcaattcactacttcaataatcaggatctttctacccatcctcacatttattttacatcattctctcttcaacaatcttttgctctatacaaatttcttcaatctttttcactaaaccaaccaacccctttacatttcttggaccatttcaccaaaacaaacaacccctttacattttcttgaattttttcacaaccccttttcattttcttgagtcttttcaccaaaaaaaaacaacccctttatattttcttgaatcttttcacataaaaatccaatctttatacactttcttgaaaaaaaaatggctggtgtcattaatggtcagcaagatttggacttttgcatcaaagtggatccattgaactgggaaatggcagcggagtcattgaggggtagccatttagatgaagtgaaaaagatggtggcagagtttaggaagccagttgtaaaacttggtggtgaaacattgacagttgcacaagttgcttcagtagctgcaaaggttaatgttgaaaatgtgaaagtggagctttgtgaggatgctagggctggtgttaaagctagtagtgattgggttatggaaagtatgagtaaagggactgatagctatggtgttactactggttttggtgctacatctcataggagaacaaaaaatggtggtgctttacaaaaggaacttattagattcttgaatgctggagtttttggtaatggtactgagtcatgtcacacattgccacaatcaagcacaagggcagccatgcttgttaggattaatactcttcttcaggggtactctggcatcagatttgaaatcttggaagctatcactaagttgattaaccacaatgtcactccatgtttgcctcttcgtggcacaatcactgcatccggtgatcttgttcctttgtcctacattgctggattgctcactggcaggcctaattccaaggctgttggacctaatggtgagacgttgaatgctgaggaagcgttccatgttgctggagttaatggtggattttttgagctgcagcctaaggaaggacttgctcttgtgaatggtactgctgttggttctggtttggcttcgattgtgttgtttgatgctaatgtgctcgcggtattttctgaagttctctcggctatttttgctgaggtgatgaatggaaagcccgagttcactgatcatttgacgcataaattgaagcatcatcctggacaaattgaggctgctgcaatcatggaacacattttggatgggagtgcttatgtgaaggcagctcagaagctccacgaaatggatcctttgcagaaaccaaagcaagatcgttatgctcttagaacgtcaccacagtggcttggccctcagattgaagttattcgttctgcaaccaagatgatcgagagggagattaattcagtgaacgacaaccccttgattgatgtttcaagaaacaaggctttacatggtggcaatttccagggcactcccattggtgtctctatggacaatgctagattagcccttgcatcaatagggaaattgatgtttgcacaattctccgagcttgtcaacgactactacaacaatgggttgccatctaatctgactgcaggaaggaatccaagcttggactacggtttcaagggatctgagattgctatggcttcatactgttcagagcttcaattcttagcaaatccagtgactaaccacgtacaaagcgcggagcaacacaaccaagacgtgaactccttgggcttaatctcagcaagaaaaacagctgaagcagtggatatcttgaagctaatgtcatccacatacctagtggcactttgtcaagctatagacttgaggcatttggaagagaatttgagaaatgctgtcaagaacacggtgtgccaagtagctaagaggaccttgacaatgggtgccaacggagaacttcatccatcaagattctgcgagaaagacttgctccgcattgtggacagggaatacctcttcgcttatgctgatgacccctgcagcgctaactacccactgatgcagaaactgagacaagtcctcgtagagcacgccttgcaaaacggtgaaaatgagaagaatgcaagcagctcaatctttcaaaagattgtagcttttgaagaagagttgaagtctgttttaccaagagaagtcgagagtgccagagtcgcgttggaaagtggaaaccccgcgattgcaaacaggatcaacgaatgcagatcatacccgctctacaagtttgttagggaggagctcgggacggaattgttgacaggagaaagagtaagatcaccaggtgaagaatgtgacaaggtgttcacagcaatgtgcaatggacaaatcattgattcattgttagaatgccttaaggaatggaatggtgctccactaccaatctgttagaagtgaagcaacaggttttattatgttaaatgtttgtcaattacttcaattattttttacatttaccattttggagttaaaaactaaatatgaactctcttgaatatgttggtttgtagctatatattattacaagtccttttttattctatgaaaataaaagaaaagtgaccttgtgctta

SEQ ID NO: 5423 - DNA, 2516 bp, Ipomoea nil
  misc_feature (11)..(11): n is a, c, g, or t
agtctacaccnacctaccaaaaatccctgtagcttcatttccccctatatatatcatcttcctcagctaccacttctcccaggacctcttacaagatatcctcaacaaccatctcacaatcttagcaatccaagctcttttctctccttcctgttcttcggatcacctcaatttctgtcctctctttcaacacaacaatggagggcgccattgaaaacggccacagcaatgatttctgcatcaaggttgatccgctgaactgggaaatggcggccgactcattgaagggcagccacttggatgaggtcaagcgcatggtggcggagttcaggaacccggcggtgaagatcggaggccagacactcaccgtcgctcaggtcgccgctatcgccgcccgtgataatgccgtgaaagtggagctctcagagggtgcccgcgccggcgtgaaagccagcagtgactgggttatgaacagcatgaacaatggcaccgatagctacggcgtcaccaccggcttcggcgccacctctcaccggagaaccaagaacggccatgctcttcagcaggagctcatcaggttcttgaatgctggaatttttgggactggaacagggcacacacttcctcattcagctacaagggcagctatgcttgtgaggatcaacacccttcttcaaggatactccggcatcagatttgagatcttggaagccattactaaattgctcaaccataatatcactccgtgtctgcctctccgtggcacaatcaccgcctccggtgaccttgtgcctttatcctacatcgccggattgctcaccggccgccctaattccaaggcggttggacccaacggtgaggccctcaccgcggaggaggcgttcaaactcgccggagtccagggtgggttcttcgagttgcagcctaaggaagggcttgcacttgtgaatggaactgctgtgggttctggcatggcgtctatggttctgtttgaggctaatgttcttgcggtgttgtctgaggttttgtctgcaattttcgctgaggtgatgaatgggaagccggagtttaccgaccatttgactcataagctgaagcatcatcctggtcaaattgaggctgctgctataatggaacatattttggatagaagctattacatgaaggctgcacagaaactgcacgaaatggatccattgcagaaacccaaacaagatcgttatgctctgagaacatctccccagtggctcggccctcagattgaagtgataagacaagcaaccaaaatgattgagagggaaatcaactctgtcaacgacaaccctttgatcgacgtttcaagaaacaaggccttacacggtggcaatttccaaggtacccccattggtgtgtccatggacaattctagattagcccttgcctccatcggaaaactcatcttcgcgcaattctctgagcttgttaacgactattacaacaacggattgccgtccaatctcaccgccgggaggaatccgagtctggattatggattcaagggcgttgaaatcgccatggcttcatactgttccgagcttcaattcttggctaatcccgtcaccaatcacgtccagagcgccgagcagcacaaccaagatgttaactccctgggtttgatctctgcaagaaagacagctgaagctgttgatgtgttgaaactcatgtcctccacttatctagtggcgctctgccaggccattgatctgaggcacctggaggagaacttgaggaacgcagtgaagaacacagttagccaggtggccaagaggactctcacaatgggcgtcaatggagaactccatccatcaagattctgcgagaaggacttgctcagagtggtggaccgtgaatacgttttcgcctacgccgatgatccctgcagcgcaaactacccattgatgcagaagctcaggcaagtcctggtagatcacgccttgcagaacggcgaacacgagaagaatgtgagcacatcaatcttccaaaagattgcagctttcgaagatgaactcaaggcactcctgcccaaagaagtggagggagcaagatcagcccttgagaatggaaatcctgccattcccaacagaattaccgagtgcaggtcttatcctctgtacaagtttatccgggaagaactcggaacggagatactcaccggagagaaggtccagtcgccgggagaagtgtgtgataaggtgttcacagcggtgtgcgatggagggatcattgatccattgttggagtgcctcaagagctggaatggtgctcctcttcctatctgttaattatgcatgttttccaattggttttcaatttttattttttatttttgggtgttgggagctatcctccaacatgtgctctatgtggttaaaagtaaaatcatattgtaatgtttgggggatggttctctataactatgtttgtaactttgtatgttcactggtaaagataaatgacaagtgattgtttaccacttt

SEQ ID NO: 5424 - DNA, 2555 bp, Catharanthus roseus
aaattcaagagttcctctgatctgttatccattttttgttttccagattcaattagcattttccacttgtacaatttctcaattcttcgtcaattgcatttatttgcgatccaaatttcttctacctaatttaattcgcctggatgaagaatatgggaagtactgagaacggtcacattaataacggtgaagtattggatttttgcttgaaagatccgttgaattggggaatggcagccgattcgttgaaaggaagccatttagatgaagttaaacggatggtggcggagtttaggaagccagtggtgaaactcggcggcgaaaccttaactatatcacaggttgctgctatcgccgctagagattataatgctgttaaggttgagctttcggaggatgctagggctggtgttaaagccagcagcgattgggtgatggagagcatgaataaaggaactgatagttacggcgtcaccaccggttttggtgccacttctcatcggaggactaaacaaggcggtgctcttcagaaggagcttattaggtttctgaatgctggaatctttgggaatggaacagaatcttcccacacactgccacactcagcaacaagggctgcaatgctcgtgagaatcaacaccctgcttcaaggttactccgggatcagatttgagatcctagaagccattaccaaattcctaaaccacaacatcactccttgtttgcctcttcgtggtacgatcactgcctccggtgatcttgtgcccttatcctacattgccggattacttacaggcaggcctaattccaaggctgttggacctaatggagaaattgtaaaccctgaagaagcattcaagatggctggagtaaacgatggcttcttcgagctgcagcctaaagaaggacttgctcttgttaatggcacagctgttggttctggcatggcctctatggtccttttcgaagctaatattcttgcagtgctatctgaggtgctttctgcaatttttgctgaagtgatgaatggcaagccggagttcactgaccatttgacgcataagttgaagcatcacccgggacaaattgaagctgcagcaattatggaacacattctggatggaagcggttatgttaaagcagctcataagttacatgaaatggaccctttacagaaaccaaaacaagatcgctatgctcttagaacatcccctcaatggcttggtccacaaattgaagtcattcgttcagccacaaaaatgattgagagggaaatcaattcagtgaatgataaccccttgattgatgtctcaagaaacaaggccttgcatggtggcaacttccagggcaccccaattggagtatccatggacaatgctcgcttggcaatcgcgtccattgggaaactgatgtttgctcaaatatcagagcttgtcaatgatttctacaacaatggcttgccatccaatctatccggaggaagaaacccaagcttggtctacggttttaagggagctgaaattgcaatggcttcatactgttcagaactccagtatttagccaatccggtcaccaatcacgtgcagagtgctgagcaacacaaccaagatgtcaactccttaggtttgatctcttcaagaaagacagccgaagctgttgaaatcttgaagcttatgtccagcacatacctggtggcgctctgccaagcaatagatttgaggcatttggaggagaacttgaaaaatgcagtgaaaaacacagttagccaagttgcaaagagaactctaaccgttggtgtcaatggagaacttcatccatcaagattttgcgagaaggatttgattagagtggtagaccgcgaatatgttttcgcctatgtggatgatccttgcagtggtacctatccattgatggaaaagctaagacaagttattgttgatcatgcattgcaaaatggcgaaagtgagaagaatgtgaatacatccatcttccaaaagattgcagcatttgaagatgaactcaaaactgtcttaccaaaggaagtagaaagtgcaagaacagctctggagaatggaaacccggcaatccctaaccggatcaaggaatgcagatcatatccgttgtataagtttgtgagagaagatgtgggagccgaattcctcacaggagagaaagttagatcaccaggagaagagtttgacaaggtgtttacagcaatgtgcaatgagaagattatagatccactcttggaatgcctcaaggaatggaatggtgctcctcttcctatttgttagttctttttgtttgattcttcctataaaaaaaattgttttgtcaaaggtttgtttgcctcctaaattcttccaaagaaatctgttattgtttggaaatctcaagaatgtatgtatatctatctatctattgtaatgcttaaccttctctaaatattaagtaaatttgagatcttatcgctttttgaaatttgataccaaaatgtatgtgcgaaacaacccaataattattgataagttagtattgagttatgttcgttgcca

SEQ ID NO: 5425 - DNA, 2165 bp, Ricinus communis
tatccgggtctttctttaaaatggcagcaatggcagaaaatggcagcaaaaatgattctttggagagcttttgcaacatggggcgagacccactgagttggggattggctgcagaatcaatgaaaggcagtcatttagatgaagtaaagaagatggttgctgaatataggaaaccttttgttaagcttggtggtgaaaccttgacagtagctcaagttgctgctattgctagccatgattgtggtgttaaagtcgagctttctgagtctgctagagctggtgttaaggctagtagtgactgggttatggatagcatgaataaaggtactgatagctatggtgtcactactggttttggagctacttctcatagaagaactaagcaaggtggtgctttacagaaagaactcataagattcttgaatgctgggatttttggcaatggaacagaatcatgccacacattacctcattctgccacaagagcagcaatgctagttaggatcaacactctcctacaagggtattctggcattagatttgaaatcttggaagcaattaccaagcttcttaaccacaacattactccatgtttgccactccgcggcacaatcactgcttcaggggatttagtcccattgtcttacattgctggattgctcacaggcaggcctaattccaaagctattggccctaatggtgaatccatggatgcccttgaagcttttcgccttgccggtattgaatcaggattctttgagttgcagcctaaagaaggccttgctttggttaatggtactgcagtcggttctggtttggcttctatggttctttttgaggcaaacattcttgctgtcttatcagaaattctatctgcaatttttgctgaagtcatgaatggcaagcctgaatttaccgatcacttgacacataagctgaagcatcatccaggccaaattgaagctgcagctataatggagcacattttagatggcagctcttatgttaaagctgctaagaaattgcatgagatggatccattacagaaaccaaagcaagatagatatgctttaagaacttcaccacaatggttaggccctcagatcgaagttattcggttctcgacgaaatcaatcgaaagagagattaattcagtgaatgataaccctttgatcgatgtttcgaggaacaaagccttgcatggtggaaatttccaggggacaccaatcggtgtctcaatggacaatgcacgtttggctattgcatcgattgggaagctgatgtttgctcaatttagtgagcttgttaatgatttctacaacaatggattgccatcaaacttgactgctggtaggaatccaagtcttgattatggcttcaagggagctgaaatagcaatggcttcttactgttctgagctccaatatcttgcaaatccagtcactagccacgtgcaaagcgcggagcagcacaatcaagatgtgaactcgttggggttaatctcttcaagaaagacagcagaagctgttgatatcttgaagctcatgtctacaacttacttggtagcactttgccaagccattgatctgaggcatctggaggaaaacttgcggcaagctgttaaaaacactgtaagccaagtagccaagagagttctaactacaggtgctaatggagaacttcacccttcaagattctgtgagaaagatttgctcaaagtggtcgatcgcgagtatgtctttgcctatgctgatgatccttgtagtgctacttatccattgatgcaaaaactaaggcaaattctcgtcgagcatgccttggcaaacggcgaaaatgagaagaatgctggtacctcagtcttccaaaagatcagtgctttcgaggaagaactcaagacccttttgcctaaagaagttgagagtgtaagaattgcatatgagagtggaaatccagcaactgctaacaggatcaaggaatgcaggtcttatccactttacaagtttgtgagggaggaattgggtactggattgctcactggagacaaagttatgtcacctggagaggagtttgacaaggtttttactgcaatgtgccagggaaagatcattgatccaatgatggattgtctcaaggaatggaatggtgcccctcttccaatttgctaa

SEQ ID NO: 5426 - DNA, 2145 bp, Ricinus communis
atggcagcaatggcagaaaatggcagcaaaaatgattctttggagagcttttgcaacatggggcgagacccactgagttggggattggctgcagaatcaatgaaaggcagtcatttagatgaagtaaagaagatggttgctgaatataggaaaccttttgttaagcttggtggtgaaaccttgacagtagctcaagttgctgctattgctagccatgattgtggtgttaaagtcgagctttctgagtctgctagagctggtgttaaggctagtagtgactgggttatggatagcatgaataaaggtactgatagctatggtgtcactactggttttggagctacttctcatagaagaactaagcaaggtggtgctttacagaaagaactcataagattcttgaatgctgggatttttggcaatggaacagaatcatgccacacattacctcattctgccacaagagcagcaatgctagttaggatcaacactctcctacaagggtattctggcattagatttgaaatcttggaagcaattaccaagcttcttaaccacaacattactccatgtttgccactccgcggcacaatcactgcttcaggggatttagtcccattgtcttacattgctggattgctcacaggcaggcctaattccaaagctattggccctaatggtgaatccatggatgcccttgaagcttttcgccttgccggtattgaatcaggattctttgagttgcagcctaaagaaggccttgctttggttaatggtactgcagtcggttctggtttggcttctatggttctttttgaggcaaacattcttgctgtcttatcagaaattctatctgcaatttttgctgaagtcatgaatggcaagcctgaatttaccgatcacttgacacataagctgaagcatcatccaggccaaattgaagctgcagctataatggagcacattttagatggcagctcttatgttaaagctgctaagaaattgcatgagatggatccattacagaaaccaaagcaagatagatatgctttaagaacttcaccacaatggttaggccctcagatcgaagttattcggttctcgacgaaatcaatcgaaagagagattaattcagtgaatgataaccctttgatcgatgtttcgaggaacaaagccttgcatggtggaaatttccaggggacaccaatcggtgtctcaatggacaatgcacgtttggctattgcatcgattgggaagctgatgtttgctcaatttagtgagcttgttaatgatttctacaacaatggattgccatcaaacttgactgctggtaggaatccaagtcttgattatggcttcaagggagctgaaatagcaatggcttcttactgttctgagctccaatatcttgcaaatccagtcactagccacgtgcaaagcgcggagcagcacaatcaagatgtgaactcgttggggttaatctcttcaagaaagacagcagaagctgttgatatcttgaagctcatgtctacaacttacttggtagcactttgccaagccattgatctgaggcatctggaggaaaacttgcggcaagctgttaaaaacactgtaagccaagtagccaagagagttctaactacaggtgctaatggagaacttcacccttcaagattctgtgagaaagatttgctcaaagtggtcgatcgcgagtatgtctttgcctatgctgatgatccttgtagtgctacttatccattgatgcaaaaactaaggcaaattctcgtcgagcatgccttggcaaacggcgaaaatgagaagaatgctggtacctcagtcttccaaaagatcagtgctttcgaggaagaactcaagacccttttgcctaaagaagttgagagtgtaagaattgcatatgagagtggaaatccagcaactgctaacaggatcaaggaatgcaggtcttatccactttacaagtttgtgagggaggaattgggtactggattgctcactggagacaaagttatgtcacctggagaggagtttgacaaggtttttactgcaatgtgccagggaaagatcattgatccaatgatggattgtctcaaggaatggaatggtgcccctcttccaatttgctaa

SEQ ID NO: 5427 - DNA, 2475 bp, Helianthus annuus
gggacatctcaccttcattacacacacatagagtgtgagtctagtgtgtgaagataagattgttcttctacttctagctttcttattattccttttgtaatcctttttatcgtttgaataataaacacaatggagaacggtacacatgttaacggatccgctaacgggttttgcatcaaggacccgttgaattggggcgttgcggccgaagcgttgacgggtagtcatctggatgaggtgaagaagatggtgggtgagtttaggaagcctgtggtgaagttgggtggcgagactttgactgtgtctcaagtggctgggatcgcggctgctggtgatggtaacatggtgaaggtggagctatccgaggcggctcgggccggggttaaggcgagtagtgattgggtgatggagagtatgaacaaagggactgatagttatggtgtcactactggatttggtgccacttctcataggaggactaagaatggtggtgctctacaaaaggagctcattagattcctgaacgccggaatattcggcaacggcacagaatctagccacacactaccacattccgccacaagagccgccatgttggtcagaatcaacaccctcctccagggatattccggcataagattcgaaatcttggaagccatcactaaattcctcaacaacaacatcaccccatgtttacccctccggggcacgatcaccgcctccggtgacctcgtcccgttgtcctacatcgcgggtctcctcaccggccgacccaactcaaaggcagttggcccggccggtgaagttctcaatgcggaatccgccttcgcccaagctggcgtagaaggcggattcttcgagttacagcccaaagaagggctcgcgcttgttaatggtaccgcggtggggtccgggatggcgtccatggtgttgtttgaagccaatgtacttgcattgttgtcggaagtgttgtccgcgattttcgcggaagttatgcaagggaagcccgagtttacggaccacttgacccacaaacttaagcaccacccgggccaaatagaggcggcagccatcatggagtacattttggatggaagtgactatgttaaagccgcgcaaaaggtccatgagatggacccgttacaaaaaccaaaacaagaccgttacgcgctccgcacgtcccctcaatggcttggaccacaaatcgaagtcattcggtccgccacaaaaatgattgaacgggagatcaactccgttaacgacaacccgctaatcgacgtgtcgagaaacaaagcgttacacggtggcaactttcaaggaaccccaattggtgtgtcaatggacaacacacgtttggctattgcggctattggaaaactcatgttcgcgcaattttccgagcttgtgaatgatttttataacaatgggttgccttcgaatttgtcgggtgggcgtaacccaagtttggattacgggtttaaaggtggggagatcgcgatggcttcttactgttcggagcttcagtttctagcaaatccggttacaaaccatgttcaaagcgcggagcaacataaccaagatgttaactctctagggttgatttccgcaaggaaaaccgcggaagcggttgatattttaaagctcatgtcatcgacttacttagtcgcgttatgccaatcgattgacttgaggcatttggaagagaacatgaagtcaaccgtgaagaacaccgtgagccaagtagcgaaaaaggtcctaaccatgggcgtaaacggcgagctccacccatcaagattttgtgaaaaggacttgcttcgtgtggttgaccgcgagtacgttttcgcctacgctgacgacccttgcctcgccacctacccattgatgcaaaagcttcgacaagtcctcgttgaccacgcgctaaacaatggggaaaccgagaagaacgccaacacctcaatcttccaaaagattgctactttcgaagacgagttgaaggccattttgcctaaggaagttgagagtgttagagttgcattcgaaaatggtacaatgtcgattcccaacaggatcaaggcttgtcgatcatacccgttgtatcggtttgtgagggaggagcttggtggcgcgtacttgaccggcgagaaggtgacttcgccgggcgaggagttcgacaaggtgttcacggccatgtcaaagggactaattatcgatccattgttggagtgtgttgaagggtggaatggtgcaccacttcctatttgttaggtgtgaattgtgttgtaagttgtttaatttgtattttctaatatatttttgtttgttttatttatttgtgttcaaatgttgtatccctcttgttaatgtagacaataactcaagttgttatgtgcccgagagtatgtggttgtaaatcatatatgttaaacatgtttctgtctcgttggtctcattaggtattcatgtattttttttcta

SEQ ID NO: 5428 - DNA, 2335 bp, Unknown
  Sequence found in Organisms: Ipomoea nil, Ipomoea batatas
acgcagtgaaggtgcaagaataatggccaaccaaaatggcttctgtatcaagaagcagcaggttgatcctttgaactgggagatggctgccgagtcattgagggggagccacttggatgaagtgaaacgcatggtggccgagtttaggaagccggcggtgaagctcggcggagagacgctcacggtggctcaagtggcacgtatcgcctcccgtgacaatgccgtcgcggtggagctctccgaggaggcccgggccggcgttaaggccagcagtgattgggtgatggatagcatgaacaaagggactgatagctacggcgtcaccaccggcttcggtgccacctctcaccgtagaaccaaacaaggtggcgctcttcagaaggagctcattaggtttttgaatgctggaatattcggcaatgcaacagaatcgtgtcacactcttccccattcagcaacaagagctgccatgcttgtgagaatcaacactcttcttcaaggatactctggcattagatttgaaatcttggaagcaatcactaaattgctgaaccacaacattaccccctgcctgcccctccgtggcaccatcaccgcctccggtgaccttgtcccgttatcctacattgctggcttgatcaccggccgccctaactccaaggccgtcggacccaacggggagaccctcaacgcagaggaagctctgcggttaagccggagtggacggaggatttttcgagttgcaagcccaaggaagggcttgccctcgttaatggcaccgccgttggttctaggcatggcctctatggttcttttcgaggctaatgttcttgcagttctgtctgaggttttatccgctatttttgctgaagtcatgaatgggaaaccagaatttaccgaccatttgacgcataagttgaagcatcaccccggccagattgaagctgctgctattatggaacatattttggacggcagctcttacgtgaaggcggctcagaagttgcacgaaatggatcctctgcagaaacccaaacaggatcgctatgctctccgcacttcgccccaatggctcggccctcagattgaagtcattcgtgctgcaaccaaaatgattgagagggagatcaactctgtcaacgacaaccctctcattgatgttgccagaagcaaggccttgcacggtggcaacttccagggtacaccaattggtgtgtctatggacaactcaagattagcccttgcatctatcggcaagttgttgtttgcccaattctctgagcttgtcaatgactattacaacaatgggttgccttctaatctcacagcagggaggaatccaagcttggattatggtttcaagggcgctgaaattgccatggcttcttactgctccgagctgcaatttttggctaatccggttactaaccatgtccagagtgctgagcagcacaaccaggatgttaactccttgggtttgatctcagctaggaagactgctgaagctgtggacgtgttgaaactcatgtcatccacatatctcgttgcgctttgccaagctattgacttgaggttcttggaggagaacttgaggaatgctgtgaagaatgcagttacacaggtagctaagaggactctcactgtgggtgctaatggagaacttcatcccgcaaggttttgcgagaaagacttgctccgagtggtggaccgcgaatatgtcttcgcatatgcggatgatccctgcagtgctaactacccgctgatgcagaaactccgccaagcccttgttgatcacgccttgcagaatggggagaatgagaagaacaccggcacttcaattttcctaaaggttgcagcttttgaagatgaattgaaagctgttctgccaaaagaagttgaggctgcaaggatcgctgtagagagtgggaacccggctattccaaacaggattaaggagtgcaggtcttacccattgtacaagtttgttcgtgaaggcctgggcactgagttgctgaccggagagaaggtccggtcaccgggcgaagagtgtgacaaggtgttcacagctatgtgtgagggaagtatcattgatcctttgttggaatgccttaagagctgggatggggctcctcttcctatctgttaatttatttcaattcattgcttattttcaatgtaatatatacatttttttcctcggttatgctacttgaacattgttttggcttttggtaaaatccagttgtaatcttttctggaatgcttctctctgtagggatgtagctacatgtgcttttctgttcagtaaaagatgaatgagtaggcactgttgtgg

SEQ ID NO: 5429 - DNA, 2396 bp, Ipomoea batatas
ggtcaacaaccatctcacaatcaaccttttctctcccccctgttcttcggatcacctcaatttcactcctctctctcaactcaacaatggagggcgcaattgcaaacggccacaccaatgatttctgcattaaggttgatccgctgaactgggaaatggcggctgactcattgaagggcagccacttggatgaagtgaagcgcatggtggcggagttcaggaaccccgccgtgaagatcggaggtcagaccctcacgtcgctcaggtcgccgcctatcgccgcccgtgataatgcgtcaaagtggagctctccgaggctgcccgcccggcgtgaaagcagcagtgactgggttatgaacagcatgaacaatggcaccgatagctacggtgtcaccactggcttcggcgccacctctcaccggagaaccaagaacggccatgctcttcagcaggagctcatcaggttcttgaatgctggaatttttgggactggaacaggggcaagccacacactacctcactcagctacaagggcagctatgcttgtgaggatcaacactcttcttcaaggatactccgggatcagatttgagatcttggaagccattactaaattgctcaaccataatatcactccgtgtctgcctctccgtggcacaatcaccgcctccggtgaccttgtgcctttatcctacatcgccggattgctcaccggccgccctaattccaaggcggttggacccaacggtgaggccctcaccgcggaggaggcgttcaaactcgccggagtccagggtgggttcttcgagttgcagcctaaggaagggcttgcacttgtgaatggaactgctgtgggttctggcatggcgtctatggttctgtttgaggctaatgttcttgcggtgttgtctgaggttttgtctgcaattttcgctgaggtgatgaatgggaagccggagtttaccgaccatttgactcataagctgaagcatcatcctggtcaaattgaggctgctgctataatggaacatattttggatagaagctattacatgaaggctgcacagaaactgcacgaaatggatccattgcagaaacccaaacaagatcgttatgctctgagaacatctccccagtggctcggccctcagattgaagtgataagacaagcaaccaaaatgattgagagggaaatcaactctgtcaacgacaaccctttgatcgacgtttcaagaaacaaggccttacacggtggcaatttccaaggtacccccattggtgtgtccatggacaattctagattagcccttgcctccatcggaaaactcatcttcgcgcaattctctgagcttgttaacgactattacaacaacggattgccgtccaatctcaccgccgggaggaatccgagtctggattatggattcaagggcgttgaaatcgccatggcttcatactgttccgagcttcaattcttggctaatcccgtcaccaatcacgtccagagcgccgagcagcacaaccaagatgttaactccctgggtttgatctctgcaagaaagacagctgaagctgttgatgtgttgaaactcatgtcctccacttatctagtggcgctctgccaggcaattgatctgaggcacctggaggagaatttgaagaacgcagtgaggaacacggtcaaccaggtggccaagaggactctcacaatgggcgtcaatggagaactccacccatcaagattctgcgaaaaagacttgctcagagtagtggaccgcgaatacgttttcgcctacgccgatgatccctgcagcgcaaactacccattgtttcaaaagctgaggcaagtccttgtagatcacgccctgcagaacggcgagcacgagaagaatgtgagcacatcaatcttccaaaagattgcagctttcgaagacgaactcaaggcagtcctgcccaaagaagtggagggagcaagatcagccattgagaacggaaaccctgccattcccaacagaatcaccgagtgcaggtcttatcctctgtacaagtttgtccgcgaagaactcgggacggagatgctgaccggagagaaggtgaagtcgccgggagaagtgtgtgataaggtgttcacagcggtgtgtgatggagggatcattgatccattgttggagtgcctcaagagctgggatggggctcctcttcctatctgttaagtgtgttttccaattggttttcaatttttattttttatttttgggtgttgggagctatcctccaacatgtgctctctgtgggtaaaagtattgtaatgtttgtgggatggctctctataactatgtttgtatgttcttttcttcactggtaaagataaatgacaagtgattgtttaccacttt

SEQ ID NO: 5430 - DNA, 2535 bp, Gossypium hirsutum
caactaccttgagctattattattcctcatttcctctcctaagtttcgactcaaaacattcacaaacaaagaactttaaatacttgtctagctcattctctcttttccatcatttcttttaacatggagacgatcactcaaaatggtcaccacaaggggtctttggagagcttttgcactgcttcaaagggtgccggtggagccgttgatcctttgaattggggtgttgcagctgagtcactcaaggggagtcatttggatgaagtgaaacgcatggtggctgaatacaggaacccattggtgaagcttggtggggagaccttgacaatttctcaagttgcagccattgctacacgtgacttgggtgtcaaggttgagctttccgaggatgctagggctggcgtcaaggccagtgctgattgggtccttgatggcatgaacaaaggcactgacagctatggtgttaccactggttttggtgctacttctcatcgaagaaccaagcaaggagcagcccttcaaaaagagctcattaggttcttgaatgctggggtctttggccatggaactgagtcatgccacacacttcctcactcggcaaccagagcagctatgcttgttaggatcaacacccttctccagggttactctggcattagatttgagattttggaggcaattacaaagcttatcaacaacaacataactccatgtttgccacttcgtggaacaattactgcctctggggatcttgttcctctttcctacatagctggattgctcacaggcaggccgaattccaaggccgtaggaccgaacggtgaaccccttgatgcagaggaagcattccgtgtagctggtatcgattccgggttctttgtgttgcaacctaaagaaggccttgctttagtcaatggcactgcggttggttcaggcatggcttccatggttctttttgaagctaatattctggctgttctgtcagaagttttatcagcaattttcgctgaagtcatgaatggtaaacctgagttcactgaccatttgacgcataaattgaagcaccatccaggacaaattgaggcagcggctataatggaacacatacttgaggggagttcttatgttaaagcagcaaagaagttgcatgaaatggatcccctgcagaaaccgaaacaagatcggtatgctctgaggacttctccacagtggcttggtccacagattgaagtgattagattcgcaactaaatcaattgaaagagagatcaactctgtgaatgataaccctttgatcgatgtttcaaggaacaaggcgctacatggtggcaacttccagggtaccccgattggagtgtcaatggacaatgctcgtttggctattgcagctattgggaaactaatgtttgcccaattctctgaacttgttaatgatttctacaacaatggtctcccatcaaacctctctggtggtaggaacccaagtctggattatggtttcaaaggtgctgaaatagcaatggcttcctattgttctgagctccaataccttgctaatccggtcactagccacgttcaaagtgctgagcagcacaaccaagatgttaactccttgggactaatctcttcaaggaaaactgctgaggctgttgatattttaaagcttatgttctctacatacttggcggcactttgtcaagctattgatttgaggcatttggaagagaatttgaggagcacagtgaagaacaccgtgagccagatagctaagaaagtcctcactactggtgccaatggtgagcttcacccttcaagattctgtgagaaggatctactaaaagctgtggacagggaatatgttttcgcttacatcgacgatccctgcagtgctacctacccgttgatgcaaaagctgaggcaagtacttgttgagcacgcattgacaaatggtgaaaatgagaagaatgcaagcacttcaatcttccaaaagattgcagcttttgaagaagaattaaaggctgttttgccaaaggaggtggagagtgcaagggcatcagttgagaatggaaatgctgcaatccctaacaagatcaaggaatgtagatccttcccgctgtacaaatttgtgagggaagagcttggaactgggctgctaactggagaaaacgttatgtcacctggtgaggagtttgacaaggttttcacagctatgtgccaagggaagatcattgatccaatgctggaatgtctcgaggaatggaatggtgcccctcttccaatctgctagtttgctttattttttatagttgagatgtgtaatccaaatcttttgcatttgttgttggaatttccttgtaaaacaagttacttaactaaatgaatccattttcacaactcaaacctctctaattgtaatattgcgaatgctcaatcactaaccatctctttaactttatccacctttcccaaataaacatataaaaaaaaccctcggcccgtaacctcctaaggcacgatttcctcgccccttatttct

SEQ ID NO: 5431 - DNA, 2253 bp, Cynara scolymus
  misc_feature (2159)..(2159): n is a, c, g, or t
  misc_feature (2187)..(2187): n is a, c, g, or t
  misc_feature (2199)..(2199): n is a, c, g, or t
atggagaacaacaacgggcacgtaaatggagtggccaccgatttctgcattaataaagacccattgaactggggtgtggcagcagaggcgatgacggggagccatcttgatgaggtgaagagaatggttgcggagttcaggaagccggtggtgaagctgggaggagagactctgacggtgtctcaggtggctggaatcgcggctgccggtgacagttcggtggtgaaagtggagctgtcggaggcggcgagggctggggtgaaggccagtagtgactgggtgatggagagcatgagcaaaggaactgatagttacggtgttaccaccggcttcggagctacctctcaccggcggacgaagcaaggtggggcacttcagaaggagctcattagatttttgaacgccggaatctttggcaacggctcagaatcatgccacacccttccacattcagcaacaagagcagccatgctagtaagaatcaacaccctcctccagggttactccggcatccgttttgagatcttggaggccatcaccaagttcctcaacaccaacgtcaccccttgtttacctctccgtggcaccatcaccgcctccggcgaccttgttcccttgtcctacattgccggacttctcaccggtcgtcccaactccaaagctgttggtcccaacggggaaatcctcaatgccgaaaaggccttcagcctcgccggtgtctctggtggcttcttcgagctacagcctaaagaaggtctagcacttgtgaatggtaccgccgtcggatctgggatggcctccatggtcctttttgaggccaatgtgcttgcactgttatcggaagtcttgtccgccatttttgccgaggttatgcaagggaagccggagtttacagaccacttaacacacaaattgaagcatcacccaggccagatcgaggctgctgcgataatggaatacattttagacggaagtgactatgttaaggcagctcagaagctccatgaaatggatcctttgcagaaacctaagcaagaccgatatgctctaaggacctcaccccaatggcttgggccacatattgaggttatccgatcgtcaacgaaaatgatcgaaagagagatcaactccgtcaacgataaccctttgatcgacgttgccaggaacaaggccttacacggaggaaacttccaaggaactcccatcggagtttccatggacaacacacgtttagcaattgcctccatcggaaaactcatgtttgctcaattttcagagctcgtaaacgacttctacaacaatgggttaccttcaaatctttccggcggacggaaccccagcttggattacgggttcaaaggagcagaaatcgccatggcttcttactgttccgaactccagtttcttgccaatccggtgactaaccatgttcaaagtgccgaacaacacaaccaagatgtgaactctttgggattgatttcagcaagaaaaacatccgaagccgttgaaatcttgaagctcatgtcaacttcatacttggtggctctatgccaatccatcgacttgagacatttggaagaaaacatgagatccacagtaaagaacaccgtgagccaagtagccaaaaaggtcctaaccatgggagtgaacggcgagctccacccctctaggttctgcgaaaaggacttacttcgagtagtcgatagagagtacgtctttgcatacatcgacgacccttgcagcgccacttatcctttgatgcagaagctccgacaagttctggtcgatcacgccttaaacaacggcgaaaccgagaagaataccagcacctcaatcttccaaaagatcggtgcttttgaagacgaactgaaagccatcttgcccaaagaagtcgaaggtgttagaacttcttacgaagatggtacattggcaatcccaaacaggatcaaagcttgcagatcatacccattatacaggtttgttagggaagagcttggaactggattcttgacaggtgagaaggtgacttcaccaggggaggagtttgataaggtgtttacagcaatgtgcaaaggccaaatcatcgatccattgctggaatgtgttgagggctggaatggtgttcctcttccaatctcttagaatctgcaatcctgcantttcaaccttcttttttctatttttggntaaatttagggntcaaacttgtactttttctgttattaatgagtcatcaaagacttttgttgtgtt

SEQ ID NO: 5432 - DNA, 2338 bp, Artemisia annua
aaaaaaaacattgataaccagctgactgtctttttgtgtgtgatctaagcaagattatcaaatacttactaaaaatggaaaatggtcatgcaaatggggtggcaaaggagttgtgcattaaggatccattaaactggggtgtagcagctgaggctttgacagggagtcatttagatgaggttaagaagatggttgctgagtttaggaaacctgttgtgaaactaggtggtgaaacactgacagtgtcccaggttgctgggattgcggctagtgaaaacgctggtgttaaggttgagttgtctgaaagtgctagagctggagttaaagctagtagtgattgggttatggagagtatgggtaaagggactgatagttatggtgttactactggttttggcgctacttctcacaggagaaccaagaatggtggtgctcttcagaaggaactcattagatttttgaacgccgggatctttggcaatggcactgaatcgaaccacacccttccacattcagccacaagagccgcaatgctcgtaagaatcaacacgttgctccagggctactctggcattcgtttcgagatcttggaagcaatcaccaagtttcttaacactaatgtcaccccttgtttgcctcttcgtggtaccatcaccgcatctggtgatcttgtcccattgtcctacattgctggacttctcactggtcgacccaactccaaagctgtcggtcccgatggacaaatccttaatgccgaaaaggctttcagcctagctggtgttgatggagggttctttgagctacagcctaaagaaggtcttgcacttgtgaatggtaccgctgttggatcaggaatggcctcaatggttctttttgaggctaatgtacttgcattgctatccgaagtcttgtctgctatttttgctgaggtcatgcaaggaaagcccgagtttactgaccacttgacacacaaattgaagcatcacccgggccagatcgaggctgcagccattatggaatacatattagatggaagtgattatgtcaaggccgcggcaaaggtccatgaaatggacccattgcaaaaacccaagcaagaccgttatgctttaaggacctcgcctcaatggctggggccacacattgaagtcatccgatcatctactaaaatgatagaaagagagatcaactcagtgaatgacaacccattgatcgatgtctcaagaaacaaggccttgcacggtggaaacttccaaggaactcccattggtgtttccatggataacactcgtttagctattgcctcaattggaaagcttatgtttgctcaattctctgagcttgtaaatgacttctacaacaacgggttaccttcaaatctttctggtggacgcaatcctagcttggattatggattcaaaggaggtgaaattgcaatggcttcatactgttctgaacttcaattccttgcaaacccggtgacaaaccatgtccaaagtgcggaacaacacaaccaagatgttaactcattggggctaatttcagcacgaaagacagctgaagcagtagatatcttgaagctcatgtcatctacatacttggtagctttatgtcaatccattgacttaaggcacttggaagaaaacatgaaatccactatcaagaacaccgtcagccaagtagccaaaaaggtcctaaccacaggcgtgaacggtgagcttcacccttcaagattctgtgaaaaggacttactccgtgttgttgatcgtgaatatgtctttgcatacgttgatgatgtgtgtcttgccacatacccattaatgcaaaagcttcgacaagtccttgttgatcatgctttaaacaatggtgaaagcgagaaaaacacaaacacttcaatcttccaaaagattgcagctttcgaagacgaattgaaagccattttgcctaaagaagtcgaggccgttagagttgcatttgaagatggtacattggcaattcctaacaggatcaaggcttgtagatcatatccattataccgatttgtaagggaagagctcggaggcgtttacttgaccggtgagaatgtgacttcacccggtgaagagttcgataaggtgtttaccgcaatgtgcaaaggccaaatcatcgatcctttactcgagtgtgttgagggttggaatggtgttcctcttccgatctcttaatctgaactaggtttaaatttgtttgcaatgtgcttaaaattttctttttttctttttcaaattcattatatgtatctgttggatttttgaggtaaaaattttaccccacttataaaacaagtcatcagactctt

SEQ ID NO: 5433 - DNA, 2431 bp, Manihot esculenta
aggaaatccatttcctaccaaagatttcctctctcagatcctttgtttctccttcaacttcaagttcttcacttccttgagttgtttgtgctgtctgggtatttcttaaaaatggcaacaatctctcagaatggtcaccagaatggttctttagactctttgtgtacagctcgtgacccactgaattggggtctggctgctgagtctatgagtggcagccatttagacgaagtgaaaaagatggtggctgagtttaggaagcctttggtcaagttaggcggcgagaccttgactgtagctcaggtggcagctattgctcgtgaatctggtgtccaagtggagcttgctgaatctgctagagctggtgttaaggcgagtagtgactgggtcatggatagtatgagcaagggaactgatagctatggtgtcactactggatttggagccacttcacatagaagaaccaagcaaggtggtgctttacagagggagctcattagattcctgaatgctgggatttttggcaataagacagaatcatgtcacactttgtcacactctgcaacaagagcagcaatgctagtgaggatcaacactcttctccaaggttactcaggcattagatttgaaatcttggatgctatcaccaagctcctcaaccacaacattactccttgcttgccgctgagaggcacaatcactgcttctggggatttagttccattgtcctacattgctggattgctcaccggccggcctaattccaaggctgttggccctaatggagaacccctagatgcccagcaagcctttcactctgctggtattgattctggcttctttgagttgcagcctaaagaaggccttgctctggttaatggcactgctgttggttctggcttggcttccatggttctctttgaggcaaatgttcttgctgttttatcagaagtcttatcagctattttcgccgaagttatgaatggaaaacctgagtttactgatcacttgactcataagttgaagcaccatccaggccaaatagaggctgcagctataatggagcatattttagatggtagctcttatattaaagcagctaagaagttgcatgaaattgatccattgcagaaaccaaagcaagatcgatatgctctcagaacttccccacaatggctaggtcctcagattgaagttatcagattctcaacaaaatctatcgaaagagagattaattcagtcaatgacaaccctttgattgatgtttctaggaacaaggctttgcatggtggaaatttccaggggaccccaattggagtctcaatggataatgcacgtttggccattgcatcaataggaaagctcatgtttgctcagttcagtgagcttgtaaatgatttttacaacaatgggttgccatcaaatctcacagccagcaggaatccaagcttggattacggcttcaagggagctgaaattgcaatggcttcttactgttctgagctccaataccttgcaaatccagtcaccagccatgtacaaagtgcagagcagcacaatcaagatgtaaactccttggggctaatttcttcaagaaagacagaagaagctgtagacatcttgaagctcatgtccacaactttcttagtagcactttgccaagctattgacttgaggcatttggaggagaacttgaagcacgcagtcaaaaacacagtaagccaagtagctaagaggattctaactacaggagctagtggagaacttcacccatcaagattctgcgagaaggacttgctcaaagtggtggatcgcgagcaagttttctcttatgtcgatgacgcctgcagtgctacctatccattgatgcaaaaactaaggcaagttctcgtggaccatgccttggcaaatggcgagagtgagaagaatgccagcacttcaatcttccaaaagatcagagctttcgaggaagaattgaaagcccttttgcctaaagaagttgagagtgcaagagaggcatacgagaatgggaatccagcaattgccaacaagatcaaggaatgcagatcttacccattgtataagtttgtgagagaggaaataggaactgggttgctgaccggcgaaaaggtccggtcaccgggagaggaatttgataaggttttcactgccatgtgccaaggaaagatcattgatccaatgctggattgtctcaaagagtggaatggtgcccctcttccaatatgttaaactgtaactttcttgttttgtttacacttaaagatttgttttccaattgctttttatgtacttatagtttgtgatgtaaaaaatctgtaatgcatttcttttaaatgttcaattgttctcttctcacttttgtgctggaattgaaggcagaatagcaatggtaattacttaaagattactg

SEQ ID NO: 5434 - DNA, 2432 bp, Manihot esculenta
  misc_feature (1459)..(1459): n is a, c, g, or t
  misc_feature (1573)..(1573): n is a, c, g, or t
  misc_feature (1576)..(1576): n is a, c, g, or t
gaggaaatccatttcctaccaaagatttcctctctcagatcctttgtttctccttcaacttcaagttcttcacttccttgagttgtttgtgctgtctgggtatttcttaaaaatggcaacaatctctcagaatggtcaccagaatggttctttagactctttgtgtacagctcgtgacccactgaattggggtctggctgctgagtctatgagtggcagccatttagacgaagtgaaaaagatggtggctgagtttaggaagcctttggtcaagttaggcggcgagaccttgactgtagctcaggtggcagctattgctcgtgaatcttgtgtccaagtggagcttgctgaatctgctagagctggtgttaaggcgagtagtgactgggtcatggatagtatgagcaagggaactgatagctatggtgtcactactggatttggagccacttcacatagaagaaccaagcaaggtggtgctttacagagggagctcattagattcctgaatgctgggatttttggcaataaggcagaatcatgtcacactttgtcacactctgcaacaagagcagcaatgctagtgaggatcaacactcttctccaaggttactcaggcattagatttgaaatcttggaagctatcaccaagctcctcaaccacaatattactccttgcttgccgctgagaggcacaatcactgcttcaggggatttagttccattgtcctacattgctggattgctcaccggccggcctaattccaaggctgttggccctaatggagaatccctagatgcccagcaagcctttcactctgctggtattgattctggcttctttgagttgcagcctaaagaaggccttgctctggttaatggcactgctgttggttctggcttggcttccatggttctctttgaggcaaatgttcttgctgttttatcagaagtcttatcagctattttcgccgaagttatgaatggaaaacctgagtttactgatcacttgactcataagttgaagcaccatccaggccaaatagaggctgcagctataatggagcatattttagatggtagctcttatattaaagcagctaagaagttgcatgaaattgatccattgcagaaaccaaagcaagatcgatatgctctcagaacttccccacaatggctaggtcctcagattgaagttatcagattctccacaaaatcgatcgaaagagagattaattcagtcaatgacaaccctttgattgatgtttctaggaacaaggccttgcatggtggaaatttccaggggaccccaattggagtctcaatggataatgcacgtttggccattgcatcaataggaaagctcatgtttgctcagttcagtgagcttgtaaatgatttttacaacaatgggttgccatcaaatctcacagccagcaggaatccaagcttggattanggcttcaagggagctgaaattgcaatggcttcttactgttctgagctccaataccttgcaaatccagtcaccagccatgtacaaagtgcagagcagcacaatcaagatgtaaantcnttggggctaatttcttcaagaaagacagaagaagctgtagacatcttgaagctcatgtccacaactttcttagtagcactttgccaagctattgacttgaggcatttggaggagaacttgaagcacgcagtcaaaaacacagtaagccaagtagctaagaggattctaactacaggagctagtggagaacttcacccatcaagattctgcgagaaggacttgctcaaagtggtggatcgcgagcaagttttctcttatgtcgatgacgcctgcagtgctacctatccattgatgcaaaaactaaggcaagttctcgtggaccatgccttggcaaatggcgagagtgagaagaatgccagcacttcaatcttccaaaagatcagagctttcgaggaagaattgaaagcccttttgcctaaagaagttgagagtgcaagagaggcatacgagaatgggaatccagcaattgccaacaagatcaaggaatgcagatcttacccattgtataagtttgtgagagaggaaataggaactgggttgctgaccggcgaaaaggtccggtcaccgggagaggaatttgataaggttttcactgccatgtgccaaggaaagatcattgatccaatgctggattgtctcaaagagtggaatggtgcccctcttccaatatgttaaactgtaactttcttgttttgtttacacttaaagatttgttttccaattgctttttatgtacttatagtttgtgatgtaaaaaatctgtaatgcatttcttttaaatgttcaattgttctcttctcacttttgtgcttgaattgaaggcagaatggcaatggtaattatttaaagattactg

SEQ ID NO: 5435 - DNA, 2428 bp, Ocimum basilicum
acaacacgcacacacacaatcatcacaaaccttctccaatcacctctctctacttgttaatttctcgcctccagtatttgtgtttttgtgtgtgtgtgtgtgtgttcaaacaacctgacctgttatttatcgatccattgtgatggcggcggagaatggtcatgttgattccaacggattctgcgtgaagcagagtgatcccttgaattgggttatggcggcggagtcgctcaaggggagccacctcgatgaggtcaagaggatggtggaggagttcaggaagccggtggtgaagctcggcggagaaaccctcactatatcgcaggtggcggcgatcgctgccagggataatgctgtcgccgtggagctggcggaggcggctagagctggcgtcaaggccagcagcgattgggtgatggagagcatgaataagggaactgacagttacggagtcaccaccggtttcggcgccacgtcacaccgccggaccaagcaaggcggcgctcttcagaaggagcttattagattcttgaatgccggaatattcggaaatggaacagaatcaaatcacacattaccccacacagcaaccagagcagcaatgcttgtgaggatcaacaccctccttcaaggctactccggcatcagattcgagatcttggaagccatcaccaaattcctcaaccacaacatcactccctgcttgcctctccgcggcaccatcaccgcctccggcgatctcgtccccttatcctacatcgccggccttctcaccggccgccccaactccaaggccgttggccccaccggagaagccctcaatgccgaggaagccttcaagcttgccggcgtcaacggaggcttctttgagctccagcccaaagaaggcctggcccttgtcaacggcaccgcagttggctctggattggcctccattgctctgtatgaggccaatattcttgctgttttgtccgaagttatgtcggccattttcgcagaagttatgaacggaaagcccgagttcaccgatcacttaacgcataaactgaagcaccatcctggccagatcgaagctgccgctataatggagcacattcttgatgggagcgtttacgttaaagctgctcagaaactgcatgagatggatcctctgcagaagcctaaacaagacagatacgctctccgcacatctcctcaatggctgggcccacaaatagaagtcatccgcaccgccaccaagatgatcgagagggagatcaactctgtcaacgacaaccctttgatcgatgtttctagaaacaaggctctgcacggtggcaacttccaagggacaccaattggagtgtctatggacaatgcaagattagccattgcatcaattgggaagctcttgtttgctcaattctctgagcttgtgaatgacttctacaacaacggcttgccttccaacttatcaggtggccgcaatcctagcttggactatggattcaagggggccgaaatcgccatggcttcctactgctccgagcttcagttcttggctaaccctgttacaaaccacgttcagagcgctgagcagcacaaccaagatgtcaactctctaggattgatctcatctagaaagacggttgaagcattagatattctgaaactcatgtcatccacttacctcattgctctctgccaagccattgatttgaggcatttggaggagaatctgaagcatgctgtgaagaacactgtgagccaagttgctaagagaactctaacaatgggcgccaacggcgagctccacccttccagattctgcgagaaggacttgatccgtgtggtggaccgcgaatatgtctttgcctacatcgatgatccctgcagcgccacctacccactgatgcagaaactgcgacaagtcctcgtcgatcacgctctgaaaaacggagagaatgagaagaatgtaggcacatccatcttccacaagatcgaagctttcgaagaagagctcaaggccctcttgcctaaggaagttgagagtgcaagaatcgccctcgagagcgggaatccagcagttgcaaaccggattgcggaatgccgatcttaccccttgtacaaattcatcagagaggagctcggaaccagcttcttgacgggcgaaaaggtaatttctccgggtgaggagtgcgagagggtgttcacggcgttgagcaaaggcctcgttgttgatccgttgttggaatgcctccaaggatggaatggtgcacctcttcctatttgctaagcttgtttgttgtttgtctgatggaatattttttgaatttgttctgtgcttaaattttctgtgtttaggttgttgtttcaaggttgctacaaatgtgaggttctctgtattaatgtgaaaaataatgttgtacaacttgaacgagattctcat

SEQ ID NO: 5436 - DNA, 2436 bp, Ocimum basilicum
acaacacgcacacacacaatcatcacaaaccttctccaatcacctctctctacttgttaatttctcgcctccagtatttgtgtttttgtgtgtgtgtgtgtgtgttcaaacaacctgacctgttatttatcgatccattgtgatggcggcggagaatggtcatgttgattccaacggattctgcgtgaagcagagtgatcccttgaattgggttatggcggcggagtcgctcaaggggagccacctcgatgaggtcaagaggatggtggaggagttcaggaagccggtggtgaagctcggcggagaaaccctcactatatcgcaggtggcggcgatcgctgccagggataatgctgtcgccgtggagctggcggaggcggctagagctggcgtcaaggccagcagcgattgggtgatggagagcatgaataagggaactgacagttacggagtcaccaccggtttcggcgccacgtcacaccgccggaccaagcaaggcggcgctcttcagaaggagcttattagattcttgaatgccggaatattcggaaatggaacagaatcaaatcacacattaccccacacagcaaccagagcagcaatgcttgtgaggatcaacaccctccttcaaggctactccggcatcagattcgagatcttggaagccatcaccaaattcctcaaccacaacatcactccctgcttgcctctccgcggcaccatcaccgcctccggcgatctcgtccccttatcctacatcgccggccttctcaccggccgccccaactccaaggccgttggccccaccggagaagccctcaatgccgaggaagccttcaagcttgccggcgtcaacggaggcttctttgagctccagcccaaagaaggcctggcccttgtcaacggcaccgcagttggctctggattggcctccattgctctgtatgaggccaatattcttgctgttttgtccgaagttatgtcggccattttcgcagaagttatgaacggaaagcccgagttcaccgatcacttaacgcataaactgaagcaccatcctggccagatcgaagctgccgctataatggagcacattcttgatgggagcgtttacgttaaagctgctcagaaactgcatgagatggatcctctgcagaagcctaaacaagacagatacgctctccgcacatctcctcaatggctgggcccacaaatagaagtcatccgcaccgccaccaagatgatcgagagggagatcaactctgtcaacgacaaccctttgatcgatgtttctagaaacaaggctctgcacggtggcaacttccaagggacaccaattggagtgtctatggacaatgcaagattagccattgcatcaattgggaagctcttgtttgctcaattctctgagcttgtgaatgacttctacaacaacggcttgccttccaacttatcaggtggccgcaatcctagcttggactatggattcaagggggccgaaatcgccatggcttcctactgctccgagcttcagttcttggctaaccctgttacaaaccacgttcagagcgctgagcagcacaaccaagatgtcaactctctaggattgatctcatctagaaagacggttgaagcattagatattctgaaactcatgtcatccacttacctcattgctctctgccaagccattgatttgaggcatttggaggagaatctgaagcatgctgtgaagaacactgtgagccaagttgctaagagaactctaacaatgggcgccaacggcgagctccacccttccagattctgcgagaaggacttgatccgtgtggtggaccgcgaatatgtctttgcctacatcgatgatccctgcagcgccacctacccactgatgcagaaactgcgacaagtcctcgtcgatcacgctctgaaaaacggagagaatgagaagaatgtaggcacatccatcttccacaagatcgaagctttcgaagaagagctcaaggccctcttgcctaaggaagttgagagtgcaagaatcgccctcgagagcgggaatccagcagttgcaaaccggattgcggaatgccgatcttaccccttgtacaaattcatcagagaggagctcggaaccagcttcttgacgggcgaaaaggtaatttctccgggtgaggagtgcgagagggtgttcacggcgttgagcaaaggcctcgttgttgatccgttgttggaatgcctccaaggatggaatggtgcacctcttcctatttgctaagcttgtttgttgtttgtctgatggaatattttttgaatttgtctgtgcttaaattttctgtgtttaggttgttgtttcaaggttgctacaaatgtgaggttctctgtattaatgtgaaaaataatgttgtacaacttgaacgagattctcatgttcttact

SEQ ID NO: 5437 - DNA, 2430 bp, Lactuca sativa
  misc_feature (1904)..(1904): n is a, c, g, or t
gagcaatctgatcaatacccattcacgcacaaagagtgtgagtttagtgtgtgaagaagtacacaattagattgttcttgtttctttgatctatagtctacaatctgtataaacaataatggagaacggtaatcacgttaatggagtcgttaatgagttgtgcatcaaggatccattgaactggggagttgcagcggaggcgttgaccggaagtcaccttgatgaggtgaagaagatggttgcggagttcagaaagccggtggtgaagctcggaggagagacgcttacagtttctcaggtggcggggatcgcagctgctaatgacagtgacaccgtgaaggtggagctgtcggaagctgcgagggctggagttaaggcgagtagtgattgggttatggagagcatgaataaaggaactgatagttatggtgtcaccaccggcttcggcgccacctctcaccggagaactaagcaaggcggtgctttacagaaggagctcattagatttttgaacgccggaatattcggcaatggaacggaaacaagccacacacttccacattcagccaccagagccgccatgatcgtcagaatcaacaccctcctccagggttactccggcatccgattcgagatcttggaagccatcaccaagttccttaacaacaacatcaccccttgtttacccctccgtggaaccatcaccgcctccggtgaccttgtcccattatcatacatcgccggcctcttaaccggccgccccaactccaaagccgttggccccaccggagaagtcctcaatgccgaaaaggccttcgctgcagccggagttgaaggtgggttcttcgagttacagccgaaagaagggctagcacttgttaacggcaccgccgtggggtccgggatggcttccatggttctatttgatgctaatgtacttgcgttgttgtcggaagtgttatcggcgatcttcgctgaggttatgcaagggaagccggagtttaccgatcacttgacacacaaattgaagcatcaccctggtcaaatcgaggcggcggcgatcatggagtatattttggacggaagcgattacgtcaaggcggcgcaaaaggtccacgaaatggacccgttacagaaaccaaaacaagatcgttatgctctccgtacatctccccaatggctcggacctcaaatcgaagtaatccgatcatcaaccaaaatgatcgagagggaaatcaattccgtcaacgacaacccattgatcgacgtttccagaaacaaagctttacacggtggtaacttccaaggaaccccaatcggagtttccatggacaacacccgtctcgccattgctgcaatcggaaaactcatgttcgctcaattttctgagctggttaacgatttctacaacaatggattaccatcgaatctctccggtggacgtaaccctagtttggactacgggttcaaaggtggagaaatcgccatggcttcttactgttctgagcttcagtttctcgcaaatccagtcaccaaccatgttcaaagcgccgaacaacacaatcaagacgttaactctctcggattaatttcagcgaggaaaaccgcagaagcagtcgacatcttaaaactcatgtcgtcgacatacttagtcgctctatgccaatccatcgatttacgccatttggaagagaacatgaaatcgacagtgaagaacaccgtaagccaagtcgcgaaaaaggtcctcaccatgggcgtcaacggcgagctccacccgtcgagattctgcgagaaagatctcctccgtgttgttgatcgtgaatacgtcttcgcttacatcgacgacgtttgcagcggcacctacccattaatgcagaaactccgacaggttctggtcgaccacngctctaaacaacggcgaaacggagaagaacactaacacctccatcttccaaaagatcgctaccttcgaagaagaattgaaagtcctgttaccgaaagaagttgaaggtgttagaatcgcttatgagaatgatacattgtcgattccaaacaggattaaagcttgcagatcgtacccgttgtataggtttgtaagggaggagctcggcggagggtttttgaccggagagaaggtgacgtcgccgggagaggagttcgacagggtgttcacggcgatgtgcaaaggtcaaattattgatccgttgttggagtgtcttggagggtggaatggggaacctcttccaatatgttaggaaagtgagtgtgaaaccgtttgaattgtatttgtaatattctgtttttttttttttttttttaaattttatttgcatttaatatctcatcaaagacttccactttcaagtgtggtgtatgtggttgtaaatcatatatattaacttattatttttgccgaaaaaacaaacttat

SEQ ID NO: 5438 - DNA, 2318 bp, Artemisia annua
ttctttactgacaattcattcacttgtgtttgtgtcagtgtacgtcttggaaatgggcagtctaacggtggaaaatgtgcatcaaaacggtgtggtagttggtttatgtgtgaaaggtgacccattaaactggggtgcagcagctgaaagtttgacagggagtcatttagatgaggttaagaagatggttgctgagtttaggaaacctgttgtgaaactaggtggtgaaacactgacagtgtcccaggttgctgggattgcggctagtgaaaacgctggtgttaaggttgagttgtctgaaagtgctagagctggagttaaagctagcagtgattgggttatggagagtatgggtaaagggactgatagttatggtgttactactggttttggcgctacttctcacaggagaaccaagaatggtggtgctcttcagaaggaactcattagatttttaaattccggaatctttggcaatggcacagaatcaagtcataccctaccacattcggcaacaagagccgccatgcttgttagaatcaacaccctactccagggttactctggcatccgttttgagatattggaagcaatcaccaagttcctcaatagcaatgttaccccttgtttgccccttcgtggtaccatcaccgcatccggtgaccttgtcccattgtcgtacattgctggacttctgaccggccgacccaactcaaaagctgtcggtcccgatggacaaatccttaatgccgaaaaggcttttagcctagctggtgttgagggtggattcttcgagctacagcctaaagaaggtctagcacttgttaacggtactgctgtgggatcaggaatggcctcaatggtcctttttgaagccaatgtactttcattgttagcagaagtcttgtctgccattttcgccgaggttatgcaaggaaagcccgagttcacggatcacttgacacacaaactaaagcaccaccctggccagattgaggctgcagcgatcatggagtacatattggatggaagtgattatgtaaaggcagcacaaaaggttcatgaaatggacccgttacagaaacctaaacaggaccgttacgctcttaggacttcacctcaatggttaggcccacaaattgaggtcatccgatcatccactaaaatgattgaaagagagattaactcggtgaacgacaaccctttgattgatgtctcaaggaacaaggccttgcacggtggcaacttccaagggaccccgattggtgtttccatggacaacacacgtttggctattgcagcaataggtaaactcatgtttgcccaattctccgagctcgttaatgacttctacaacaatgggttaccttccaatctttctggtggacggaatcctagcttggattatggtttcaaaggtgcggaaattgcaatggcatcttactgttctgaactccaatttcttgccaaccctgttactaaccatgtccaaagtgccgaacaacacaaccaagatgtaaactctttgggtttaatttctgcccgtaaaacttccgaagctgttgacatcttgaagctcatgtcctcaacatatttggtagctttatgccaagccatcgacttacgacacttggaggaaaacttgaaagccactgtcaagaacaccgtgagccatgtagccaaaaaagttctaaccacaggtgtgacaggagagcttcacccctccaggttctgtgaaaaggacttgcttagagtcatcgatcgcgagtatgtctttgcatacattgatgacgtgtgtctcgccacatacccattaatgcaaaagcttcgacaagtcctggttgaccacgctttaaacaacggtgagaacgagaaggatgcaagcacttcaatcttccaaaagatcggtatgtttgaagaagagttgattgcccttttgccaaaggaggttgagagtgtaagaaatgcttatgaaaccggtgagcttgcaatcccaaacaggatcaaggcttgtaggtcatacccgttgtataggtttgtgagggaggagctcggaacaggttacttgacaggggagaatgttacttcacccggagaggaattcgataaggtgtttacagcagtatgcaaggggctagtgatcgatccattattggagtgtcttcaaggctggaatggtgctcctcttccaatttgttagtttaattagattcacgagtctgttgtttattactattctaagttcttttgtcaaatctttttacttattagtgtatctttcttgtttcataaatttaaagatccctgcttcatcctcc

SEQ ID NO: 5439 - DNA, 2535 bp, Ocimum basilicum
gcacgcaccgttacacacacgcacacaaggagaagaacgcaacaaagattcctctctttcaagtgtgccacttcataccatctctaccacttaaaattcgatggcggctgcgacggaaaacgttcatcactccaatggtttctgcgttaagcagaacgacccactgaattggggggcggcggcggaagcgctgcaggggagccacctcgacgaggtgaagaagatggtggaggagttcaggaagccggcggtgaagctcggcggagagactctgactatagcccaggtggccgcgatcgccgccagggataatgcggtggccgtcgagctgtctgaggaggccagggctggcgtcaaagctagcagcgattgggtcatggacagtatgaacaaaggaaccgacagctacggcgtcaccaccggctttggcgccacttctcaccggagaactaagcagggcggcgctcttcagaaggagcttattagatttctaaatgcgggaatcttcggaaaagggacagaaagttgccacacattaccacactcggcaacacgggcagcgatgctagtgagaatcaacactcttctgcagggatattccggcatccgattcgaaatcttggaagccctcgccaaatttctcaaccacaacatcaccccctgcctccccctccgcggcaccatcaccgcctccggtgacctcgtccccttatcctacatcgccggcctcctcaccggccgtcccaactccagggctgtcgctcccaccggcaccgagctcaacgccgaggaagcattcaagctcgccggcatcaacggcggcttcttcgagctgcagcccaaagaaggcctcgccctcgtcaacggcacagccgtcggctccggcttggcctccatcgctctctacgaggccaacatcttgtccgtgttatccgtagtgatctccgcaattttcgccgaagtgatgaatggaaagccggagttcaccgaccacttgacgcacaagctgaagcaccacccggggcagattgaggcggcggcgatcatggagcacattctcgacggcagcgcgtatgtgaaggcggcgcagaagctgcacgaaatggatcccctgcagaaaccgaaacaagataggtatgctctgagaacctcaccacagtggctgggcccacaagttgaggtgatccgcaccgccacaaagatgattgagcgggagatcaattctgtcaacgacaacccgctgattgatgtttctagaaacaaggccttgcacggcggcaatttccaagggactccaatcggcgtctccatggacaacgccaggctggcgatcgcctcaattgggaaactgatgtttgctcaattctcggaactcgtgaacgacttctacaacaacggtctcccctccaacctttccggcgggaggaaccccagcttggactacggcttcaagggggccgaaatcgccatggcctcctactgctcggagctccagttcctggctaaccctgtcaccaaccacgtgcagagcgcggagcagcacaaccaagacgtcaactccctgggattgatctcatccaggaaaactgttgaagcattggatatcctgaagctcatgtcttccaccttcctgatcgcgctctgccaggccattgatttgaggcatctggaggagaatctgagagccgctgtgaagaacacagtgagccaggtggccaagagaactctaacaatgggcgtcaacggggagctccacccatccagattctgcgagaaggacttgctccgtgtggtggacagggagtatgtgtttgcgtacattgacgacccctgcagcgccacctacccactgatgcagaagctgaggcaggtgctggtggagcacgccttgaacaacggggagaatgagaagaatgtgagcagttccatcttccagaagatccaggtgttcgaggaagagctcaagggagtgcttcccaaggaagtggaggcagcgagagcggcagtggagggtggaaatccggcggtggccaacaggatcaaggagtgcaggtcatatccactgtacaagttcgtgagggaggagttgggaacagaattgttgacgggggagaagacaacatcgccaggggaagagggggataaggtgttcacggctttgagcaatggattaattgttgatccattgttgaaatgcctggaggcatggaatggggaacctcttccaatctgctaagtttgtaatttatgcggctcttatttttgatgtggtgttgtatctgataattgtattttaagggagggacgggacctctgggaatttctaggttgggtctcacatatttagtgtgtattattattttataaatccaactctgttctcgcacttcaactccctcaccctgctcccaatcactcaactatctatattttaggatttattttcatttctttttctttatggaaggaaataaaacactcatctttgagattgaatattaaatgactctaatgaaagaaacacaacaacagttc

SEQ ID NO: 5440 - DNA, 2403 bp, Lactuca sativa
gagcaatctgatcaatacccattcacgcacaaagagtgtgagtctagtgtgtgaagaagtacacaattagattgttcttgtttctttgatctatagtctacaatctgtataaacaataatggagaacggtaatcacgttaatggagtcgttaatgagttgtgcatcaaggatccattgaactggggagttgcagcggaggcgttgaccggaagtcaccttgatgaggtgaagaagatggttgcggagttcagaaagccggtggtgaagctcggaggagagacgcttacagtttctcaggtggcggggatcgcagctgctaatgacagtgacaccgtgaaggtggagctgtcggaagccgcgagggctggagttaaggcgagtagtgattgggttatggagagcatgaataaaggaactgatagttatggtgtcaccaccggcttcggcgccacctctcaccggagaactaagcaaggcggtgctttacagaaggagctcattagatttttgaacgccggaatattcggcaatggaacggaaacaagccacacacttccacattcagccaccagagccgccatgatcgtcagaatcaacaccctcctccagggttactccggcatccgattcgagatcttggaagccatcaccaagttccttaacaacaacatcaccccttgtttacccctccgtggaaccatcaccgcctccggtgaccttgtcccattatcatacatcgccggcctcttaaccggccgccccaactccaaagccgttggccccaccggagaagtcctcaatgccgaaaaggccttcgctgcagccggagttgaaggtgggttcttcgagttacagccgaaagaagggctagcacttgttaacggcaccgccgtggggtccgggatggcttccatggttctatttgatgctaatgtacttgcgttgttgtcggaagtgttatcggcgatcttcgctgaggttatgcaagggaagccggagtttaccgatcacttgacacacaaattgaagcatcaccctggtcaaatcgaggcggcggcgatcatggagtatattttggacggaagcgattacgtcaaggcggcgcaaaaggtccacgaaatggacccgttacagaaaccaaaacaagatcgttatgctctccgtacatctccccaatggctcggacctcaaatcgaagtaatccgatcatcaaccaaaatgatcgagagggaaatcaattccgtcaacgacaacccattgatcgacgtttccagaaacaaagctttacacggtggtaacttccaaggaaccccaatcggagtttccatggacaacacccgtctcgccattgctgcaatcggaaaactcatgttcgctcaattttctgagctggttaacgatttctacaacaatggattaccatcgaatctctccggtggacgtaaccctagtttggactacgggttcaaaggtggagaaatcgccatggcttcttactgttctgagcttcagtttctcgcaaatccagtcaccaaccatgttcaaagcgccgaacaacacaatcaagacgttaactctctcggattaatttcagcgaggaaaaccgcagaagcagtcgacatcttaaaactcatgtcgtcgacatacttagtcgctctatgccaatccatcgatttacgccatttggaagagaacatgaaatcgacagtgaagaacaccgtaagccaagtcgcgaaaaaggtcctcaccatgggcgtcaacggcgagctccacccgtcgagattctgcgagaaagatctcctccgtgttgttgatcgtgaatacgtcttcgcttacatcgacgacgtttgcagcggcacctacccattaatgcagaaactccgacaggttctggtcgaccacgctctaaacaacggcgaaacggagaagaacactaacacctccatcttccaaaagatcgctaccttcgaagaagaattgaaagtcctgttaccgaaagaagttgaaggtgttagaatcgcttatgagaatgatacattgtcgattccaaacaggattaaagcttgcagatcgtacccgttgtataggtttgtaagggaggagctcggcggagggtttttgaccggagagaaggtgacgtcgccgggagaggagttcgacagggtgttcacggcgatgtgcaaaggtcaaattattgatccgttgttggagtgtcttggagggtggaatggggaacctcttccaatatgttaggaaagtgagtgtgaaaccgtttgaattgtatttgtaatattctgttttttttttttttttttaaattttatttgcatttaatatctcatcaaagacttccactttcaagtgtggtgtatgtggttgtaaatcatatatattaacttatt

SEQ ID NO: 5441 - DNA, 2142 bp, Jatropha curcas
atggcaacaattatcggaaatggtcaccagaatggttctttagagggtctgtgtataactcgtgatccactgagttggggagtggctgctgagtcaatgaaaggtagccatttagatgaggtgaagaagatggtgagtgaatataggaaacctttggtcaagttaggtggcgagaccttgactgtagctcaggtggctgctatcgccagtcatgatgccggtgttaaggtggagcttgctgagtcagcccgagctggggttaaagctagcagtgactgggttatggatagtatgaataaaggaactgatagttatggtgttactactggttttggagctacttcccatagaagaaccaaacaaggtgctgctctgcaaagggagcttattagattcttgaatgctgggatttttggcaatggaacagaaacatgtcacacattacctcactctgcaacaagagcagcaatgctagtgagaatcaatactcttcttcaaggttactcaggcattagatttgaaatcttggaagccattactaaactcctcaaccacaatatcactccatgcttgcctctccgtggcacaatcactgcttcaggagatttagttccattatcttatattgctggattattaaccggccggcctaattccaaagccattggcccttccggagaatctttagatgctgttgaagcttttcgccttgctgatattgattctggattctttgagttacagcctaaagaaggtcttgctcttgttaatggcacagcagttggttctgggttggcttctatggttctatttgaagcaaatgttcttgctgtcttgtcagaaatattatcagcaattttcgccgaagttatgaatggaaaacctgaatttactgatcatttgacacataaattgaagcatcatcctggtcaaattgaagctgcagctataatggagcatattttagatggtagctcctacattaaagctgctaaacaattacatgaaattgatccattgcagaaaccaaaacaagatcgttatgctttaagaacttctcctcaatggttaggccctcaaatcgaagttattcgattttctactaaatcaattgaaagagagattaactctgtcaatgataatcctttgattgatgtttcaagaaacaaggctttacatggtggaaactttcaaggcacaccaattggtgtttcaatggataatgcacgtttggctattgcttcaattgggaagttaatgtttgctcaatttagtgagctcgtaaatgatttttacaataatgggttgccttcaaatctttctggaggaagaaatccgagtttggattatggattcaaaggagctgaaattgcaatggcttcatactgttctgagcttcaatttcttgctaatccagttactagccatgtgcaaagtgcagagcagcataatcaagatgtgaactcattagggttaatttcttcaagaaagactcaagaagcgattgatattttgaagcttatgtcttcaactttcttagtagcactatgtcaagctattgacttgaggcatttggaagagaatttgaagcatgcagttaaaaataccgtaactcaagtagctaaaagagttttaactactggtgccaatggagaacttcatccttcaagattttgtgggaaagatttgctaaaagttgtcgatcgcgaacaagtgtttgcgtatattgatgatccctgtagtgcgacatatcctttgatgcaaaaactaaggcaagttcttgtcgaacatgccttggcgaatggcgaaaatgaaaaaaatgctagcacttccgttttccaaaagattggtgcttttgaagaagaattgaaaacccttttgcctaaagaagttgaaagtgcaagagaagcatatgagagtggaagtgcagcaattggcaataagattaaggaatgcaggtcatatcctttgtataagtttgtgagggaggagttaggtagtggattgctcaccggagagaaagtccggtcacctggagaggagtttgacaaggttttcactgctatgtgtgaaggaaagattattgatccaatgatggaatgtctcaaggaatggaatggtgctcctcttccaatttgttaa

SEQ ID NO: 5442 - DNA, 2405 bp, Populus trichocarpa
ctcttctcctcaggaaatcccatcttccaaaaccaaagatttcctctactgcttctgctcttcctctcacggcaatcatttttctaacctcttcttctctctcatttacactttaatttcttctaacaaaacgaatggagacaatcaccaagaatggctaccaaaatggttcttcggagagtttgtgtacccaacgtgatccactcagctggggtgttgctgctgaggcaatgaaaggaagccatttggacgaagtgaaacgtatggtagccgagtataggaagcctgttgtgaatcttgctggtcagaccttgaccattgctcaggttgcatccattgctggccatgatgctagtaatgtcaaggtggaactttctgagtctgcaagacctcgtgtcaaggctagcagtgactgggtcatggatagcatggacaagggaactgatagttatggtgttactactggttttggtgctacttcccatagaagaaccaaacaaggtggtgctcttcagaaggaactcattagattcttgaatgctgggatctttggcaatggaacagaaacttgccacacactgcctcactcagctactagagcagctatgcttgtcaggatcaacactctcctccaaggttactctggcatcagatttgaaatcttggaagcaattaccaagctacttaataacaacatcactccatgcttgccactacgtggtacaatcactgcttcaggtgatttagtcccattatcctacattgctggattactgactggaaggcctaattccaaggccactggtcccaacggagaagtgctggatgctgtggaagcctttaaagctgctggtattgattctggattctttgagttgcagcctaaagaaggcctcgctcttgttaatggaactgcagttggttctggtttggcttccatggttcttttcgagaccaacgttcttgctgtcttatcagaactcatatctgcaattttcgccgaggttatgaatggtaaacctgaattcactgaccatctgacacacaaattgaagcaccatccaggtcaaattgaggctgctgctataatggagcacattttagatggcagcgcttacatgaaggcagctaagaagttgcatgaaatggaccccttgcagaaaccaaagcaagatcgctatgctctgaggacttcaccccaatggcttggcccccagattgaagtgatccgattctcaaccaagtcaattgaaagagagattaattcagtgaatgacaaccctctaattgatgtttcaaggaacaaggccttacatggtggcaacttccagggaactccaattggagtctcaatggacaatgtacgtttggctattgcatctataggcaagctcctattcgctcagttcagtgagctcgtaaatgatttctacaacaatggattgccatcaaatctcactgctagcagaaatccaagtctggattatggtttcaaaggagctgaaatagcaatggcctcctactgttctgagcttcagtatctcgctaatccagtcaccagccatgtgcaaagtgccgagcagcacaatcaagatgttaactcgttgggacttatttcttcaagaaagacagcagaatctgtcgatatcttgaaactcatgtccacaactttcttagtggcactctgccaagcaattgacttgaggcatttggaggagaacttgaggagcgctgtcaagaacactgttagtcatgtatccaagagggttttaactacaggtgctaatggagaacttcacccatcaaggttctgtgagaaggagttgctcaaggtggttgatcgtgaagatgtctttgcttacgccgatgacccctgcagtgctacctatccattgatgcaaaaactaaggcaagttcttgttgaccatgcattggcaaatggagagaatgagaagaacacaagcacttcagtcttccaaaagattacagctttcgaggaagaattgaaggcccttttgcctaaagaggttgagagcgcaagagcagcatatgatagtgggaattcagcaattgagaataagattaaggaatgcaggtcttatccactgtacaagtttgtgagggaggagttgggaactggattgctcactggtgaaaaggtccgatcgcctggtgaggagttcgacaaggtgtttacagccatgtgccaggggaagatcattgacccaatgctggaatgccttggtgaatggaatggtgcccctcttccaatctgttgagtgttttctattactaaataaatttgttgtaatgtttttgaacattgtttccaatcccttctacgttcttaaagtttcatggctatgtactacataagctgcgataaaaaagtttccatttcagta

SEQ ID NO: 5443 - DNA, 2398 bp, Gossypium hirsutum
cctcaccattttgtatattctttcctgggtcaatctttgcttctcatttcaatggagtccatcactcaaaatggtacctcaaatggccatttgcagagcttttgcagcgccacaaatggtggtgttggtgtgctggtggaccctttgaactggggtgttgctgctgagtcacttaaagggagtcatttagatgaagtgaaacgtatggtggctgagtttaggaaaccattggtgaaactcggtggtgagaccttaaccatttctcaagttgctgccattgctacacgtgacttgggtgtcaaggttgaactctcagaggatgcaagggctggtgttaaagctagtgctgattgggtccttgatggtatgaataaaggaactgatagctatggtgtcaccactggttttggtgctacttctcatcgacgaaccaagcaaggcgctgcccttcaaaaagagctcattaggttcttgaatgctgggatatttggcaatggaactgagtcatgtcacacattgcctcactcagcaaccagagcagctatgcttgttaggatcaatacccttttacaaggatactctggcattagatttgagattcttgaggcaatcactaagcttcttaacaacaacatcacgccgtgtttgccgctccgcggcacgattactgcatccggtgacctcgttcctctttcctacattgctggattactcactggcaggcctaattccaaggctgttggacctaatggagaatcccttgatgctgaagaagcctttcgtgttgccgggatcgattcgggtttttttgtgttgcagcctaaagaaggacttgctttagttaacggcaccgcggtcggttcgggtttggcttccatggttctttttgaagcaaacattttagctgttttgtctgaaattttatcagcaatttttgctgaagttatgaatggtaaacctgaatttactgatcatttaacacataaattgaagcatcatccaggacaaattgaagcagctgctataatggaacatatacttgatggaagctcttatgttaaagcagctaaaaaattgcatgaaatggacccgttgcaaaaaccgaaacaagatcgttacgcattgaggacgtctccgcaatggctcggtccacaaatcgaagtgatcagattcgcaaccaaatcgatcgaaagagagatcaattctgtcaacgacaaccctttgatcgacgtttcgaggaacaaagcattacatggtggcaatttccaaggtacacctattggtgtttcaatggacaatactcgtttagctattgcagctatcgggaaacttatgtttgctcagttttcggaactcgttaacgatttctacaacaacggtctcccatcaaacctctccgctagtaggaacccgagtcttgattatggtttcaaaggtgctgaaatcgcaatggcctcctattgttccgagctccaatacttagctaatccggtcactaaccatgttcaaagtgccgaacaacacaatcaagatgtgaactcattaggactaatatcatcacgaaaaacagccgaagcagtcgatatcttaaaactcatgtcctctacatacttggtagctctatgtcaagctattgatttaaggcatttagaagaaaacttgaggaacacggtgaagaacactgtgagtcaagtagccaagaaaaccctcacaaccggtaacaatggtgaactccacccatcgagattctgcgaaaaggatttgctcaaagccgtggaccgcgagtacgtgtttgcttacatagatgatccatgcagtgctacttatcccttgatgcaaaagctaagacaagtccttgtcgaacacgcattcgccaatggtgacaatgaaaaggatacaaacacttccattttccaaaagatcacagcatttgaagatgaattcaaagctgcattgccaaaagaagttgaaggtacaagggtttcacttgaaaatggaaatgcaacaatccctaacaagatcaagggttgtagatcatatccattgtataaatttgtgagggaagagcttggaactgggttgttgagtggtgaacaaggtaagtcacctggtgaagaatttgataaggtgttcatagctatgtgtgaagggaagattatcgatccaatgatggaatgtttaaagggttggaatggtgctccacttccaatttgttagtgtgcttttttcattgtttatttcttcaatttttttctttgttttttcagcttaattgtctttcaatttcattgtgaaaaaaaaatagtaaatgataatatgaggtgaatgtacgggtggtatgtttgtttctcattttctctctcttgtttttactttataataatcaatgttagtactt

SEQ ID NO: 5444 - DNA, 2254 bp, Beta vulgaris
tttttcatctcttcaactcaaaactcccacatcatcattttgtttgctatttcctctatttcaatcttacaaaaacacatccaaaatcacagaaatggaggctaatcagcaataccaaaacggatcatcagaaatggacctttgcattggaggaaagcctattcaggctgacccattgaactggggaaaggcggccgaagcgatcaccggtagccaccttgatgaagtgaagaagatggttgcggagtatcgaaacccggctattcgtctaggaggagaaacacttacagtggctcaagtagcggccgtagcagccgccactggacctcatgaggcagccgtggagctagctgaatctgctagagccggagttaaggctagtagtgattgggtgatggatagcatgaataaaggaactgatagctatggtgttactactggttttggtgctacttctcatcgtagaactaaacaaggtggtgcccttcaaaaggagcttattagatttttgaatgctggagtattcggcaatggaacagaatcaagccacacactgcctcacacagcaacaagggcagctatgcttgtgagaatcaacactcttcttcaaggttactccggtatccgtttcgagattttggaagcaatcactggactcctcaacaacaacatcactccttgtcttccccttcgtggaactatcactgcctcaggggaccttgtaccactgtcttacattgcaggtctactaacaggcaggcctaactccaaggccgtaggccctaatggtgaggtccttaacgcggaacaggccttcaaggctgctcaaatcagctccggctttttcgagcttcagcctaaggaaggtctcgcattggtaaatggtactgcagtaggttcagggatggcatccattgtcttgtttgaaaccaacattctcgcggtgctggcagaggttatctcagctgtctttgctgaagtgatgaatggaaagcctgagttcacagatcacttgacccacaaattgaagcatcacccaggacagattgaggctgcagccattatggaacacatattagatggtagctcatacatgaaagctgctaaggcactacacgagttggacccattgcagaagccaaaacaggatagatatgctttgaggacatcacctcaatggctaggccctcaaattgaggtcatccgttttgccacaaagtccattgagcgcgagatcaactctgttaatgacaacccacttattgatgtatcacgtaacaaggccctgcacggtggaaatttccagggtacccctattggtgtttccatggacaacgcaaggttggctatcgcggccattggaaagttgttgtttgctcagttctctgagctagtcaatgactattacaacaatggccttccatcaaaccttacagcaagcagggaccccagcttggactatgggttcaagggcgcggaaattgcaatggcttcttactgttccgagcttcagtttttgggtaacccagttacaaaccatgtccaaagcgcagagcagcataaccaggatgtgaactccttgggtttgatctcagcccgtaagacagctgaggcagtggatatcctgaaactgatgtcatccactttcttagtggcactatgccaagctattgatctgaggcatttggaggagaatgtgaaacatgcagtgaaaaacactgtcagtcaggtgtgcagaagggtcctgatcactggttccaatggcgagctccacccaggaagattctgtgagaaagagcttatcagagttgtagaaagagaatatgtgtttgcttatgctgatgatccttgcagtgtcacttaccctctgatgcagaaactcagacaagtgcttgttgatcaggccttggctaatggtgatagtgagaagaatgtgagcacttcgattttccagaagatcggagccttcgaggaggagctcaaggcacgcctgcctaaggaagtagaggctgcacgcgctgcctacgagagtggtaactccgttatcccaaacaggattaaggagtgcaggtcttaccctgtgtacaagtttattagggaggagctgaacaccaacttgcttactggagagaaagtgatatctccaggagaggaaattgacaaagtgttcactgcaatatgccagggaaagattattgatcctcttctcgattgtcttaaggagtggaatggtgctcctctgcctatctgttaa

SEQ ID NO: 5445 - DNA, 2551 bp, Citrus sinensis
gaaaatttccctttcatcatcgtcacagattcacgtttacatgcaataaatatataattgcccccacaaaagattttcccacccattttctctcccacccatcagtacatttacttcttttaactcaaaaacaacaaggaaaaaaaagaaaatggagttgtcacatgaaacatgcaatggcatcaacaatgataggaatggtggtacttcgtcattggggttgtgcacaggtactgaccctttgaactggaccgtggcagcggactcattgaaagggagtcaccttgatgaagtgaaacggatggttgacgagtacaggaggccggtggtgaagctcggcggcgagtccttgaccataggccaagtgactgctatcgcggcccacgactctggagtcaaggtggagctagcggaggccgcccgcgccggcgtcaaggccagcagcgattgggtgatggacagcatgatgaaagggactgatagctatggtgtcaccactggctttggtgcaacttctcaccggcgaaccaagcaaggtggtgctttgcaaaaggagctcattagattcttgaattctggaatttttggcaatggcactgaatcaagccacacattgcctcactcggcaacaagggcagcaatgctggtgagagtcaacaccttgttacaaggatactcaggcatcaggtttgagatcctggaaaccattaccaagttccttaaccataacatcaccccatgcttgccgctacgtggcacgatcaccgcgtcgggcgacctggtcccactctcgtacattgctgggcttttgacaggcaggcccaactcgaaggctgttgggcccaacggccaagttctcaaccccaccgaggccttcaacctagctggggtcactagtggattttttgaattgcagcctaaggaaggtcttgccctggtgaatggcacagcggttggttctggtttagctgccacggtactctttgaggctaacatattagccattatgtctgaagttttatctgcaatttttgcggaagtgatgaatgggaaacctgaatttacagaccacttgacacataagttgaagcaccatccgggacaaattgaagctgcagctattatggaacacattttggatggcagctcttatgttaaagcagcacaaaagttacatgaaatcgatcctcttcaaaagccaaagcaagacagatatgctcttcgaacatcgcctcaatggctaggcccccagattgaagtgatcagggcagctaccaaaatgattgaaagagagattaactccgtgaatgacaatccattgatagatgtatcaaggaacaaggcgcttcatggaggcaatttccaggggaccccaattggtgtttccatggacaacacccgtctagccattgcttcaattggcaagctcatgtttgcacaattctctgagcttgtcaatgatttctacaacaacgggttgccttcaaatcttactgggggacgtaatccaagcttggattacggattcaagggtgccgaaattgcaatggcatcatactgttctgaactccaattcctcgccaatcctgtcaccaatcatgtccaaagtgctgagcaacacaaccaagatgtgaactctttaggcctcatttcttctaggaaaactgctgaagcagtagacatattgaagcttatgtcgtcaactttcttagttgctctatgccaagcgattgacttgaggcatctggaagagaacctcaagaacacagtgaagaacaccgtgagtcaagttgccaagagagtcttgaccatgggagtgaatggagagcttcacccttcaagattctgcgaaaaagacttgatcaaagttgtggacagagaatatgtctttgcatacattgatgatccttgcagtgcaagttacccattgatgcagaagctgaggcaagtgcttgttgatcatgcgttggacaatggagacagagagaagaattcaaccacttcaatcttccaaaagattggagcctttgaggatgaactaaagacccttttgcctaaagaggtcgaaatcgccagaactgaacttgagagtggaaatgcagccattccaaacaggatcaaggaatgcaggtcctatccgttatacaaaattgtgagagaagagattggaacaagtttgttgactggcgaaaaggttcgatccccaggtgaagaattcgacaaagttttcgcagcaatgtgtgaagggaagttgattgatcctatgcttgaatgcttgaaggagtggaatggtgctcctcttcctatttgccagaattaatggtttgattaagtacagttttatgacagtgtctttttttattcttcttgttcttatgcttttacttgccatgttgtgtagtcaacttgaaacagtcaattcaattgcttttttggtttttctgtatttggaaaagttgggacaataacaaatgtaatgttgataacaagatcttttgttatttcagttcaagttgaattaatgaaatatgaagaaatatttctgtcaaaa

SEQ ID NO: 5446 - DNA, 2327 bp, Salvia sclarea
gcggggggcggcgatcaatccatggcggcggagaacggtcatcacgaggagtccaacggcttctgcgtcaagcagaacgatcccttgaactgggtggcggcggcggagtcgctcaaggggagccacctcgacgaggttaagcggatggtggaggagttcaggaagccggtggtcaagctcggcggggagacgctcaccatatctcaggtggcggcgatcgcggccaaggataatgcggtggcggtggagctggccgagtcgtccagggccggcgtcaaggccagcagcgattgggttatggagagcatgagtaaaggcaccgacagctacggcgtcaccaccggtttcggtgccacctctcaccggaggaccaagcagggcggcgctcttcagaaggagctcattaggttcttgaacgccggaatattcggaaacgggacagaatccaaccacacgctgccgcacacggcgacgagagcggcgatgctggttcggatcaacaccctcctccaaggctactccggcatcagattcgaaatcctggaagccatcacaaaattcctgaacgagaacatcaccccatgcctccccctccgcggcaccatcacggcctccggcgatctggtgccgctatcctacatcgcgggcctcctgacggggcggcccaactcgaaggctgtgggccccaacggcgagcccctgaacgcggaggaagccttcaagctggccggcgtgaaaggcggcttcttcgagctgcagcccaaggaagggctggccctggtgaacggcaccgccgtggggtccggactggcctccatcgccctcttcgacgccaacatcctggccgtcctatcggaggtgatgtccgccgtgttcgcggaggtgatgaacgggaagccggagttcacggatcacctgacgcacaagctgaagcaccacccggggcagatcgaggcggcggcgatcatggagcacatcctggacggcagcgggtacgtgaaggcggcgcagaagctgcacgagcaggatcccctgcagaagcccaagcaggacaggtacgccctccgcacctcgccccagtggctgggcccgcagattgaggtcatccgcaccgccaccaagatgatcgagagggagatcaactccgtcaacgacaaccccttgatcgatgtttctagaaacaaggccttgcacggtggaaacttccaaggcacccccatcggagtctccatggacaatgcccgcctagccatcgcctccatcgggaagcttctcttcgctcagttctccgagctcgtcaacgatttctacaacaacggattgccgtccaacctctccggcggccgcaaccccagcctcgactacggcttcaagggctccgagatcgccatggcctcctactgctccgagctccagttcctggccaaccccgtcaccaaccacgtgcagagcgccgagcagcacaaccaggatgtcaactcattgggcttgatctcttcacggaagaccgttgaagctctcgacattcttaaactcatgtcgtccacctacctcgtcgccctatgccaagccgtggatttgaggcatttggaggagaatctcaagcacgcggtgaagaacaccgtgagccaggttgctaaacgaactctcacaatgggcgtcaatggcgagctccatccttccagattctgcgagaaggacttgatccgcgtggtcgaccgcgagtacgttttcgcctacatcgacgacccctgcagcgccacctaccccttgatgcagaagctgaggcaggtgctcgtcgatcacgccctcaagaacggggacttggagaagaacgcgagcacctcgatcttccagaagatcgaggcgttcgaggaggagctcaaggccttattgcccaaggaggtggagagcgcgaggatggccctcgagagcgggagccccaccgtggccaaccggatagcggagtgcaggtcgtacccgttgtataagttcataagggagcagctcggcgcggggttcttgacgggggagaaggcggtgtcgccgggggaggagtgcgagaaggtgttcacggcgttgagcaatggcctcattattgaccccttgttggaatgccttcaaggatggaatggtcaacctctgccaatctgctagttcgttttctatatgtttcgcccaaataatttttttcgatttgttttctgtgcttaaatttgctctttttttcatttgtgttcttcttcgacggaatctcctgtgttttgtgaaataatgtgtaaaattcaatgggattctcgcgtttgcaactcacgtaattgtttctg

SEQ ID NO: 5447 - DNA, 2649 bp, Aquilegia formosa
atttccattccaacttccaacaacaaaagcttttgattactttctgattctctgtactctgtttttagtccattatttgctctgctttctttcttctttgattctatcttctttttttatcaacaaaagaacaaagatctcaacaactttgatctttattttggtttttactacataccctttgtttctttctaagatttctaaagttggtatttttttttttatttcacttttatacttctctataaattaaaatcctccgttcttgctctatagtatccatctctactactgtattaattaaacttattcatttttttcttctctggttattaacatggcagctactaaaattaatgaaaatggaaattcaaatagtttgtgcattaacaaaatagacccattaaactggggattagcagctgagtcattgaaaggtagtcatcttgatgaagttaaaagaatggttgaagaatttcgaaaaccaggtttgaaacttggtggtgcaacacttactgtatcacaagtagctggaattgctgcacatggagcaaatgttaaagttgagttatgtgaatcagctagagctggtgttaaagcaagtagtgattgggttatggaaagtatgaacaaaggtactgatagttatggtgttacaactggttttggtgctacttctcatagaagaactaaacaaggaggtgctcttcagaaagaactcattagatttttgaatgctggagtatttggtaatgggactgaatctagccacacattgccttattctgcaacaagagctgctatgttggtcaggatcaacacactccttcaaggatattcgggaattcgttttgaaattttagaagccattaccaagtttctcaataacaatataactccatgtttacctctaagaggtacaatcactgcatcaggtgatcttgtccctctttcgtatattgctgggcttttgaccggtcggcccaattcaaaggcagttgggcccaatggtgaatctcttaatgctgaacaagctttcaacttagctgggattagcagtggattttttgagttacagcctaaggaaggtcttgctcttgttaatggtactgcagtgggttcaggcttagcttcaatggttttatttgacgccaatatacttgctgttatgtcagaagtattgtcagctatctttgctgaagtcatgcaaggtaaaccagagtttactgatcatttgactcacaaactaaagcaccacccaggtcaaattgaggctgcagctataatggaacatattttagatggtagttcttatgtgaaatcagctaagaagctacatgatactgatcccttacagaagcctaaacaagatcggtatgctctacgtacttctcctcaatggctaggccctcagatagaagtcatccgatcgtccaccaaatccattgagcgtgaaataaactctgtcaatgacaatccattgattgatgtatcaaggaacaaggccatacatggtggaaacttccaagggactcctattggagtgtcaatggataacacaagactagcaattgcatccattgggaaactaatgtttgcgcaattctctgagctcgttaatgatttctacaacaatgggttgccttcaaatctgtcaggtggaaggaatcctagcttggattatggtttcaagggtgctgaaattgcaatggcttcttactgttctgaattacagttccttgccaatccagtgaccaaccatgttcaaagcgcagagcaacacaaccaagatgtcaactccttgggcttaatttcttctagaaagacagctgaagccgttgacatcttgaagctcatgtcatctactttcctagttgcactttgccaatcaattgatttgaggcatttggaagagaacttgaagagcacagtgaagaacacagtaagtcaagtagctaagagagtactaactatgggtgttaatggggagctccatccttcaaggttctgcgagaaggacttactcaaggtggttgatcgtgaatatgtcttttcctacattgacgacccttgcagcgctacataccctttgatgcagaagttgaggcaagtccttgttgaacatgcactactcaatggagagaaagagaaaacctcaagcaattcaatcttccaaaagattaatgccttcgaagaagaactgaagaaccttttacctaaggaagttgagagtacaaggacattgtatgagactggtacattgccaattgctaaccagataaaagaatgcaggtcatatccattgtacaagtttgtgagggaagagttggataccggactactcactggagagaaaaccctgtcaccgggtgaggtttttgacaaggtgtttactgctatgtgcaacgggaagatgattgatcccctactcgaatgtttaagctgttggaacggtgaaccacttccaatctgttagtagttggtagtttgcaccattacagcttcatttggaattgtttcttgattctctagtcttctttttactgtcaatctgtaatgtggtttttgaccataagatcacacttggagtgtctatataccggaaaaatgtgatctccggaacttatatgaataatatatattgtttat

SEQ ID NO: 5448 - DNA, 2690 bp, Mimulus guttatus
atgactcgccctcctcctttcctccactcatccaactcccaaacccacctaccaaaaatccatacatctaacctacatttcaagaaacgctctttcttaaacacacactcaccacacacatacactaacaaagagaaactcagaaaaaagaatacatttttttcatccgccgatcacatttttttccaccagtgttatttatttctccgatcaccgcttatatacaatctaatggcacctgcagttgtggcagccgaaaacgggcaccacgccgccggaaacgggttctgcgtgcagcagaacgatccattgaactgggggatggcggcggagtcactcaagggtagccacctcgacgaggtcaagcgcatggtggcggagttcaggaagccggtggtcaagctcggcggagagacgctgactatatctcaagtcgccgccatcgccgccagggataatgccgtggcggtggagctgaacgagtcggccagggccggcgtcaaggccagcagcgactgggttatggacagcatgaacaaagggactgacagctacggcgtcaccaccggtttcggtgccacgtcacaccgccggactaagcaaggcggtgctcttcaaaaggagctcattaggtttctgaacgccggaatattcggtaacggaacggaatcaaaccacacactcccacactccgcaacaagagcagctatgctcgtcagaatcaacaccctcctccaaggatactccggcatccggttcgaaatcttggaagccataaccaaattcctcaacaacaacgtcaccccatgcttgcccctccgcggcacgatcaccgcctccggcgatctcgtccccttgtcctacatcgccggactcttaaccggccgccccaactccaaggccgtgggccccaccggagaaaccctcaccgccgtcgaagcattcaaactcgccggagttgatggattctttgagctgcagccgaaagaagggcttgcattggttaacggaacagctgttggttccggattggcttcgattgctctgtacgaagccaatgtactttctctactgtcggaagttatgtcggccatattcgctgaagtgatgaacgggaaaccggaattcaccgaccacttgactcataaattgaagcaccaccctgggcaaattgaagctgctgcaataatggagcacattctcgatggaagtgcttatgtgaaagctgctcagaagctacacgaaacagatcctctgcagaagccgaagcaggatcgttacgctcttcgaacttccccacaatggctgggcccacagatcgaggttattcgaacggcgacaaagatgatcgagagggagattaactccgttaacgacaacccgctgattgatgtatcgaggaacaaggcgattcacggcgggaatttccaaggtactccgattggggtttccatggataattctaggttagcaattgcttcaatcgggaagctaatgtttgctcaattctccgaattggtgaatgatttctacaacaacggtttgccgtcgaatctctccggcggccgcaaccctagtttggactacggattcaaaggatccgaaatcgcaatggcgtcgtactgctcggagctccaatttctggcgaatccggtgacgaatcacgtgcagagcgcggagcagcacaaccaggatgtgaattctctaggtttgatttcatcgaggaagacggttgaagctctggatatactgaagctaatgtcgtccacatacctaatcgcgctttgccaggcgatagatctgaggcatctggaggagaatctgaggctcgccgtgaagaacaccgtcagccaggcggcgaagaaaaccctaacgatgggggttaacggcgagctccatccgtccagattctgcgagaaggatctgctccgtgtggttgaccgtgagtacgttttcgcctacatcgacgacccctgcagtgggacctacccgctgatgcagaagctcagggaggttctcgtcgaccacgcgctgaagaacggcgacaaccagaagaatgcggcgacttcgattttccagaaaatcgaggcgttcgaggaggaattgaaggcggtgttgcccaaggaggtcgagagcgcgagatccgccgtcgaaaacggaaatgcggcggtggggaacaggatcaaggagtgcagatcttacccgctgtacaaattcatgagggaggaattggggacggagtttctgaccggagagaagctgacttctcccggagaggagtgcgataaggttttcacggcgttgagcaaggggttgatcgttgatccattgttggaatgccttgagggttggaacggagctcctcttccgatttgctagctgtattattttgaattttgaatttttatttcgggaaatattttaattttatgtattagattatatactgccctttttttggtttgtttttatggtatgtgaatgtaatttttaatttttatttttaaatttattatgtaaggtgaattgtgtaaaagaatctggagacgtgagatttgcagctatatgtatgtaaaagcttttgagttttgagtaatgttcaaatgtcataaacatttgtattagtgaataataatgtattgaattattttaatactggagttagtgaataatgactgggtatttaatta

SEQ ID NO: 5449 - DNA, 2546 bp, Ricinus communis
gggtaatctcacctgaaaattcctttagctaaaactactaacatttttattttttgttcacatagcatttcccaattcattcatctttttcccttaccctttctcatcaatcttccaagctttccaagaaaaacttatccaagtccgtccatatacaatggagttttctcatgatgataataacaacaatcacggttcatcattggaatcattctgtactgctactgctggccatcatgacccactgaactggggcatgctagcagactcgctcaaagggagccatctcgatgaggtcaagcgcatggttgatgagtacaggaggcctgtggtcaggctaggtggtgagaccttgaccatcgcacaagttaccgctattgcgaaccgtgatgccgggatcaaggtagagctatccgaggatgctcgagccggtgtcaaggctagcagtgactgggttatggacagcatgaataaaggaactgatagttatggtgtcaccactggttttggtgcaacttctcatagaagaaccaagcaaggtggcgccctccaaagggagctcataaggttcctgaatgctgggatctttggaaatggcacagagtcttgccacacattgcctcattcagcaactagagcagctatgttggtgagaatcaacaccttgctacaaggttattcaggcataagatttgaaattttggaagctattaccaagtttatcaatcacaacgttactccatctctgcctttaagagggacaattactgcctctggtgacctagtcccattgtcctatattgctgggctcctcatcggccggcccaactccaagtgcgtcgggccgaacggagagtccttggacccaactgaggcctttacactagctgggatcaatagtgggttttttgatttgcaaccaaaagaaggtcttgcattagtgaatggtactgcagttggttctggcttagcttcaatggtactttttgaggctaatgtgttgggaattctatcagaagttctatcagcagtttttgcagaagttatgcaaggaaaaccagagttcactgaccatttgacacataaattaaagcatcaccctggccaaattgaagctgcagctataatggaacatattttggatggtagttcttatatcaaagcagctcaaaaactacatgaggttgatcctttgcaaaagcctaaacaagatcggtacgctcttcgaacatctcctcaatggttaggccctcagattgaagttattagatcggcaacaaaaatgatcgaacgcgaaatcaactctgtgaatgataatccattgattgatgtgtcaagaaacaaggcattacatggtggcaactttcagggtacaccaattggtgtgtccatggataacactcgtttagccattgcagcaattggtaaactcatgtttgcacaattttctgagcttgttaatgacttctacaacaatgggttgccttcaaatcttactggtggccgcaatccaagcttggattatggtttcaaaggagctgaaattgccatggcatcttactgctcagagcttcaattccttgccaatcctgtcactaatcatgttcaaagtgcagagcagcacaaccaagatgtcaactcattaggtctgatttctgctaggaaaacagctgaagctgttgatatattgaagcttatgtcttcgactttcttagttgctttatgtcaagcaattgacctgaggcacttggaggagaatttgaagagtacagtcaagaacacagtcagtcaagttgctaaaagagtcttgacaatgggcttcaatggcgaacttcacccatcaagattctgcgaaaaagacctgctcaaagttgtcgacagagaatacatctttgcatacattgatgatccttgcagtgcaacctatccattgatgcaaaagctaaggcaagtactagttgatcatgctttgttgaacggtgaaaaggagaagaattcaagcacttcaatttttcaaaagattggagcttttgaggaggaacttaaggcccttttgcctaaagaagtagaaaatgcaagaactgaatatgataatggtaatcctgctattcccaacaagataaaggaatgcaggtcatacccattatacaagtttgtgagggaagaactgggtactggtttgctcaccggggaaaagatccgatcgccaggcgaagaatttgacaaggttttctcagcaatgtgtgcagggaagctgattgaccccatgcttgaatgcttgaaggagtggaatggtgctcctctacctatatgttaagatgtttttatgatgctctttttttccattttcttacaagtttacttgccatgtttaatttgtaatttaagaacaaaagtactatcaaactgtatctctcaatgttttttcttttcttttttaattcatcaaagaatgaaattttctttgtaatatgaaacgagtttctgtaccaagtgtataacaagaaatgcaatcaagatcaaccgttctttataacaagtttctc

SEQ ID NO: 5450 - DNA, 2363 bp, Vitis vinifera
ctacacaaccctctagttcctctctctctctctttccttattggttgtcgtgaaaaaaaccagcttattcttctaagacatggaagcaatgaacagccacggaagcaacaaggtcgagagtttctgcgtgagtgatccgctgaactggggagtggctgcggaggagttgaaggggagccatttggatgaagtgaagcgcatggtggcggagtaccggaagccggtggttcggctgggtggtgagactcttacgatatcgcaggtggcggcgatcgccgggcgggaggaggatgtgactgtggagttgtcggaggcggcgagagaaggcgtgaaggcgagcagtgactgggtgatggagagcatgaacaagggtactgacagctatggtgtcaccactggatttggtgcgacttcacataggagaaccaaagaaggtggtgcccttcagaaggagcttattagattcttgaatgctggaatatttgggaacggaacagactcatgccacacgctgcctcactcagcaacaagagctgccatgctagtgaggatcaacaccctcctccaaggctactccggcatcagatttgagatcctggaagccataaccaagctcctcaaccacaacatcactccaagcttgcctctgcgtggcaccatcactgcctctggagatttggttcctctctcctacattgccggtcttctcactggcaggcctaattccaaagctgttggacctaccggtgaagttgtcaatgctgaagaggcctttaaaatggctggaattgagtccggattttttgagctgcagcccaaggaaggcctggctcttgttaatggcactgcagttggctctggtttggcctctatggtgcttttcgaggccaatgttctggcggtgttgtctgaagttttatctgctattttcgctgaagtgatgcaggggaagcctgaattcactgaccacttgactcacaaattgaagcaccatcctggccaaatcgaggctgctgccattatggagcacattctagatggaagctcttatgtgaaagaagctaagaagctacatgagatggatcccctgcagaagccaaagcaagatcgatatgctctaaggacttcccctcaatggcttggcccacagattgaagtgatccgagcatcaactaaatccattgagagggagataaactcagtgaacgataaccccttgattgatgtttccaggaacaaggctctacatggtggcaacttccaggggaccccaattggagtctccatggacaacacccgcttggcaattgcagccattggaaaacttatgtttgctcagttctcagagcttgtcaatgacttctacaacaatgggctgccatcaaatctctctggtggccgaaacccaagtctggattatggtttcaagggagcagaaattgccatggcttcctactgttcagaactccaatttttggccaatcctgtcaccaaccatgtccaaagtgctgagcaacacaaccaagatgtgaactccctgggcttaatctcctccagaaaaacagctgaagcggttgatatcttgaagctcatgtcttccacatacctagttgccctctgccaagccattgatttgaggcatttggaggagaatctgaagatcacagtcaagaacactataagccacatagccaagaaaactctaaccactggagtcaatggagaactccacccatcaagattctgcgagaaggacttgctcaaagtggtggacagggagtatatatttgcctacatcgacgacccctgcagtgaaacatatccactgatgcagaaggtcaggcaagttctggtagaacacgcactgaacaatggcgaaaatgagaagaatgtcagcacctcaatcttccaaaaaatagtggcattcgaggaggagttgaaggcccttttgcccaaagaggtcgagagcacaagagcagggttggagagtggaaacccatttattccgaaccgaatcaaggactgcaggtcatacccactgtacaagttcgtgagagaggagctgggaacagggctgctaacaggtgaaaaggtgaggtcaccaggggaggagttcgacaaggtgtttactgcaatgtgtgaggggaagatcatagaccctcttctggattgtctcagtggctggaacggtgctcctctcccaatctgttaggggatttcactgttgcatatactctttatttcccacttccaactttctttcgtctctgtttgtaaaacctgagattgtccgcgcgcctcgcgctttctattctatgatactaaaattgtttgtaataatgaatgcttctttcttcaaatct

SEQ ID NO: 5451 - DNA, 2237 bp, Vitis vinifera
atggatgcaacgaactgccatggaagcaacaaggtggagagtttctgcgtgagtgatccgctgaactggggaatggctgcggagacgttgaagggaagccatttggatgaagtgaagcgcatggtggcggagtaccggaagccggttgttcggctcggtggtgagacgcttaccatatcgcaggtggcggctatcgccgggcgggagggggatgtgggtgtggagttgtcggagacggcgagagcgggcgtgaacgcgagcagtgagtgggtgatggagagcatgagcaaaggcaccgacagctatggtgtcaccactgggtttggtgccacttcacataggagaaccaaacaaggtggtgcccttcagaaggagctcatcaggttcttgaatgctgggatatttgggaacggaagagagtcatgccacacactgcctcactcagcaacaagagccgccatgctcgtgaggatcaacaccctcctccaaggctactccggcatcagatttgagattctggaagcaatcaccaagctcctcaatcacaacatcactccatgcttgcctctgcgtggcaccgtcactgcctccggagacctggttcctctctcctacatcgctggtcttctcaccggcaggcctaattccaaagctgttggaccttccggtgaagttgtcaatgccgaagaggcctttaaaatggctgggatcgagtcgggattttttgagttgcagcctaaggaaggcctggctcttgttaatggcactgcagttggctctggcttggcctctatggtgctttttgagaccaatgtgctggcagttttgtctgaagttttatcggctatttttgctgaagtgatgcaggggaagcccgaattcactgaccacttgactcacaaattgaagcaccaccctggccaaatcgaggctgcagccattatggagcacattctagatggaagctcttatgtgaaagaagctaagaagctacatgagatggatcctctgcagaagccgaagcaagatcgatatgctctcaggacttcacctcaatggcttggcccacatattgaagtcatccgagcatcaactaaatccatcgaacgggagatcaactctgtgaatgataaccccttgatcgatgtttccaggaacaaggctctacatggtggcaacttccaggggaccccaattggagtctccatggacaacacccgcttggccattgcagccattgggaagcttatgtttgcccagttctcagagcttgttaatgacttctacaacaatggactgccatcaaatctctctggaagccgaaacccgagtctggactatggtttcaagggagcagaaattgccatggcttcctactgttcagagctccagttcttggccaatcctgtcaccaaccatgtcgaaagtgctgagcaacacaaccaagatgtgaactccttgggcttaatctcctcccggaaaacagctgaagcggtggatatcttgaagctcatgtctaccacatacctagtggcactctgccaggccattgatttgaggcatttggaggagaatttgaagagcacggtgaagaagactgtcagccacgtagctaagaaaactctaaccattggagccaatggagaactccacccatcgagattctgcgagaaggacttgctaaaagtggtggatagggaacatgtatttgcctacatcgatgacccctgcagcgccacatatccactgatgcagaaggtaaggcaagttctggtggaacatgcgctgaacaatggcgaaagtgagaagaatggcagcacctcaatcttccaaaaaataggggcattcgaggaggagttgaaggccgttttgcccaaagaggttgagagcgcaagagatggggtggagagtggaaacccatcaattccgaaccgaatcaaggagtgcaggtcatacccattgtacaagtttgtgagggaggagctgggaacagggctgctgactggtgaaaaggtgaggtcaccaggggaggattttgacaaggtgtttactgcaatgtgtgaggggaagatcatcgaccctcttctggattgtctcagtgcttggaacggtgctcctctcccaatctgctaggggatttcacccttgcacatactcttttacttttcacttccaactttctttcatctctgtttgtaaaacttgagattgtctgcacgctttcaattttgtgatac

SEQ ID NO: 5452 - DNA, 2478 bp, Malus domestica
cacgagggtccaccaccacctttttatcttttcaccactttctttaaacaccttcctcgcttctacttccctcggtttttagagtttttgagttttcagtttctcgtaattaacatggaagcgaaaaccatcacgcaaaatggtcaaaacggccaccaccagaacggagtgtcggagtcccagctgtgcattaaaaaggacccattgaactggggtctagtggctgattcactaaaagggagccacttggatgaagtgaagcgtatggtggcggagtacagaaagccggtggtgaagctcggcggagagagtctcaccatttcccaagttgcagccatagccactcatgacaccggggtcaaggttgagctgtctgagtcggctagggctggggtcaaggccagcagtgattgggtcatggatagcatgggtaaggggactgacagctacggtgtcaccaccgggtttggtgcaacctcccaccggagaacaaacaaaggagctgcccttcaaaaggagctaattagattcttgaacgctggagtgtttggaagtgctacagaatcaggccacacactgccacaccaagccacaagagcagccatgttggtccgaatcaacacactcctccaaggctactccggcataagattcgaaatcttggaagccatcaccaagttcctgaacaacaacgttactccatgcttgcccctacgcggtactattaccgcctccggagatcttgtcccgctatcctacattgccggattactcaccggcaggcctaattccaaagctgtcggaccaaatgggcagaccctcaatgcctcagaagcttttgagctagtagggatcaattccgggttttttgagttgcagcctaaagaagggttagctcttgtgaacggcactgctgttggttctggcttggcctccaccgttcttttcgagaccaacattttggcattgcttgcggagattttatcagcgattttcgctgaagtgatgcaggggaaaccggagtttactgatcacttgacgcacaagttgaagcaccaccctggacagattgaggcagctgcaattatggaacatattttggatggcagctcttatgtcaaagctgctaagaagttacatgagcaggatcccctgcagaagccaaagcaggatcgctacgctctccgaacatcacctcagtggctgggacctcaaattgaagtgattcgtttctccaccaaatccattgagagggagatcaactcggttaatgacaaccctttgattgatgtttcgaggaacaaggccttacatggaggcaacttccaggggaccccaattggggtttccatggacaacactcgcttggcgattgcatccattggcaagctcatgtttgcacaattttctgaacttgtcaacgacttttacaacaatggtttgccttcaaatctgtcgggaggcaggaatcctagcttggattacggtttcaagggggctgaaatcgccatggcatcttattgttctgagctgcagtttctcgcaaatccggtaactaaccatgtccagagtgctgagcagcacaaccaagatgttaactctttggggttgatctcttcaaggaaaacagctgaagctgttgatatcttgaagctcatgtcttccacatttttggttgcgctttgtcagtccatagatttgaggcatttggaggagaacttgaggaacactgtgaagaacacggtgagccaagtagcgaagaggactttaacaactggggttaatggagagcttcacccctcaaggttctgtgagaaggatctgcttaaagttgtcgatagggagtatgtttttgcctacattgacgatccctgcagtgccacttacccattgatgcaaaaactaagggaagtgctgattgaacatgctttgacaaatggcgagagtgagaagaatgcaagcacttcgatcttccaaaagattggagctttcgaggaagagctgaaagcgcttttgcctaaagaggttgagagtgcaaggagtgcaattgagagcggaaatgctgcagttccaaacaggattgcggaatgcagatcttatcccttgtacaagtttgtgagggaggagttggggggagagtacctaaccggggagaaggtcaggtcaccgggcgaggagtgtgacaaggtgttccaagccatctgccagggtaagattatcgacccaattctgggttgcctcgagggttggaacggcgcacctctgcctatctgttagcacgtcacggtttacatgctgcattccttcacattcaacttcgtctttgtccataagtttgattgcattgctcgttaattagcctgtgtgactatacctatttttacctaataaaatgtaaaaccatctgtttttgcttttttgtgttctttcttagttattactacttcttggttgattagtgaaaatagtgtttaatta

SEQ ID NO: 5453 - DNA, 2454 bp, Populus trichocarpa
aggaaatcccgtactccagaactcaagatttcctctacagctactcctcttcctccattcttcaagactccttctctctcatttaagcttttctttggtctaacatatatataaataagaaatggagacggtcaccaagaatggctaccaaaatggttctttggagagtttgtgcgtcaaccaacttgatccactcagctggggagttgctgccgaggcaatgaaaggaagccacttagatgaagtcaaacgtatggtggctgattataggaagcctgttgtcaagcttggaggtgagaccttgaccattgctcaggttgcatccattgctggtcatgatactggtgatgtcaaggtggagctttctgagtctgcaaggcctggtgtcaaggctagcagtgactgggtcatggatagcatggacaagggaactgatagttatggcgttactactggttttggtgccacttctcacagaagaaccaaacaaggcggtgctcttcagaaggaacttattagattcttgaatgctgggatctttggcaatggaacggaaacatgccacacactgcctcactcagcaactagagcagcaatgcttgtcagaatcaacactctcctccaaggttactctggcatcagatttgaaatcttggaagctattaccaggctcctcaataacaacatcactccatgcttgccactacgaggcacaatcactgcttcaggtgatttagttccgctatcctacattgctggattactgactggcaggcccaattccaaggccactggtcccaccggagaagtgctagatgctgctgaagcctttaaagcagctggcattgaatctggattctttgagttgcagcctaaagaaggccttgctctagttaatggaactgcagttggttctggcttggcttctatggttcttttcgagacgaacgttcttgctgtcttatcggaactcttgtcagcaatttttgctgaggttatgaatggtaaacctgaattcactgaccatttgacacacaaattgaagcaccatccaggtcaaattgaggctgcagctataatggagcacattttagatggcagcgcttacatgaaggcagctaagaagttgcatgaaacggaccccttgcagaaaccaaagcaggatcgctatgctctaaggacttcaccccaatggcttggtccccagattgaagtaatccgattctcgaccaagtcaattgaaagagagattaattcagtgaacgacaaccctctaattgatgtttcaaggaacaaggctatacatggtggtaacttccagggaactccaattggagtctcaatggataatgtacgtttggctattgcatcaataggcaagctgctatttgctcagttcagtgagctcgtaaatgatttctacaacaatggattgccatcgaatctcactgctagcaggaatccaagtttggattatggcttcaagggagctgaaatagcaatggcctcctactgttctgagcttcagtatctcgccaatccagtcaccacccatgtgcaaagtgccgagcagcacaatcaagatgttaactcgttggggcttatctcttcaagaaagacagcagaagctgttgatatcttgaagctcatgtccacaaccttcttagtggctctttgccaagctatcgacttgaggcacttggaagagaacttgaagagcgcagtcaagaacacagttagtcaagtatccaagagggttttaactacaggtgccaacggagaacttcacccatcaaggttctgtgagaaggagttgctcaaggtggttgatcgtgaatatgtctttgcctatgtggatgacccctgcagtgctacctatccattgatgcagaaactaaggcaagtttttgttgaccatgcgttggaaaatggagagaacgagaagaattttagcacttcagtcttccaaaagattgaagctttcgaggaagaactgaaggctcttttgccaaaagaagttgagagcgcaagagcagcatatgatagtgggaattcagcaattgacaacaagatcaaggaatgtaggtcttatccactgtacaagtttgtgagggaggagttgggaactgtattgctcactggcgaaaaggtccaatcgcccggcgaggagttcgacaaggtgtttacagctatgtgccaggggaagatcattgacccaatgctggagtgccttggggaatggaatggttcccctcttcctatctgttaagtgttttcttttaccaataaatttgttgtattttttttacatttgtttcgacggcttttctgtccttacagtttcttggctatgtaatatacatatataatgtcatggaaaggaaaaatcagttccgaatatttctatttcaatatatcttttgcctcttaagattttgatgtggttttgaaagg

SEQ ID NO: 5454 - DNA, 2343 bp, Citrus sinensis
  misc_feature (2342)..(2343): n is a, c, g, or t
ggtatcttttgtgattgtagtaacatttacgcaaaagatatggacagaggtgctgttattgagaatggtcaccagaacggttgcttggagggtttgtgtaaggacaacaattacagttctggggatgcgttgaactggggagtgatggcggagacgttgaaggggagccatttggaggaagtgaagcgaatggtggcggagtacaggaagccggtggtcaacctcggtggtgagacgttgactgtagcacaagtggctgccattgcgacagctggcgacgtcaacgcccaagtcaaagtggagctctcagaatccgccagggaaggtgtcaaggccagcagtgattgggtgatggacagcatgaataagggcaccgacagttacggcgttaccactggttttggtgccacttctcatcgtagaaccaagaacggcggtgctcttcagaaggagctcattagatttttgaacgctggaatctttggaaacggaacagagtcatctcacacgctacctcactcaacaacaagggcagccatgcttgtgagggttaacactcttctccagggctactctggcatccgatttgaaatcctggaagcgatcacaaagctgctcaatcacaacatcactccatgcctccctcttcgcggcacaatcactgcttcaggggatctggttcctctttcctacattgccggactgctcaccggccggcccaattctaaggccaccgggcctaatggagagatcattgatgcccaggaagcctctaaacaagcgggtttcgggttctttgagttgcagcctaaggagggtcttgctcttgtcaatggcactgctgttggttctggcctggcttctatggttctgtttgaggctaacaaccttgctctgttatcagaaattttgtcagctatttttgctgaagtcatgcaaggcaaacctgagttcactgatcacttgacacacaaattgaagcaccatcctggccaaattgaggctgctgctataatggaacatatcctcgatggcagctcttatgttaacgcggctaagaagttgcatgagattgatcctctgcagaagccgaaacaggatcgttatgccctgagaacttcaccacaatggctcggccctcagatcgaagtgattcggtttgcaaccaagtctattgaacgggagatcaactcggtgaatgacaatcccctgatcgacgtttcaaggaacaaggccttacatggtggcaatttccaggggaccccaattggtgtctcaatggacaatacccgtttggctattgcggcaatagggaagctcatgtttgcccaattttccgaacttgtcaacgatttttacaacaatggattgccgtcaaatctttccggtggcaggaatcctagcctggattatggtttcaagggcgctgaaattgctatggcttcctattgttcggagctccaatttctagccaatcctgttactaaccacgtccaaagtgctgaacagcacaaccaagatgtaaactccttgggactgatctcttccaggaagactgctgaagctgtggatatcctgaagctcatgtcttccacattcttggtagcactttgccaagctattgacttgaggcatttggaggagaatttgaagcatacagtgaaggacactgtgagccaagtagctaggaaagtcttaaccgtcggtgccaatggagagcttcatccgtcaagattctgtgagaaggatctgctcaaagcggctgatcgcgaacacgtctttgcatacattgatgacccctgcagcgctacctatccattgatgcaaaagctaaggcaagtacttgttgagcatgcattgaacaatggagagatcgagaagaatgccaactcctcaatcttccagaagattgcagcctttgaggaggaattgaaagccgttttgcccaaagaagttgagaacgccaggcagactgttgagaatggaaatccaacaattcccaacaggatcaaagaatgcaggtcttacccattgtacaggttagtgagggaggagctcgggactaattttctgactggggaaaaagttacatcgcccggcgagaaatttgacaaagtgtttacagcaatgtgccagggcaagatcattgatccaatgctggaatgtctcagggaatggaatggcgcccctcttccaatatgctagttgttttattcttaagaattcattgaattgccgatgtgactaaatggtacaaattagtccacctgtaatgtttcaattccttgtatttgttgttgaatatcaagaaatccgactgggtatctcattttttttcctcnn

SEQ ID NO: 5455 - DNA, 2522 bp, Prunus persica
  misc_feature (1225)..(1225): n is a, c, g, or t
  misc_feature (1302)..(1302): n is a, c, g, or t
  misc_feature (1342)..(1342): n is a, c, g, or t
  misc_feature (1401)..(1401): n is a, c, g, or t
  misc_feature (1439)..(1439): n is a, c, g, or t
ggggagatggtcaggctctttcgtgctcccaaacactttgctctcatcagtttttgtattttcccatctgggtttttggtaattaacatggcaaccaactccatcaagcaaaatggtcacaaaaacggatcggtagagttacctgagctctgcataaagaaggaccctttgaactggggtgtggcagcagagacactaaaagggagccacttggatgaggtgaagcgcatggtggctgagtacaggaagccggtggtgaagctcggtggagagagcctgaccatttcccaagtggcggccatagccactcatgactctggggtcaaggttgagctctctgagtcagcccgggccggggtcaaggccagcagcgactgggtcatggacagcatgagcaaagggactgacagctatggtgtcaccaccgggtttggtgctacctcccacagaagaacaaagcaaggggctgcccttcagaaggagctcattagattcttgaacgctggagtgtttgggagcacgaaagagtcgggccacactttgcctcaccaggcaacaagagcagccatgttggttaggatcaacacactcctccagggctactctggcataagatttgagatcttggaagtcatcaccaagttcctcaacaacaatgtcactccatgcttgcccctacgcggcacgatcacagcctccggtgaccttgtcccgctgtcctacatcgccgggatgctaactggcaggcctaattccaaggctgttggaccagatggccagaccctcagtgctgcagaggcctttgagtttgttggtatcaattccgggttctttgagttgcagcctaaagaaggcctggctcttgttaatggcactgctgttggttctggcttggcttccacggttcttttcgacactaacattttggcattgctgtcagaaattctatcagcaatttttgctgaagttatgcaggggaagcctgaatttactgaccacttgacgcataagttgaagcaccaccctggccaaattgaagctgcagcaattatggaacatattttggatggtagctcttatgttaaagctgctaagaagttgcacgagcaggaccctctgcagaagccaaaacaggatcgatatgctctccgaacttcacctcaatggctcggtccacagatcgaagtgatccggtactccaccaaatccattgagagggagatcnactcagtcaatgacaaccctttgattgatgtgtcaaggaacaaggccttgcatggtggcaacttccaggggaccccnattggtgtctctatggacaatactcgtttggctattgcanccattgggaagctcatgtttgctcaattttctgagcttgtcaatgacttttacaacaanggattgccatcaaatctgtctggaggcaggaacccaantttggattatggcttcaagggggctgagattgccatggcatcttattgttctgagcttcagtttctcgcgaacccggtcactaaccatgtccagagtgcagagcagcacaaccaagacgtgaactctttggggttgatctcttcaagaaagacagctgaagctgttgatatcttgaagctcatgtcttccacatttttggtggcactttgccaagccattgatttgaggcatttggaggagaacttgaggaacacagttaagaacacagtgagccaagttgctaagagaactttgacaactggggttaatggagagctccacccatcaagattctgtgagaaggatttgcttaaagtggtcgatagggaatatgttttcgcctacatcgacgacccctgcagtgccacttacccattgatgcaaaaactaaggcaagtgctggttgagcatgctttgacaaatggtgagaatgaaaagaatgcaagcacttcaatcttccaaaagattgttgcttttgaggaagagctgaaggtgcttttgcctaaagaggtggatagtgcaagggctgcattggatagtggaagtgctggagttccaaacaggattacggaatgcaggtcttatccgttgtacaaatttgtgagggaggagttgggtgcagagtacctaacaggggaaaaggtcaggtcaccgggcgaagaatgcgacaaggtgttcacagctatctgcgagggaaagattatcgacccgattctggattgcctcgagggctggaacggtgcaccacttccgatctgttagcatttcgttacgctttgagtgctgcattccattccactacttctgtgtccataagtttgattgcattgctggtagactgtgtgactatacctattttacctaataaatgtaaaaccatctacttatgctttttgattctttctaagttctttaccacttctttgttatttagtgagaatagtattcaaatagtcaggaaatgtttttcagaaaatgttgaatgtctctctctctctcatcagttaaataagcatctcccataggaggctatcaattctctt

SEQ ID NO: 5456 - DNA, 2447 bp, Theobroma cacao
cggggaggaaggaaacgaaagggaaacaaataaactctcatttcctatctcaactacaggaaaagacagacattgtaaattaagaagtacttcatcttctttactgggtcattcttcattctcagttttccttgtttaacatggagacgatcgctcaaaatggtcgccagaacggttctttggagagcttttgcacaactgcttccactgctacaaagggtgccgtcgtcgaccctttgaactggggtgctacagctgagtcactcaagggaagtcatttggatgaagtgaaacgcatggttgctgagtataggaagccttcagtgaagcttggtggcgagaccttgacgatttctcaagttgcagccatagctacgcgggacttgggggtcaaagttgagctctccgaggatgcgagggccggcgtcaaggctagtgctgattgggtccttgatggcatgaacaaaggcaccgacagctatggtgttacgaccggttttggtgctacttctcatagaagaaccaagcaaggagctgctcttcaaaaagagctaattaggttcttgaacgctgggatctttggcaatggaaccgagtcatgccacacactccctcactcagcaactagagcagctatgcttgttaggatcaacaccctcctccagggatactctggcatcagatttgaaatcctggaggcgatcaccaagcttctcaaccacaacatcaccccatgcctgccactgcgtggcacaattactgcatctggcgatcttgttcctctttcctacattgctggattgctcactggcaggcctaattccaaggccgttggacccaagggcgaatcgcttgatgcccaggaagcgttctgcgtagccggtattgatactgggttcttcgttttgcagcctaaggaaggccttgctctggtcaatggcactgcagttggttcaggcttggcttccatggttctttttgaagcaaacattttggccgttttgtcagaaattttatcagcaatttttgctgaagtcatgaacggtaaacctgagttcactgaccatttgacgcataaattgaagcaccatccaggacaaattgaggctgcagccataatggaacacatacttgaggggagctcttatgttaaagcagctaagaagttgcacgaaatggatcccctgcaaaaaccaaaacaagatcgctacgctctgaggacttctccacaatggcttggtccacagattgaagtgatcagattcgcaaccaaatcaattgaaagagagattaactccgtcaatgataaccctttgatcgatgtttcaaggaacaaggcattacatggtggcaacttccagggtaccccaattggtgtctcaatggataatgcccgtttggctattgcagccatcggaaaacttatgttcgctcagttctctgaacttgttaatgatttctacaacaatggtctcccatcaaacctctccggtggtaggaacccaagtctagattatggtttcaagggtgctgaaattgcaatggcttcctactgttctgagctccaatacctagctaatccagtcactaaccatgtccagagtgccgagcagcacaaccaagatgtgaactctctgggactaatatcttcgagaaaaactgccgaggctgttgatatattgaagcttatgtcctctacatacttggtggctctttgccaagctattgatttgaggcatttggaagagaatttgaggaacacagtgaagaacaccgtgagccagatagctaagaaaatcctcactaccggtgccaatggtgaacttcacccttcaagattcagtgagaaggatttactcaaagctgttgatagcgaatacgtctttgcctacattgatgacccctgcagtgctacctacccattgatgcaaaagctgaggcaagtacttgttgagcatgcattggcaaatggtgagaatgagaagaatgcaagcacttcaatcttccaaaaggtcgcagcttttgaagaggagttaaaggctatcttgccaaaggaggtcgagagtgcaaggttgtcacttgagaatggaaatgcaggaattcctaacaggatccaggaatgcagatcatatcccttgtacaagttcgtgagggaggagcttggaacagggctgctaactggagaaaatgtcaagtcacctggtgaggagtttgacaaggtgttcacagctatgtgccaggggaagatcattgatccaatgctggaatgccttaaggaatggaacggtgcccctctaccaatctgctagtttgctgtcattttgatctttgaaatttgttatccaatctctttctttgtttttccacctctcttttgtttgaatttccttgtaaaagaagttaatgatatgaacgcgtatgtaatatgtttatttctcatttccatc

SEQ ID NO: 5457 - DNA, 2236 bp, Cynara scolymus
gatccattgaactgggggatagcggcggaatcattgaagggtagtcatctggatgagatcaagcggatggtggcggagtttaggaggccgatagtgagattaggcggagaaacgttgactgtatcgcaggtggcggcgatcgcggcgacggacgacggtggtgtgaaggtggagttgtcggagtcgtcgagggcgggagtgaaggcgagtagtgattgggtgatggagagcatgggtaaagggactgatagctatggtgtcaccaccgggtttggtgccacctctcaccggaggaccaaagaaggtggcgctcttcagaaggaactcatcaggagatttttgaacgccggaatattcggcaacggcacggaatcaagccacactctgccacattcagcgacaagggcagcaatgctagtgaggatcaacaccctcctccagggttactccggcatccggttcgagatcttggaagccatcaccaagttcctcaatcacaacgtcaccccttttctgcctcttcgtggtacaatcaccgcctccggtgacctcgttcccttgtcctacatcgccggccttctcaccggtcgtcccaactccaaagcagttggtcccaccggagaaatccttaatgctgaaaaagccttcgcccaagccggtgtcgaaggtgggttcttcgagttacagcctaaagaaggcctagcacttgtgaacggcaccgccgtgggttccgggatggcatcgatggtgctttttgaagctaatgtgcttgcattgttgtcggaagtcttatcggccatttttgctgaagttatgcaaggaaagcccgagttcaccgaccacttgactcacaaattgaagcatcacccgggtcaaatcgaagctgcagccatcatggaatacattttggatggaagcgattacgtgaaggctgcacaaaaggtccatgaaatggaccctttgcagaaacccaaacaagatcgctacgctctccgcacatcgccccagtggctcggaccacaaatcgaagtcattcgctcagccactaaaatgatcgagagggagatcaactctgtcaacgacaacccattgatcgatgtttcaagaaacaaagccttacatggtggcaacttccaaggaaccccaatcggtgtttccatggataacacccgtttggccatcgcagcgatcgggaaactcatgttcgcccaattctccgagcttgtaaacgatttctacaacaatgggttgccgtcgaatctctccggtgggcgtaatccaagcttggattacgggttcaaaggtggagaaatcgccatggcttcctactgctccgagctccagtttcttgcaaacccggtgaccaaccacgtccaaagtgccgaacaacacaaccaagatgtcaactctttgggtttgatttccgcaagaaaaacagccgaagcagtcgatatcttaaagctcatgtcatccacatacttggtcgctctttgccaatccgtcgatttgcgacatttggaagaaaacatgaaatccaccgtcaagaacaccgtaagccaagtcgccaagaaggtcctaaccatgggtgtcaatggcgaactccacccatcaagattctgcgaaaaagacttacttcgtgtggtcgatagagaatacgtctttgcctacattgatgacccatgcagcgccacttacccattgatgcagagactccgacaagtcctcgtagaccacgctctaaacaacggcgaaaccgagaagaacacaaacacctccatcttccaaaagatcgctactttcgaagacgaattgaaagccattttacccaaagaagtcgaaagtgttcgaaccgcatatgaaaccgattctttatcgattcccaacaggatcaaggcttgtagatcatacccattatacagattcgttagggaggagctcggcggaggtttcttgaccggcgagaaggtgacttcgcctggggaagagttcgataaggtgttcacagccatgtgcaagggtgaactcatcgacccattgttggagtgtgttgaagggtggaatggtgcaccacttccaatatgttaggagtcatgatcgctttacttgctacttcttaatgttttgcttttaattttgttgaatttatgattcaaatttgtacgtgttgtctatgtctcatcaaagacttctgtgttgtgtatgtggttgtaaatcataaatattaacttattttatt

SEQ ID NO: 5458 - DNA, 2578 bp, Medicago truncatula
aggaaatcaatacatcattgttcattatttcccacccaacactacgtaacatttcctctcctcttatcatttcatcatcatagttattactttcaacaccccctcttccttccttttggtaaaatattcgtgcattcgtaattatggagggaattaccaatggccatgttgaagcaaccttttgtttgagcaaaaatggtggtgatccactcaactggggcgcggcggcggagtcattgacagggagtcatttggatgaggtgaagcgtatggtggaggagtatcgtaacccgttggttaaaatcggcggtgagacacttaccattgctcaggtggctggaattgcttcccatgatagtggtgttagggtggagctttcggagtcggcaagggccggtgttaaggcaagtagtgactgggtgatggatagtatgaataaaggtacggacagttatggtgttaccaccggttttggtgctacttctcaccggagaactaaacaaggtggtgccttgcagaaggagctaattaggtttttgaatgccggaatatttggcaatggtacagaatcaaattgtacactaccacatacagcaacaagagctgcaatgcttgtgaggatcaacactcttcttcaagggtattctggtattagatttgaaatcttggaagctatcacaaagctcttgaacaacaatattaccccatgtttaccacttcgcggtacaatcacagcttccggtgatcttgttccactctcttacattgccggtttattaacgggcagacccaactctaaagccgttggaccgtctggagaaattctcaatgccaaggaagcttttcaacttgctggcattggttctgatttctttgaattgcaacctaaggaaggtcttgctcttgttaatggaactgctgttggttctggtttagcttctattgttctgttcgaagcaaatgtactagcggttttgtctgaagttatgtcggcaattttcgctgaagttatgcaagggaaacctgaatttactgatcatttgactcataagttgaagcatcaccctggtcaaattgaagctgctgctattatggagcatattttggatggaagcgcttatgttaaagccgctaagaagttacacgagactgatcctttgcaaaagcctaaacaagatcgttatgcacttagaacttcacctcaatggcttggtcctttgattgaagtgataagattttcgaccaagtctattgaaagagagattaactcggtcaacgacaaccctttgatcgatgtttcaaggaacaaggccatacatggtggtaactttcaaggaacacctatcggagtttcaatggacaacactcgtttagctcttgcttcgatcggtaaactcatgtttgctcaattctctgagcttgttaatgatttttacaacaatggtttgccttcgaatcttactgcaagtagaaacccaagtttggattatggtttcaagggatctgaaattgctatggcttcttattgctccgagttacaatatcttgctaaccctgtcaccacccatgtgcaaagtgctgagcaacacaaccaagacgttaactctttgggtttgatttcttctagaaaaacaaacgaggctattgagatcttaaagctcatgtcttccactttcttgatcgcgctttgccaagcaattgacttgaggcatttggaagagaatttgaggaacactgtcaagaacactgtaagccaagttgctaagagaacactcacaaccggtgtcaatggagaacttcatccttcaagattttgcgagaaagatttgctcaaagttgtcgacagggagtatgtgtttgcctatgctgatgatccttgcctagctacataccctttgatgcaaaagttgagacaagtgcttgtggatcatgcattagtgaataccgaaggagagaagaattcgaacacatcaatcttccaaaagattgcaacatttgaggatgaattgaaggctatcttgccaaaggaagttgaaagtgcaaggacagcatatgaaaatggacaaagtggaatttcaaacaagattaaggaatgtaggtcttatccattgtacaagtttgttagagaggagttgggaacagcgttgctaaccggtgaaaaagtgatatcgccaggagaagagtgcgacaaattgttcacagctatgtgccaaggtaaaattgttgatcctcttatggaatgtctcggagagtggaacggcgctcctcttccaatttgttaatttactcaatctgtttcttggagaaatgatttctttatatatttgtagcagactagtagttgctttgagaagcaatattggttctataagcctatggtaaatgacaaaccaatatccttctgatagcatcgtttattaagtttttccttgatgttcaggaacttttaattgtttttgtaatagaatttcatttgtttgccaaaactttgggtgcaaatatcatatgatacgtgatctttgatgtaaatggtgttttttttccatgaataaatagtgtttactttcaaccatgaaaa

SEQ ID NO: 5459 - DNA, 2468 bp, Vitis vinifera
tctcaatcccacacccctcattgaaattttcctatctctcctcccctccattttcccttacactttccccaccgccaaacacagccactcatcatcaaatggaactttcaaatggaaaccactgccacacaaatgggaaggcctccattgagagcttttgcatgggaggcactggtactaaagctgctgccgatcccctcaactggaacatggcggcggagtccctcaaggggagtcacctggatgaggtgaagcggatggtggaggagtaccggaggcaggtggtgcagctgggcggtgagacgctcacaatatctcaggtggccgcggtggcctcccgcgatactggggtgacggtggagctgtcggaggaggcgagagagggagtaaaggccagcagtgactgggtcatggacagcatgaacaatggtacagacagctacggcgtcaccacaggtttcggtgctacctctcacagaagaaccaaacaaggcggagccctccaaatggagctcatcaggtttttgaatgccggaatttttggaaacgggacggaatcttgccacacactgcctcactctgcaacaagggcatccatgctggtgaggatcaacacacttcttcaaggatactcgggcattagatttgagatattggaggctatcaccaagctcatcaaccacaacattaccccttgcttgcctctccggggcaccatcagcgcatccggtgaccttgttcctctctcctacattgctgggcttttacttgggaggtccagttgcaaggctgtcgggcccaatggggagcccctcagtgctgaggaggccttccgggttgcaggaatcaagggtggattctttgaactgcagcccaaggaggggctcgctctagtcaatggcactgctgttgggtctggcatggcctccatggttctctttgaagcaaacatccttgcagtcctttcggaagttctatctgcactctttgctgaagtcatgcaaggaaaacccgaatttacagaccacttgacccataaattgaagcatcatcccggccaaattgaggctgcagctattatggaacacattctagatggaagctcttacattaaagcagctcagaagttgcatgagatggaccctctccagaagcctaaacaagatcgatacgccctccgaacatctccccagtggcttggcccccagattgaagtgatcagagcagcaacgaagtccattgaaagggagataaactcggtaaacgacaatcccttgatcgatgtttccaggaataaggctctacatgggggcaatttccaagggaccccaattggtgtttccatggacaacactaggcttgccattgcctccatcggaaagctcatgtttgcacaattctccgagcttgttaatgacttctacaacaatgggttgccttcaaatctgtcgggtggccgcaatccaagcttggactatggcttcaaaggtgccgagattgcaatggcctcttactgctccgagctccagttccttgctaatcctgtgaccaaccatgtccagagcgcagagcaacacaaccaagatgtgaactccttgggactcatttcttcaagaaaaactgctgaagccgtggacatattgaagctcatgtcctccactttcttgattgccttatcccaagccattgatctgaggcatttggaggagaatctcaagaacacagtgaagaacacggtgagccaagtggccaagagagtcctaaccattggcttcaatggtgagcttcacccctccaggttctgcgaaaaagacttgctcaaaattgtcgatagagaacacgttttcgcatacattgatgacccctgcagctccacctatccattaatgcagaagctaaggcaagtcctagtcgagcatgctctgatcaatggtgaaagagagaagaactctagcacttccattttccaaaagatcgtagccttcgaggatgagctaaaagcccttctgcccaaagaagtagagagcacaagaatcgactacgagaacggaaattctgccatttccaacagaatcaaggactgcagatcctaccctctgtacaagtttgtgagggaagaactgggagctagtttccttacaggagagaagactacatcacccggtgaagagtgtgacaaggtgttcacagctatgtgtgcagggaagctcattgatccactgctggattgtttgaaggagtggaatggagctcctctcccaatctgctagacacccctttccctacacttaaatattgtttttcatggtttttactttttcccctcaacatttgtaatggggtttactgttcatttctgtacctgaaaactgtggttcatgtttgtgttttcatcttcctttgtaatttgcccaaattcagttttcagtaataaaatcaaaacaaagaattttagatatatgataaaa

SEQ ID NO: 5460 - DNA, 2452 bp, Citrus sinensis
ccacgcgtccggttatagacttcagaatttcctttagctcattcattcttcatcactcccattcattcttcttcttcttcttcttctttctacagttttggtattttttgtaattgcagtaacatttacgtaaaacgatatggagataggtgccactactgagaatggtcaccagaacggtggcctggagggtttgtgcaagaataacaattacaattacagttctggggatgcgttgaactggggagtgatggcggagacgttgaaggggagccatttggaggaagtgaagcgtatggtggcggagtacaggaagccggtggtcaacctcggtggtgagacgttgaccgtagcacaggtggctgccattgccacgtcctctacgaatgtggagctgtcggaatctgccagggaaggcgtcaaggccagcagtgattgggtgatggagagcatgaataagggtaccgacagttacggcgttaccactggctttggtgccacttctcatcggagaaccaagaacggcggtgctcttcagaaggagctcattagatttttgaacgctggaatctttggaaacggaacagagtcatctcacacgctacctcactcagcaacaagggcagccatgcttgtgagggttaacactcttctccagggctactccggcatccgatttgaaatcctggaagcgatcacaaagctgctcaatcacaacatcactccatgcctccctcttcgcggcacaatcactgcttcaggggatctggttcctctttcctacattgccggactgctcaccggccggcccaattctaaggccaccgggcctaatggagagatcattgatgcccaggaagcctctaaacaagcgggtttcgggttctttgagttgcagcctaaggagggtcttgctcttgtcaatggcactgctgttggttctggcctggcttctatggttctgtttgaggctaacaaccttgctctgttatcagaaattttgtcagctatttttgctgaagtcatgcaaggcaaacctgagttcaccgatcacttgacacacaaattgaagcaccatcctggccaaattgaggctgctgctataatggaacatatcctcgatggcagctcttatgttaacgtggctaagaagttgcatgagattgatcctctgcagaagccgaaacaggatcgttatgccctgagaacttcaccacaatggctcggccctcagatcgaagtgattcggtttgcaaccaagtctattgaacgggagatcaactcggtgaatgacaatcccctgatcgacgtttcaaggaacaaggccttacatggtggcaattttcaggggaccccaattggtgtctcaatggacaatacccgtttggctattgcggcaatagggaagctcatgtttgcccaattttctgaacttgtcaacgatttttacaacaatggattgccgtcaaatctgtctggtggcaggaatcctagcctggattatggtttcaagggcgctgaaattgctatggcttcctattgttcggagctccaatttcttgccaatcctgttactaaccacgtccaaagtgctgaacagcacaaccaagatgtaaactccttgggattgatctcttccaggaagactgctgaagcagtcgacatcctgaagctcatgtcttccacattcttggtagcgctttgccaggctattgatttgagacatttggaggaaaatttgaagcatacagtcaagaatactgtcagccaagtagctaagaaagtcttaaccgtcggtgctagtggagagcttcatccatcaagattctgtgagaaggatctgctcaaagcggctgatcgcgaacacgtctttgcatacattgatgacccctgcagtgctacctatccattgatgcaaaagctaaggcaagtacttgttgagcacgcactgaacaatggagagaacgagaagactgccaactcttcaatcttccagaagattgcagcctttgaggaggaattgaaaaccgttttgccgaaagaagttgagaatgccaggcagactgttgagaatggaagtccaacaattcccaacaggatcaaagaatgcaggtcttacccgttgtacaggttagtgagggaggagctcgggtctaattttctaacaggggaaaaagttacatcgcccggcgaggaatttgacaaagtttttacagcaatgtgccagggcaagatcattgatccaatgctggaatgtctcagggaatggaatggcgcccctcttccaatttgttagttgtttttattttgtttaataacacggtcttcaatcccttgtgttcttgtgttcatagaatttgcccatgcgagtcagtggtacaaattcatctgtaatatttcaatcacttctattggttttttcatataaggttataagacttattgtccttta

SEQ ID NO: 5461 - DNA, 2520 bp, Gossypium hirsutum
  misc_feature (972)..(972): n is a, c, g, or t
  misc_feature (2436)..(2436): n is a, c, g, or t
aaggaaaggaacccaaactccctccacctgaattcatcccattccttccctccactctcaactaatatatacaaccaataaaacctcacatttcctttcaacatggacatggtcactcaaaatgctcaacaaagcagctctttggagagtttttgcacgactactactactgctaagggtggtgtcgtcgaccctttgaactggggtgttgcagctgagtctctccagggaagccatttggatgaagtgaaacgtatggtagccgagtacaggaggtcattggtgaagcttggtggtgagaccttgaccatttctcaagttgcagctattgctacacgtgacttgggtgtcaaggttgagctttcagaggatgcgagggctggcgttaaggctagtgctgattgggttcttgatggcatgaacaaaggcactgacagctatggtgtaactactggttttggtgctacttctcatcgaagaaccaagcaaggagctgcccttcaaaaagagctaattaggttcttgaatgctgggatctttggtaatggaattgagtcatgccacacacttcctcactcaacaactcgagcagccatgcttgtcaggatcaacaccctgctccaggggtactctgggatcaggtttgaaattttggaggcaatcaccaagcttctcaaccacaacgtcaccccttgtttgccacttcgtggcacaattactgcttctggtgatcttgtccctctttcctacattgctggattgctcactggcaggcctaattccaaagccgtcggacccaacggggaacctcttgatgcccaggaagcctttcatgttgccggtatcgattccgggttctttgtgttgcagcctaaagaaggccttgcactagtcaatggtactgcagttggttcgggcttggcttccatggttctctttgaagcaaacattttggctgttctatcagaaatnttatctgcaatttttgctgaagtcatgaatggtaagcctgagtttactgaccatttgacacataaactgaagcaccatccaggacaaattgaggccgctgctataatggagcatatacttgaggggagctcttatgttaaagcggctaagaagttgcatgaaatggaccctctgcagaaaccaaaacaagatcgctatgctctgaggacatctccacagtggcttggtccacagatcgaagtgatcagattcgcaaccaaatcaatcgaaagagagattaactctgtcaatgataaccctttgatcgatgtttcaaggaacaaggcattacatggtggcaacttccagggtaccccaattggtgtctcaatggacaatgctcgtttggctattgcagccatcggaaaacttatgttcgctcaattctctgaacttgttaatgatttctacaacaatggtctcccatcaaacctctctggtggtaggaatccaagtttggattacggtttcaagggtgctgaaattgcaatggcttcctattgttctgagctccagtacttggctaatccagtcaccaaccatgttcaaagtgctgagcaacacaaccaagatgtgaattctttgggactaatctcttccagaaaaactgccgaagctgttgatatcttgaagctgatgtcctctacattcttggtggctctttgtcaagctattgatttgaggcatgtagaagagaatttgaggaacacagtgaagaacaccgtgagccagatagctaagaagacgctcactacaggtgccaatggtgaacttcacccttcaagattctgcgaaaaggatttactcaaagccgtggatcgcgaatacgtttttgcctatatcgatgacccttgcagtgctacctatccattaatgcaaaagctgaggcaagttctggttgaacatgcattgacaaacggggagagtgagaagaatacaagcacatcaatcttccaaaagattgcagattttgaagaagaattacaggctgttttgccaaaggaggttgagagtgcaagggtgacacttgagaatggaaatgcagcaattcctaacatgatcaaggattgcaggtcgtatccattgtacaagttcgtaagggaggagcttggaactggactgctaactggagaaaaagttaagtcacctggtgaggagtttgacaaggtgtttacagctatgtgccaagggaagatcattgatccaatgctagaatgtcttaaggaatggaacggtgcccctcttccaatctgctagttttgctttcctttcaatctttggaattttgctatcctacctttttctctgttttccaccgtccgttgcttatatttccttgcaaaacaaggaaatcatatgaatgtctatgaaatatatgtttttttttctcatttatttgtaatacaagtgtgtacaaaatatatngttgttactacctaatctctcaccaaaactcataaataataatattagggaaatgaagaaaagagattgaaagttatttcaaat

SEQ ID NO: 5462 - DNA, 2412 bp, Glycine max
aaactaattaactatctctctctctgtctctacaaaacttagctctgttttttaattattccttgcattctcttgagttcagatggaagcaactaatggccaccaaaatggttcgttttgcttgtccagtactaagggaagtgatccgttaaactggggagcggcggcggaggcgatgaaggggagccacctggacgaggtgaagcgcatggtgtccgagtaccggaagccggtggtccggctcggcggcgagacgctcaccatcgcccaggtggccgccgtggctggacacgaccacggcgtgacggtggagctctcggagtctgcccgagaaggagtgaaggcgagcagtgagtgggtgatgaacagcatgaacaacggaactgacagttacggcgtcaccaccggcttcggtgccacgtcacaccgccgaaccaaacaaggtggtgctctgcagaaagaactcatcaggtttttaaacgcaggaatatttggaaatggaaccgaatcaagccacaccctgccacacactgcaaccagagcagccatgttagtgaggatcaacactcttcttcaagggtactcaggcattagatttgaaatcctagaagccatcaccaagctcctcaacaacaatgttaccccatgtttgccacttcgtggtacaatcacagcttctggagatcttgttccactttcttacattgctggtttgctaactggcagacccaactccaaagctgttggacctaatggagaagtacttaacgctaaggaagcttttgaattggctagcatcaattctgagttctttgaattgcaacccaaggaaggccttgcccttgttaatggcactgctgttggttctggattagcttctatggttctctttgaggctaatatactagctgtgttgtctgaagttctatcagctatttttgcggaagtgatgcaagggaaacctgaatttactgaccatttgacacacaagttaaagcaccatcctggtcaaattgaggctgctgcaattatggagcatattttggatggaagttcctacatgaaagctgctaagaagttgcatgagattgatccattgcaaaagccaaaacaagatcgatatgcccttagaacttcaccacaatggcttggtcctctcattgaagtgattcgtttctcgactaagtcaattgagagagagattaactctgtgaatgacaaccctttgattgatgtctcaaggaacaaggcattacatggtggcaatttccaaggaaccccaattggagtctctatggacaacacgcgtctggctcttgcatctattggcaaactcatgtttgctcaattctctgagcttgtcaatgatttttacaacaatgggttgccttcaaatctcactgctagcagaaatcctagcttggactatgggttcaagggagctgaaattgccatggcttcttactgctctgaactccaatatcttgcaaatccagtaactagccatgtccaaagtgctgagcagcataaccaggatgtgaactctttgggtttaatttcatccagaaagacaaatgaagctatcgagatccttaagctcatgtcttccacattcttgattgcactttgccaagcgattgacttgaggcatttggaggagaatttgaaaaactcggtcaagaacactgtgagccaagtttccaaaaggattcttaccacaggtgtcaatggagaactccatccttcaagattttgtgaaaaggatctgctaaaagtggttgatagggagtacgtattttcctacattgatgacccctgcagtgctacatacccattgatgcaaaaacttaggcaagtgcttgtagatcatgccttggtaaatgcagagaatgagaaggatatgaacacatccatctttcaaaagatagcaaactttgaggaggagttgaagaatttcttgccaaaagaggttgaaagtgcaagggttgcttatgagagtggcaaagctgcaattccgaacaagatccaagaatgcagatcttacccactgtacaagtttgtgagagaggaattagggactgggttgctaactggagagaaggtcaggtcaccaggtgaagagtttgacaaattattcacagcaatgtgccagggcaaaattattgatcctcttctggagtgccttggggagtggaatggagctcctcttccaatctgttgattttactgtcacttttataaatattttctttgtacctatgcaagtgaaaccataatcatttggtttgtcaatcctttaacaaatgttcctttaatgtcaaataggaccttgtaatttaatattttaatggaatttcagtagtttgccggagctttggttctattatatactaagtctcattttttgaccct

SEQ ID NO: 5463 - DNA, 2404 bp, Manihot esculenta
aggaattttgggtcccctaaaatttccttaatctatttcatcattttcttgcactttccttccacctttcccagcaaacaaacagcagcaatggacttctgtcacgacaataatggaactcctgatccattgaactggaacttggctgcggactcattgaagggcagccaccttgatgaggtcaagcgcatggtgaatgactacaggaagcctgttgtgaggctaggtggtgagaccctgaccgtagcccaagttacggcaattgcgaaccgtgactctggtgtcaaggttgagctatctgaggctgctcgagccggggtcaaggctagtagtgactgggttcttgattccatgaacaaaggaactgatacttatggcatcaccactggctttggcgcaacgtcccatagaagaaccaagcagggaggtgcccttcagagagagctcatcaggttcttgaatgctgggatttttggaaatggagcagaatctagccacacattgcctcactctggaacaagagcagcaatgctggtgagaatcaacactctattacaaggttattcaggcataagatttgaaattttggaagctatttccaagttcatcaacaacaacatcaccccatgtttgcctctcagaggcacaatcactgcctctggtgacctaatcccattggcctacattgctgggcttttgactggccggcccaattccaagtcggtcgggcccgacggagaatccctggatgctgctgaagcctttaagctagctgggatcaatggtggattttttgaattgcagcccaaagagggtctggctctagtcaatggaactgcagttggttctgggttagcttctttggtgctttttgaggctaatgttttagcaatcctgtcagaagttttatcagcaatttttgcagaagttatgcaaggaaagccagagtttactgatcatttaacacataaattgaagcatcaccctggacaaattgaagctgcagcaatcatggaacatatcttagatggcagctcttatattaaagaagctcaaaagattcatgaaattgatcctctgcaaaagcctagacaagatcgttatgctctcagaacatctcctcagtggctaggccctcagattgaagtgatcagaacagcaaccaaaatgattgaaagagaaatcaactctgtgaatgataatccattgattgatgtttcaaggaacaaggccttacattgtggaaatttccagggaaccccaattggtgtttcaatggataacactcgtttagctattgcttcaattgggaaactcatgtttgcacaattctctgagcttgttaatgacttttacaataatgggttgccttcaaatcttaccggcggccgaaatccaagcttggattatgggttcaaaggagctgaaattgccatggcatcttactgctcagagcttcaattccttgcaaatcctgtcaccaaccatgttcaaagtgcagagcagcacaaccaggatgtgaactcattaggtttgatttctgcaagaaaaacagctgaagctgtcgacattttgaagctcatgtcttcaacttacttagttgctctctgccaagccattgatctgaggcacttagaggagaacttgaaaaacactgtgaagaacacagtgagtcaagttgccaaaagagttctcacaatgggtatcaatggcgagcttcacccatcaagattctgtgaaaaggatcttctcaaagtcatcgacagagaatacgtttttgcctacagtgatgatccatgcagtgcaacgtacccattaatgcaaaagctaagacaagtacttgtagatcacgcattgatgaatggtgataaggagaagaattctagcacctcaattttccagaaaattgcagcatttgaagaagaactcaaggcgattttgcctaaagaagttgaaagttgcaggattgaatgtgagaatgaaaatccagctattcctaacaggatcaaagaatgcagatcatacccattgtacaagtttgtgagagaagaactgggtaccaatttgctcacaggcgagaaagtccggtcgccgggagaagagtttgataaggttttctcggcaatgtgtgcagggaagatgattgatcctatgcttgaatgcctcaaggagtggaatggtgctcctcttcccatctcctaagaactatttttctttttttttattttttaatttaaaaatatataaaggttgcatatgccatgttaatctgtaatgtcaaattgtactgtgtttatgatgtttatttcttttatacttgaaagaatcttgatttctttgtactttgaatttcagcaagtgtataacaagatatgcaatcaagatttgattaagtattgttttc

SEQ ID NO: 5464 - DNA, 2446 bp, Tropaeolum majus
aaccaaacaaagaaacagaaatggagtctccgctctgcaatggtggcttttgcacgactgatccattgaactggggcttggcggccgagtcgcttaaaggtagccatctggacgaggtgaagcggatgatcgacgagtaccggaaacctgtggtgaagctaggtggtgagagcctgacgatcggtcaggtgacggccattgctaacctttggtcaggtggtgttaaggttgagttgtctgaagaagctagagctggtgtgaaggctagtagtgattgggtgatggatagcatgagcaaaggaactgatagttatggtgttacaactgggtttggggctacctcacataggagaaccaaagaaggtggtgcccttcaaaaggagcttattagatttttaaatgctggaattttcggtaatggaacagaagcttcacatacattaccacacacagcaacaagagcagccatgctggttcgaatcaacacccttctccaaggatattccggcattcggttcgaaatactcgaagccatctccaagttccttaacaacaacatcacaccgtgcttgcctctccgcggcacaatcaccgcgtccggtgacttggtcccactctcctacatcgccggacttttaaccggcaggcctaactccaaggctgtcggaccgaaaggagaaccactcaaccctgcgcaagcgtttgacgtagccggaatcgacggtggattcttcgaattgcaaccgaaggaaggtctcgcgttagtcaacggcaccgcagtggggtccggcttagcttccatggtgcttttcgaagctaacatattggctataatgtccgaagttctgtccgcgattttcgcggaagttatgcagggaaaaccggagtttacggaccatttgacgcataaactgaagcaccatcctggccaaatcgaggcggcggctataatggaacatatactggatggaagttcttacataaaaacggctcaaacgttacacgaaatggaccctcttcaaaagccaaaacaagaccgttacgcgttgcgtacctcgccccaatggctcggtcctcaaatcgaagtgatacgagccgcgacaaaaatgatcgaacgagagatcaactcagtgaacgacaacccgttgatcgacgtgtcgagaaacaaagctctacatggaggaaatttccaagggactcctataggtgtttccatggacaacactcgtcttgctatcgcgtccattgggaaactcatgttcgcgcaattttcggagcttgtcaatgacttttacaacaacgggttgccttcgaatctttcgggtggtcgcaacccaagtttggattacgggttcaaaggcgcggagatcgcgatggcctcgtactgctcggaactccaattcctcgcgaacccggtcacaaaccatgtccaaagcgcggagcaacacaaccaagacgtgaactctttaggtttgatctcgtcgaggaaaacagctgaggcgattgagatattgaagctcatgtccacaacttttttggttggtctatgccaagccattgacttaaggcatttggaggagaatctgaaatatgtggtcaagaacacggttagtcaagtcgctaagagagttttgaccatgggcgtgaacggcgagcttcacccatcaaggttttgtgagaaatacttgctccaagttgtggatagagagtatgttttcgcctacattgatgacccttgtagcgcggtctaccctcttatgcaaaagctaaggcaagttcttgtggagcaagcgttgatcaatgtagagaaagagaagaactcgagcacatctattttccaaaagatttcggctttcgaggaagaacttaaagtcgttttgcctaaagaagttgagagttgtagaatcaaagtcgaaaacgggaattcggatattcctaatcaaatcaagcaatgtaggtcttacccgctatacaagtttgtgagagaagagttggggaccggattactaaccggtgagaaggttcgttcaccgggcgaagagtttgacaaagtattctcagcaatgtgtgaaggtgagttgattgatccattgatggattgtttgaagggatggaatggtgcacctcttcctatatgttaaattgtttttcttagttcattactattgtttttcttcttattattattgttcttgttcataacactttgaaccaaaaatcatgaaacaaagtgtacgttttaagttgtttgttctcattacatatattcttgttcgtctcattgtgttaccacaaatgttatgctaaaagacaagtgtatgtatatactaatttcattttcaagtatggtgttgttttgtttttcgactcatactttttataagcttaaatacggacatgatccacgttaaacttttaaagtcaactttcttcgagaatggacgag

SEQ ID NO: 5465 - DNA, 2492 bp, Populus trichocarpa
cagggatttttggtgacctgaagattcctacatacacatagagcccagctatcttaatcttgcatgctgagcagccctcttgtattcttacaaacacgagaaaaagagatatattttgtgcacacggatccattttctccctccttgaccaccgatcaatccataattcccttctttttcccatagagaatcatcactttcaagaacgggagaaaatggaattctgtcaggactcatgcactggcaatggttccctgggatttaaccccaatgaccccttgaactggggcatggtggcagaatcactaaaaggaagccacctagatgaggtgaagcgcatgatcgatgagtacaggaagcctgtggtcaagctgggaggtgagtccctgaccataggccaagtaacagcgattgctagccgtgacgttggtgtcaaggtagagctgtcagaggaggctcgagttggtgtcaaggctagcagcgactgggttatggacagcatgaacaagggcacggacagttatggtgtcaccactggtttcggcgccacctcacatagaagaaccaagcaaggcggagagcttcagaaggagcttatcaggttcttgaatgctggtatctttggtaatggcacggagtctactcatacattgcctcactcagcatctagggcagctatgttggtcagaattaacacccttcttcaaggttactcgggcataagatttgagatcctagaagccatcaccaagttgctcaaccacaacatcaccccatgtttgccactcagaggaacaatcactgcctccggtgaccttgtcccattatcctacattgctgggctcttgacaggcaggcccaattcaaaggccgtgggacccaatggagaaaccctggccgctgctgaagccttcacactagctgggattaatggtggattttttgagttgcaaccaaaggagggtctagcacttgtaaatggtactgctgttggttctggtcttgcttcgatggtgctttttgaggctaatgtgctggcaatcctatcagaagttttgtcagcaattttcgccgaagttatgcaaggaaaaccagagtttactgatcacttgacacataaattgaagcatcatcctggccaaattgaagctgcagccatcatggaacatattttagatggtagctcttacgttaaagcagctcaaaagttacatgagattgatcctctacagaagcctaaacaagaccgatatgctctccgaacatctccacagtggctaggtcctctgattgaagtgattagaacttcaacgaaaatgatcgaacgagaaatcaactctgtcaatgacaatccattgattgatgtgtcaaggaacaaggctctacatggagggaatttccaggggactcctattggtgtttccatggacaacactcgtttagcaattgcttcaattggcaaactcatgtttgcacaattctctgaacttgttaatgactattacaacaacgggttgccttcaaaccttaccggtggtcgcaatccaagcttggattacgggttcaaaggtgctgaaattgcaatggcatcttactgctcagagctccaatttcttgctaaccctgtcaccaatcatgtccagagtgctgagcaacacaaccaagacgtcaactccttgggcttgatttctgcaagaaaaacagctgaagctgttgaaatattgaagctcatgtctaccacctggttggttgctctatgccaagccatagacttgaggcacatagaggagaacctgaagaacacagtcaagaacactgtcagccaagttgctaagagagtcctgacaatgggcttcaacggcgagcttcacccctcaagattctgcgagaaagacttgctcaaggttgtcgacagagaacatgcctttacctacattgatgacccttgcagtgcaacctacccattaatgcagaaactaagacaagttctagttgatcacgccctgatgaatggtgagaaggaacataattcaagcacttcgattttccaaaagattggagcctttgaggaagaactgaagacccttttgcccaaagaagtagagaatgctagacttgaacttgagaatggcaacccagctattccaaacaggatcacggaatgcaggtcataccccttgtacaagtttgtgagggaagaattgggaaccattttgctcaccggtgagaaggtcggatcgcctggggaggagtttgacaaggtattcacagctatctgtgcagggaagttgattgatcccatgctggaatgcttgaaggaatggaatggcgctcctcttcctctttgctaagctatggatttcctgtgatgatctttttttctttatttcttgccaaggttaattacttgcatgttaatttgtaagtaacaagcacaagtgcaaacctacgttgtttagttacttttaatcattaaagaatctttctttgta

SEQ ID NO: 5466 - DNA, 2415 bp, Camellia sinensis
gttccatcaatctatacacctacctgagtttttggagactgtcacttttttactttttccaaaacacctctcttgataactgtttttaactgtttcaattctcttagatagatccaactgcttcaaataacatggatagtaccaccgccattggaaacggtgtcgggagtggcggttcaccgggtttttgtctgaaagaccctttgaattggggagtggcggcggaggcaatgaaggggagtcatttgaaggaagtgaagggcatggtggaggagtttcggaagccagtggtgaggctgggaggggagactttgacgatatcgcaggtggcggcgatcgcggtgaggggtagtgaggtggcggtggagctgtcggagtctgcgagggagggagtgaaggccagtagtgattgggttatggagagtatgaataaagggacagatagttatggtgttactactggttttggtgctacttcacataggaggaccaaagaaggtggtgctcttcaaaaggagcttattaggttcttgaatgctggaatatttggcaatggaacagagtcatgtcacacattgccacaatcagccacaagggcagctatgcttgtaaggatcaacaccctcctccaaggatactccggcattaggttcgaaattttggaaaccatttccaaattcctcaacaacaacatcactccatgcctgccgttacgcggcactatcaccgcctccggggacctaatccccctatcttacattgccgggcttttgacaggccggcacaattcgaaggcggtcgggcctactggaaaaaccctccaccccaaggaagccttccgcctaactggaaatgagggcgggttttttgagttgcaacccaaggaaggccttgcgcttgtcaacggcacagctgttggttccggcttggcttctatggttcttttcgaggctaacatactcgccgtgttatcagaagttttgtcagcgattttcgctgaagttatgcaaggcaagcccgagttcaccgaccatttgacacacaaattgaagcaccaccctggccaaattgaagctgctgccattatggaacacattttggatggtagctcttatgtcaaggcagcccaaaaactacatgaaatggatccattgcaaaaaccaaaacaggacagatatgcccttagaacatctcctcaatggctaggaccactaattgaagtcatccgatcatcgacaaaatcaattgagagggagataaactcggtgaatgacaaccctttgatcaatgtttcaaggaacaaggccttacatggtggaaatttccaaggtaccccaatcggagtctccatggacaatacacgtctagctgttgcctcaatagggaagctcatgtttgcccaattctctgagcttgttaatgacttctacaacaatgggttaccatcaaatctttccgggggacgaaatccaagtttggattatggtttcaagggagccgagattgccatggctgcttattgctcagaactccaattccttgccaatcctgtaaccaaccatgtccaaagcgccgagcaacataaccaagatgtgaactctttaggcctaatctcttcaagaaagacagccgaggcagttgatatcttgaagctcatgtcctctacatatctagtagcactctgccaagccgtagatttgaggcattttgaggagaatttgaggaacactgtcaagagcacggtgagccaagtagcgaagcgcgttctaactatgggcgttaacggagagcttcacccttcaaggttttgtgaaaaggacttgctcagagtggtagaccgtgaatacatctttgcctacattgatgacccttgcagtgcaacctacccattgatgcaaaaactaaggcaagtacttgttgagcatgcattgaaaaatggtgaaagtgagaagaatttgagcacttcaatcttccaaaagattagggcttttgaggaggaaataaagacccttttgcctaaagaggtagagagtacaagagcagcaattgagaacgggaattcggctattccgaaccggattaaggaatgccggtcttatccactatacaagtttgtgagggaagaattgggaactgaattgttgaccggagagaaggtccggtcaccgggagaggagtttgacaaggtgttcaccgctctgtgcaagggagagatgattgatccattgatggattgtctcaaggagtggaatggtgctcctcttcctatctgttagtgcaattcttatcgcattggaacaatgtttttcagtccttgtcttaagtttttctttcttgatcttcttgttcaattggattgtgtttattgtgatgtaaaaaaaattatcagatgccaataattttaatatgttaaac

SEQ ID NO: 5467 - DNA, 2404 bp, Manihot esculenta
aggaattttgggtctcctcaaacttcctatacctatatttttctcccactttctcaccactcctctacctttccgacaaaataaatcagcaaaatggagttttgtgaggctcacaatgtaactacttcacctggattttcctctgctgacccattgaactggggcatggctgcagagtcactgaagggcagccaccttgatgaggtgaagcgcatggtggatgagtacaggaagcctgtggtgaggctagggggtgagaccctgactatagcccaagtcacagcaattgcgaaccatgactctggtgtcaaggttgagctgtctgaggaggctcgagctggggtcaaggccagtagtgactgggttcttgattccatgaataaaggaaccgatagttatggtgtcaccactggctttggtgcaacctcccatagaagaaccaagcaggggggtgcccttcagagagaactcataagattcttgaatgctggtatctttggaaatggacaagaatcttgccacacattgtctcactctgcaactagagcagcaatgctggtgagaatcaacaccctcctgcaaggttattcaggcataagatttgaaatcatggaagccattaccaagttcatcaacaacaatgttactccgcgtttgcccctcagaggcacaatcacagcctctggtgacctggtcccactgtcctacattgccgggcttttgaccggccggcccaactccaagtcgttagggcccaatggagaatccttggatgcagctgaagcctttaagcttgctgggatcaatggtggattttttgaattgcagcccaaagagggtctagctttagtaaatggtactgcagttggttcaggcttagcttctatggttctttttgaggccaatgtgttggcagtcctgtcagaagttttatcagcaatttttgcagaagttatgcttggaaaaccagagtttacagatcatttgacacataaattgaagcatcatcctggacaaattgaagctgcagcaattatggaacatgtcttggatggaagttcttatattaaagcagctcaaaaggttcatgaaattgatccattgcagaagcctaaacaagacagatatgctcttagaacatctcctcaatggctaggccctcagattgaagtgattcgaacagcgactaaaatgatcgaacgcgaaatcaactctgtgaatgataatccattgattgatgtctccaggaatattgctttacatggaggcaatttccaggggaccccaattggtgtttcaatggataacactcgtttagccattgcttcaattggtaaactcatgtttgctcaattctctgagcttgttaatgatttttacaacaatgggttgccttcaaatctcactggtggacgcaatccaagcttggattatggcttcaaaggagctgaaattgccatggcatcttactgctcagagctccaatttcttgccaatcctgtaactaatcatgtccaaagtgcagagcagcacaaccaagatgttaactcactaggcttgatttcttcaaggaaaacagctgaagctgttgacatattgaagctcatgtcttctacatacttagttgctctatgtcaagccattgacttgagacacttggaggagaacttgaagcaaacagtcaagaacacagtaagtcaagttgcaaagagagtcttgacaatgggcatcaacggcgagctccacccgtcgagattctgcgaaaaagaccttctcaaagtcgtcgacagggaatacgtttatgcatatgttgatgatccttgcagtgcaacatacccattaatgcaaaagctgagacaagtactagttgatcatgccatgatgaatggtgaaaaggagaagaattcaagcacttccattttccaaaaaattggagcctttgaagaagaactcaagacccttttgcctaaagaagtagaaagtgcaagaactgaatatgagaatggtaatccagctatttctaacaagatcaaagaatgtaggtcatatccactatacaagtttgtgagggaagaactcggttgtagtttactgaccggcgagaagattcgatcgcccggcgaagagtttgataaggttttctcagcaatttgtgcagggaagctgattgatcccatgcttgaatgcctcaaggagtggaatggtgctcctcttccaatctgctaagtttttttttttgtttgtttgctcataaagtctacacatgccattgttgatttgtaactttctgtactttttgatttcagtacaaatgtaaaataaatttgataagtgtttatgatgtatcacacgcctagaattgtctaattttatcctcccaatcgaataaacaaatttttatttc

SEQ ID NO: 5468 - DNA, 2307 bp, Glycine max
atggaagcaactaatggccaccaaaacggttcattttgcttgtccactgccaagggaagtagtgatcccttgaactggggagcggcggcggaggcgatgaaggggagtcacctggacgaggtgaagcgcatggtggccgagtaccgcaagccggtggtccggctcggcggagagactctcaccatcgctcaggtggccgccgtggccggacacgaccacggcgtggcggtggagctctcagagtcagcgagagaaggagtaaaggcgagcagtgagtgggtgatgaacagcatgaacaacggcactgacagttacggcgtcaccaccggcttcggtgccacgtcacaccgccgaaccaaacagggtggtgctctgcagaaggaactcatcagattcttaaacgctggaatatttggaaatggaactgaatcaagccataccctgccacacactgcaaccagagcagccatgttagtgagaatcaacactcttcttcaggggtactcaggcattagatttgaaatcttagaagccatcaccaagctcctgaacaacaacgttaccccatgtttgccacttcgtggtacaatcacagcttctggagatcttgttccactttcttacattgctggtttgctaactggcagacccaactccaaagctgttggaccttctggagaagtacttaacgcaaaagaagcttttgaattggctagcatcaactctgagttctttgaattgcaacccaaggaaggtcttgcccttgttaatggcactgctgttggttctggattagcttctatggtactctttgaggctaatatactagctgtgttgtctgaagttctatcagctatttttgctgaagtgatgcaggggaaacctgaattcactgaccatttgacacacaagctaaagcaccatcctggtcaaattgaggctgctgctattatggagcatatcttggatggaagttcctacatgaaagctgctaagaagttgcatgagattgatcccttgcaaaagccaaaacaagatagatatgcccttagaacttcaccacagtggcttggtcctcttattgaagtgattcgtttctcaaccaagtcaattgagagagagatcaactctgtgaatgacaaccctttgattgatgtttcaaggaacaaggcattgcatggtggcaatttccaaggaacccctattggagtctctatggacaacacacgtttggcacttgcatctattggcaaactcatgtttgctcaattctctgagcttgtcaatgacttttacaacaatggattgccttcaaatctcactgctagcagaaatccaagcttggactatggtttcaagggagctgaaattgccatggcttcttactgctctgaactccaatatcttgcaaatccagtaactacccatgtccaaagtgctgagcaacacaaccaggatgtcaactctttgggcttgatctcatctagaaagacaaatgaagccatcgagatccttaagctcatgtcttccacattcttgattgcactttgccaagcaattgacttgaggcatttagaggagaatttgaaaaactcggtcaagaacaccgtgagccaagtttccaaaaggattcttaccacaggtgtcaatggagaactccatccttcaagattttgtgagaaggatctgctaaaagtggttgatagggagtatatattttcctacattgatgacccctgcagtgctacatacccattgatgcaaaaacttaggcaagtgcttgtagatcatgcattggtaaatgcagagagtgagaaggatgtgaactcgtccatctttcaaaagatagcaatctttgaggaagagttgaagaatctcttgccaaaagaggttgaaggtgcaagggctgcttatgagagtggcaaagctgcaattccaaacaagatccaagaatgcagatcttacccactgtacaagtttgtgagagaggaattagggactgggttgctaactggagaaaaggtgaggtcaccgggtgaagagtttgacaaattattcacagcaatgtgccaagggaaaattattgatcctcttatggagtgccttggggagtggaatggagctcctcttccaatctcttaaatttattgtaactcttaacaaatattttatttgtacctatgcaagaaaaaccataatcatttggtttgtctatcatttaacaaatgttccttcaatgtcaaataggaccttgtaatttaatattttaatgaaatttcagttgtttgcagaagctttggttctatt

SEQ ID NO: 5469 - DNA, 2653 bp, Mimulus guttatus
caccacctaaattatatttatattaatagttaattaaataaataaataaaaacacagcacacacactgaaacgggaaatttggtggtgttttgtttcttgtgtgtgtgtgtgtgttttttgcgagacgaattgaaggtggtgatttgggaacagttgatcagtaattttaatataatcaatggcggcggcggcggcgactgagaacgggcaccacaactcgaacgggtactgcgtgaagcagaaggatccgctgaactggggtttggcggcggaggggctgaaggggagccacctcgatgaggtgaagaggatggtggaggaattcaggaagccggtggtgaatctaggcggaaagacgctaacaatagcacaggtggcggcgatcgccgccaccgataatgctgtgacggtggagctggcggaggcggcgagggccggcgtcaaggccagcagcgactgggttatggatagcatgaacaaaggaactgacagctacggtgtcaccaccggattcggtgccacgtcacaccgccggaccaagcagggtggcgctctacagaaggagcttattagattcttgaacgccggaatattcggaaatggaacggaatcttcccacatgctaccgcactccgccacaagagcggctatgctcgtcagaatcaacaccctcctccagggctactccggcataaggttcgagatcctcgaagccataaccaaattcctcaaccacaacatcaccccatgcctccccctccgcggcacgatcaccgcctccggcgacctcgtccccctctcctacatcgccggatttctcaccggccgccccaactccaaagccgtcggccccaaaggcgaacccctcaccgccgacgaagccttcaccctcgccggcgtcgctggcggcttcttcgagctccagcccaaagaaggcctcgcgttagtcaacggcaccgccgtcggttccggcctcgcctcgatcgcgctctacgaggccaacgtcctctctctcctctccgaagtcatgtccgccatcttcgccgaagtaatgaacggcaaacccgagttcaccgaccacctaacgcacaaactgaagcaccaccccggccagatcgaagccgccgccataatggagcacatcctcgacggcagcgcgtacgtcaaagccgccgcgaaactccacgaaaccgacccgttacagaaaccgaaacaagaccgttacgcgctccgaacatctccgcagtggctgggcccgcaaatcgaggtcatccgtacggccaccaaaatgatagagagagaaatcaactccgtcaacgacaacccgctgatcgacgtttctagaaacaaagccatccacggcggaaacttccagggaaccccgatcggagtctccatggacaactcgaggctcgccatcgcctccatcgggaaactaatgttcgcgcaattctccgaactcgtcaacgacttctacaacaacggcctcccgtcgaatctctccggcggccggaaccctagcctcgactacggcttcaaaggctcggaaatcgccatggcttcgtactgctccgagctccaattcctcgcgaacccggtcacgaaccacgtccagagcgccgaacaacacaatcaagacgtgaattctttgggcttaatctcttcccggaaaacagtcgaagcgttggatatattgaagctgatgtcgtcgacgtacctagtcgcactctgccaagcaatcgatctccgccacctggaggagaatctaaggctcaccgtaaagaacaccgtaagccaagttgctaagaaaaccctaacaacggggtccaccggagaactccatccgtcgagattctgcgagaaggacttgatgcgcatagtcgaccgcgaatacgttttcgcgtatatagacgacccatgcagcgggacctacccattgatgcagaagcttcgagaagttctcgtcgagcacgcattgaaaaacggcgaaaacgagaagaatgcaaacacttcgattttccagaagattggagattttgaggaggagctgaaggccatcctgccgaaggaagtggagagtgctagggttgcgttggagagcgggaacgcggcggttgggaataggataacggagtgtaggtcgtacccgttgtacaagttcataagggaggagttggggacgggattattgacgggcgaaaaggtaatttcgcccggggaggagtgtgagaaggtgtttgtggctttgagcaatggtttgattgttgatcctttattggagtgtcttcaaggttggaatggtgagcctcttcctatttgttaggagtgaattttcatttggagactatttaacttttatttttattttttattttaattttaattttaatatgtctttgtggttaaagacttattattttttgtttgttattgttgttatgttcttttgttgatttgaggttggtggttaaatgtgatttgtttgtaaggtgaaataagatgtaaaaatttggtggaatttatttggagtatatgctttttagagtggataaattcgtaaataattgagtgttgggtggcacttggcaggctgcagcatcagtttccgaggaagatttatatttacagtttactggattggattttttaact

SEQ ID NO: 5470 - DNA, 2569 bp, Trifolium pratense
  misc_feature (782)..(782): n is a, c, g, or t
  misc_feature (830)..(830): n is a, c, g, or t
ttcatcattgtacattatttcccacccaacaccacataacaaatacatttcctttcctctcatcaatttcatatattacaattattactttctacacccctctcaactattattaacatataatggagggaattaccaatggccatgctgaagcaactttttgcgtgaccaaaagtgttggtgatccactcaactggggtgcagcggcagagtcgttgacggggagtcatttggatgaggtgaagcgtatggttgaggagtaccgtaacccgctggttaaaattggcggcgcgacgcttaccattgctcaggtggctggaattgcttctcatgatagtggtgtaagggtggagttgtctgagtccgcgagggccggcgttaaggcgagtagtgattgggtgatggacagcatgaacaatgggactgatagttatggtgttaccaccggttttggtgccacctctcaccggagaaccaagcagggcggtgccttgcagaaggagctaattaggtttttgaatgctggaatatttggcaatggtacagaatctaattgtacactaccacacacagcaactagagctgcaatgcttgtgagaatcaatactcttcttcaagggtactctggaattagatttgaaattttggaagctatcactaagctcctaaacaacaacattaccccatgtttaccacttcgcggtacaatcactgcttcgggtgatcttgttccactttcttacattgccggtttgttaaccggaagacccaactccaaagcngttggaccttccggagaaattctcaatgccaaagaagcatttcaactngcgggcattggttctgagtttttcgaattgcaaccaaaagaaggtcttgctcttgttaatggcaccgcggttggttctggtttagcttctattgttctatttgaagcaaatgtactagccgtgttgtcggaagttatgtcagcaatttttgctgaagttatgcaagggaagccagaattcaccgatcatttgactcataagttgaagcatcaccctggtcaaattgaagctgctgctattatggaacatattttggatggaagtgcttatgttaaagcagctaagaagttacacgaaactgatccattacaaaagcctaaacaggatcgttatgcacttagaacttcacctcaatggcttggtcctttgattgaagtgataagattttcaaccaagtcaattgagagagaaattaactcagtcaatgacaatcctttgattgatgtttcaaggaacaaggccattcatggtggtaactttcaaggaacacctattggagtttcaatggataacacacgtttagctcttgcttcaattggtaaactcatgtttgctcaattctctgaacttgttaatgatttttacaacaatgggttgccttcgaatctcactgctagtaggaacccaagtttggactacggtttcaagggagctgaaattgccatggcttcttattgctctgagttacaatatcttgctaatcctgtcaccacccatgtccaaagtgcagagcaacacaaccaagatgttaactctttgggtttgatttcatctagaaaaacaaatgaatctattgaaatcttaaagctcatgtcttccactttcttgattgctctatgtcaagcaattgacttgaggcatttggaggagaatttgagaaacactgtcaagaacactgtaagccaagtagctaagagaacactcaccaccggtgtcaacggagaacttcatccatctagattttgtgagaaagatttgctcaaagttgttgatagggaatatgtatttgcctatgctgatgatccttgtttagctacataccctttgatgcaaaagctgagacaagtgcttgtggatcatgcattggtaaatgttgatggagagaagaattcaaacacatccatcttccaaaagattgcaacttttgaagatgagttgaaagctatcttgccaaaggaagttgaaagtacaagggttgcatatgaaaatggacaatgtggaatttcaaacaagattaaggaatgcaggtcttatccattgtacaagtttgttagagaggagttgggaaccgcgttgctaaccggagaaaaagtgatatcgccgggcgaagagtgtgataaattgttcacagctatgtgccaaggtaaaattgttgatcctcttttggaatgcctgggagagtggaacggtgctcctcttccaatatgttaattagctcaatctgtttctttgagatgagaagtgatttctttatatatttgtagtagactatactatatagtagttgcattgagaagcaattggtttgtctataagcctatgaaaaatgacaaatcaatttcctgctcaaagcatgtttattaagttgtccttaatgtgttaaggaacttttaattgtttttgtaatagaatttcatttgtttgccacaactttgggtgcaaatatcacgtgatccatgtggtgtttgatgtaaatggtgttttttttttatgaataaaataatgtttcagccaaaaaa

SEQ ID NO: 5471 - DNA, 2143 bp, Manihot esculenta
tatctgggtatctcttaaacatggcaacagtctctcagaatggccaccagaatggttctttggacaatctgtgcaccattcgtgacccattgagttggggtgtggcggctgagtcaatgagtggtaaccatttagatgaagtgaaaaaaatggtggctgagtataggaaacctttggttaagttaggtggagagaccttgacagttgcacaggtggcagctattgccagcggcgggggccgtgattcttgtgtgaaggtggagcttgcagagtctgctagagctggtgttaaagcgagcagtgactggattatggatagtatgaatcaaggaactgatagctatggagtcaccacaggatttggtgctacttctcatagaagaaccaaagaaggtggtgctctacagagggaactcatcagattcttgaatgctgggatttttggcaaaggaacagaatcatgtcacacattatctcactctgcaacaagagcagctatgctagtgagaatcaatactctcctccaaggctactcaggcattagatttgaaatcttggaagctatcaccaagtttctcaaccacaatattactccatgcttgccactccgaggcacaatcactgcttctggtgatttagtcccattgtcctacattgccggattactcaccggccggcctaattccaaggctgttggccccaacggagaatccatagatgcccagcaagcatttagcgtgctgccaaaagaaggccttgctttggttaatggcactgcagttggttctggcttggcttctatggttctttttgaggcaaatgttcttgctgttttatcagaagttttatcagcaatttttgcagaagttatgaatggaaaacctgaatttactgatcacttgactcataaattgaagcaccatcccggccaaatagaggctgcagctataatggaacacattttagatgggagttcctatattaaagcagctaagaagttgcatgaaatggatcctttgcagaaaccaaagcatgatcgatatgctttgagaacttcaccacaatggttaggtccacagattgaagttatcagattctcaaccaaagctattgaaagagagattaattcagtgaatgataaccctttgattgatgtttcaaggaacaaggcattgcatggtggaaatttccagggcaccccaattggagtctcaatggataatgcacgtttggctattgcatcaatagggaagctcatgtttgctcagttcagtgagcttgtaaatgatttctacaacaatgggttgccatcaaatctcacagctagtagggatccaagcttggattatggcttcaaaggtgctgaaatagccatggcttcttactgttctgagcttcaatatcttgcaaatccagtcactagccatgtacaaagtgcagagcagcacaaccaagatgtgaactcattggggctaatctctgcaagaaagacagaagaagctattgatatcttgaagctcatgtctacaactttcttagtagcactttgccaagctattgacttgaggaatttagaggagaatttgaagcacacagtgaagaacaccgtaagccaagtagccaaaagggtcttaactacaaatgctaatggagaacttcacccatcaaggttttgcgagaaggacttgctcaaagttgtggatcacgagcaagtgtttgcctatattgatgatccctgcagtgctacgtatccactgatgcaaaaactaaggcaagtgcttgtggatcatgccttagcaaacggtgagaatgagaagaatcctagtagttcaatcttccaaaagatcgaagcttttgaggaagaattgaaagcccttttgcctaaagaagttgaaaatgcaagagaagcatatgaaagtgggaatccagcaattgccaacaagatcaaggaatgtagatcttacccattgtacaagtttgtgagggaggaggtgggcactgggttgctcaccggcgagaaagtccgatcacccggagaggagtttgataaggtgttcactgctatgtgccaaggaaagatcattgatccaatgttggattgtctcaaggaatggaatggtgcccctcttccaatctgttaagc

SEQ ID NO: 5472 - DNA, 2557 bp, Populus trichocarpa
tcaggatttttgggtaacctgaaaattcctacatacatttagagcctcgcaacttcaattttttcttactatacaaccctcatataattttttacgccagaaaattctttgtgctcacacatccgttcttctctctcattttctctttgatcataccaatcgatccatcactctttttttgtctctcccccattttggcatagaggatcatcgctttacagggaaaaatggaattttgtcaagattcacgcaatggcaatggttcactaggatttaacactaatgaccctttgaactggggcatggcggcagagtcactaaaaggaagccacctagatgaggtcaagcgcatgatcgaggagtacaggaagcctgtggtcaagctaggaggtgagaccctgaccataggccaggtaactgcaattgctagccgtgacgttggtgtcatggtggagttgtcagaggaggctcgagctggtgtcaaagccagcagtgactgggtcatggacagcatgagcaagggcacagacagttacggtgttactactggttttggtgcaacctcacatagaagaaccaagcaaggtggagagcttcaaaaggagcttataaggttcttgaatgccggtatctttgggaatggcacggagtctagccatacattgcctcgctcggcaactagggcagctatgttggtcagaatcaataccctgcttcaaggttattcaggcataagatttgagatgctggaagctatcaccaaattgctcaaccacaacatcaccccatgtttgccactcagaggaacaatcactgcctccggtgaccttgtcccattgtcctacattgctgggctcttgacaggcaggcctaattcaaaggcagttggacccaatggagagcccctgagccctgctgaagcctttacacaagctgggattgatggcggcttttttgagttgcagccgaaggagggtctagcactagtgaatggtactgcagtgggttccggtctagcttcaatggtgctttttgagactaatgtgttggcaatcctatcagaagttttgtcagcaatctttgctgaagttatgcaaggaaaacctgagtttactgatcacctcacacataaattgaagcatcatcctggccaaattgaagctgccgccatcatggaacatattttagatggcagcgcctatgttaaagaagctcagaagttacatgagatcgatcctctacagaaacctaaacaagaccgatatgctcttcgaacatctccacaatggctaggccccctgatcgaagtgattagaacatcaacgaaaatgatcgaacgagaaatcaactctgtcaatgacaatcctttgattgacgtgtcgaggaataaggctctacatggagggaatttccaggggacccctattggtgtttcaatggacaacacgcgtttggccattgcctcaattggcaaactcatgtttgcacagttctctgaacttgttaacgacttttacaacaatggattgccttcaaacctcactggtggccgcaatccaagcttggattacgggttcaaaggtgccgaaattgccatggcatcttactgttcggagctccaattccttgccaatcctgtcaccaatcatgtccagagtgccgagcaacacaaccaagatgtcaactccctgggcttgatttcttcaagaaaaacagctgaagctgttgacatattgaagctcatgtctaccactttcttggttggtctatgccaagccgttgacctgaggcacatagaggagaacctgaagagcacagtcaagaacactgtcagccaagttgccaagagagtcttgacaatgggcttcaatggcgagcttcacccttcacgattctgtgaaaaagacttgctcaaggttgttgacagagaacatgtattttcctacattgacgatccttgcagtgcaacctatccattaatgcaaaatctaaggcaagtactagtcgagcatgccttggtgaatggcgaaagggaaaggaattcaaccacttcgattttccaaaagatcggatcttttgaggaagaactgaagacccttttgcctaaagaagtggagagtgctagacttgaagttgagaatggaaatccagctattccaaacaggatcaaggaatgcaggtcataccccctgtacaagtttgtgagggaagaattgggaactagtttgctaacaggtgagaaggtcaaatcgcccggcgaggagttcgacaaggttttcacagctatctgtgcagggaagttgattgatcccttgctggaatgcttgaaggaatgggatggtgctcctcttcctatttgctaagctatggatgtcctgtaatcatctttcttttttcttttttcttactaagcttacttgccatgtcaatttgttcgtaacaagcaaagtgtatgcctctgttgtctatttactttcaaatcattaaagaatctttctttgtacaacaataaatataccatcctaaatgaaaaagataagtattttttgctgtcaaa

SEQ ID NO: 5473 - DNA, 2374 bp, Lotus japonicus
caaattaacatttccacattcaacacaacaatctctccctcacaacttgagcaacccagctccacttttgttttgataggcaatctttcaagtgaaatatatttatcagtttgcattactaagatggcagcaaccaccaacagccaaaacagttcccttttttgcactgctaaaggcggtagtgatccattaaattggggtgtggcggcggagtcaatgaaggggagccaccttgatgaggtcaaacgcatggtggcggagtacaggaagccggtggtccggttgggcggagagacgctgactatagctcaggtggctgccgttgcagcacatgaccagcacaatggtgtgagcgttgaactgtgcgagtcagccagagctggtgtcaaggccagcagtgactgggtgatgaatagcatgaacaatggcactgacagttacggtgtcaccaccggcttcggtgccacttcccatcgcagaaccaaacaaggcaatgctttgcagcaagagctcatcaggtttttgaatgccggaatatttggcaatggtaccgaatcaagccacacattgccacagcctgcaactagagcagcaatgctagtgaggatcaacactcttctccaagggtactcaggcattagatttgaaatcctagaagccattaccaagctcctcaacaacaacatcaccccatgtttaccacttcgtggtactgtcacagcttctggtgatctggtcccactttcatacattgctggactgcttactggccgacaaaactccaaagctgttggaccctctggagaggtacttaatgccaaggaagctttcgaattggctagcatcgattcaggattctttgaattgcagcctaaggaagggcttgcccttgttaatggcactgccgttggttctggcttggcttctattgttctctttgaggctaacatattggctgtgctgtcagaagtcttatcagcaatttttgccgaagtgatgcaagggaaacctgaatttaccgaccatttgacgcataggcttaagcaccaccctggacaaattgaggctgctgcaatcatggagcacattttggatggaagttcctacatcaaagcagcaaagaagttgcacgagatggatcccttgcaaaagccaaaacaagatcgatatgcacttagaacttcacctcagtggcttggtcctctgattgaggtgattcgattctcaaccaagtcgattgagagagagattaactccgtgaatgataaccctctgatcgacgtttccagaaacaaggccttacatggcggtaattttcaaggaaccccaattggagtttccatggacaacacacgactagctcttgcagcaattggcaaactcatgtttgctcagttcactgagcttgtcgatgatcattacaacaatgggttgccttcaaatctcactgctagtagaaatcctagcttggattatggtctcaagggagctgaaattgccatggcttcttattgctccgaactccaatatcttgcgaatccagtcacaacccatgttcaaagtgctgaacagcacaaccaagatgtgaactccttgggtttgatttcttctagaaaaacaaacgaagccattgagatccttaagctcatgtcatccacattcttgattgcactttgccaagcaattgacttgaggcatttggaggagaacttgagatactcagtgaagaacaccgtaagccaggttgccaagaggacacttaccacaagtgtcagcggagaactccatccttcaagattttgtgaaaaagatttgctgaaagtggttgatagggaggttgtatttgcctatattgatgacccctgcagtgctacatacccattgatgcaaaaattaaggcaagtacttgtggatcatgcactagtaaatgcagagaacgagaagaaccagaacacgtcaatctttcaaaagatttcaacttttgaagatgagttaaagagtctcttgccaaaggaggttgaaagtgcaagaaatgcatatgagagtggcaatccagtaattccaaacaagatcaatgaatgcagatcttatccactatacaagtttgtgagagaggagttgggaactgagttgctaactggagaaaaggtcaggtcaccaggtgaggagtgtgacaaactgttcacagctatatgtcagggtaaaattattgatcctctcctggaatgccttggggagtggaacggtgcacctcttccaatatgttaactttaccagttatttttctgtctgatttctttgtatttatgcaagtctaacattgatcatttgttttatcaagccttgagcaaactaatatggaaatcttcatctc

SEQ ID NO: 5474 - DNA, 2714 bp, Petunia hybrida
aatactcataagctttgcaatttcctaactacaccaaccaaatagagaaaaacaatacctgaccactccccttcatttgcacgtacacaatctcatatacatgcatctatagccaaatattcatcaaatattacacatagattgcttttttaacccattgattacttgttcttttagcactagcaatggagtatgccaatgaaaactgtaatggtcatgctagtcaagatatttgtgttaagggccatgatcaacaacttgatcctttgaattggaacatggcagctgatgcacttaagggtagccaccttgatgaagtcaagagaatggtgaaggaatttaggaagccggtggtccggctaggcggtgagacgctaacagtagctcaggtggctgcgatagctagccaatcgggcacggacgtgacagtgcagctgtccgaggcgtcccgggcgggtgtcaaggctagcagtgattgggtccttcaaggcatgataaatgggactgatagttatggtgttactactggatttggtgcaacatcacatagaaggaccaaagaaggtgcagctctacagaaggagctaataaggttcttgaatgctggaatctttggcaacgggactgagtcgagccacaccctgccacactccgccacgagggcggccatgctagtgaggatcaacaccctacttcaaggctactcaggcataaggtttgagatcttggaagctataaccaaattgctcaacaataacatcaccccatgtttgcctcttcgtggcacaattacagcatctggtgacttggtaccattgtcctacattgctgggcttttaacaggcaggcccaactccaaagccactgggcctaatggagaactattggatgctgttaaggccttccaaagggctggtattgatactggattctttgagttgcagcccaaagaaggcttagctttggtgaatggcactgctgttggttctggcttagcttctatggttctttttgatgctaacattcttgctgtactttctgaagttttatcagcaatttttgctgaagttatgcaaggaaaacctgaatttacagactacttaacacataagttgaagcatcaccctggacaaattgaagctgcagctataatggaacatattttggatggaagttcatatgttaaggaagctaaaatagttcatgaaatggaccctttacaaaagcctaagcaagaccgttatgcactacgaacatcgccacaatggttaggtcctcaaattgaggtcattagagcagcaactaagatgattgagagagagattaactctgttaatgacaaccccttgattgatgtctcaagaaacaaggcattgcatggtgggaattttcaggggactccaataggtgtgtcaatggacaacactaggctagcacttgcatccattggaaaacttatgtttgcacaattttctgagcttgtcaatgactattacaacaatggtctgccttcaaatttgaccggtgggaggaatcctagcttggattacggtttcaaaggtgctgagattgccatggcttcttactgttctgaactccaatttcttgccaatccagtgactaaccatgtccaaagtgctgagcaacataaccaagatgtcaactctttgggcttaatttcttcaagaaagacagctgaagcagtggacattttgaaactcatgtcttccacttatctagtggcactttgccaagccattgacttgaggcacttggaagaaaatctcaaagccactgttaagaattcagtgagcctagtggccaagaaagtgttgacaattggcgaaaaaggagagcttcaccattcaaggttctgtgagaaagacatgctcaaagtggttgatagagaatacatttttgcatatgctgatgacgcctgcagtgctacttatccattgatgcaaaagttgagacaagtcttggtggatcgtgcactactgaatgttgatggagagaaggattccagcacttcaattttccaaaaaattaaagcattcgaggaagaattgaaagttgttctgcctaaggaaattgagagagctagaagtgacttggagcaaggcaagccagccattcctaatagaattcaagaatgtaggtcctatccactgtacaagtttgtgagggaagaactaaaggctaattacttgacaggtgagaaagttcaatcacctggagaagaatttgacaaagtattcacagctatgaatgaaggaaagttggtggacccattgcttaactgcttgaaggaatggaatggtgctcctcttccactctgctaaagaaaaagtgggaataataagattaaaaggacatcggttaattttacatcgtaggtacattactttttaagtttctttttttagttttgagaacttcttttaagggtttgtatgaaagattgtgaaccttaaacttattgatgatatttgtatcttgttcttagttacagtgtttaaatttttgtggcttctttcaagaagaaaatgctatacagaaagccacttttcacaaatatctttagagaccacttcagtttggttttggtggccattctttttttcttgatttttgccttttcacttgtggtcattagtttaattgatggccctattgatggccctattgttaaaaagatagatacgtaatatttc

SEQ ID NO: 5475 - DNA, 2433 bp, Lotus japonicus
ccacatttaacacaacaatctcttctctccctcataacttgagcaagctagctccattttttgttacgataatcaatctttcaagtataatatctatcagtttgcaataatattaagatggcaccaaccaccaatggccaccaccagagccaaaatgattccatcttctgcactgctgctaaagccggcagtgatcccttgagttggggtgtagccgcagagtcaatgaaggggagccacctggatgaggtcaagcgcatggtggcggagtaccggaagccggtggtcaagcttggcggagaaactctcacaatagctcaggtggctgccatcgcagcaaacgaccaaggcgtgagcgttgagctttgtgaatcagctagagctggcgtcaaggcaagcagtgactgggtgatgaacagcatgaacaacggcactgacagttacggtgtcaccaccggcttcggcgccacctcccaccgtagaaccaaaaatggcaatgctttgcagctagaactcatcaggtttttgaatgctggaatatttggcaatggtactgaatcaactcacaccctgccacagcctgcaactagagcagccatgctagtgaggatcaacacacttctccagggatactcaggcattagatttgaaatcctagaagctatcaccaagctcatcaacaacaacatcaccccttgtttaccacttcgtggtactgtcacggcttctggtgatctggtccctctttcctacattgctggtttgctaactggccgacaaaattccaaagccgttggaccatccggcgaggtggttaatgccaaggaagctttccaattggctggcattgactctgggttctttgaattgcagcctaaggaagggcttgcccttgtaaatggcactgctgttggttctgggttagcttctattgttctctttgatgctaatgtattggctatactatctgaagttctatcagctatttttgccgaagtgatgcaagggaaacctgaattcactgaccatttgactcataagttgaagcaccaccctggccagattgaggctgctgctatcatggagcacatcttggatggaagttcctacatgaaggcagcaaagaagttgcacgaggtggaccccttgcaaaagccaaaacaagatcgatatgcacttcgtacttctccacaatggcttggtcctctgattgaagtcattcgattctcaacaaagtcgattgagagagagattaactctgtgaacgacaaccctttgattgatgtttcaagaaacaaggccttgcacggtggtaatttccaaggaacccctattggagtttctatggacaacacacgcctggctcttgcagcaattggcaaactcatgtttgctcaattcactgagcttgtggatgatcattacaacaacgggttgccttcaaatctcacagcaagtagaaatcccagcttggattatggtctcaagggagctgaaattgccatggcttcttattgctccgagctccaatatcttgcgaatccagtcacaactcatgtccaaagtgctgagcaacataaccaagatgtgaattccttgggtttgatttcttctagaaaaacgtatgaagccattgaaatccttaagctcatgtcttccacattcttgattgcactttgccaagcaattgacttgaggcatttggaggagaacttgaaacactcggtgaagagcactgtaagtcaagttgccaagaggactctgaccactggtgttaatggggaactccatccttccaggttttgtgaaaaagatttgctgaaggtggtcgatagggaaactctatttgcctacattgatgacccatgccttgctacttacccattgatgcaaaaactgaggcaagtgcttgtggaccatgcattagtaaatggagaaaacgagaaggactcaaagacatcaatctttcaaaagattgcaactttcgaggatgagttgaagagtctcttgcctaaggaggtcgaaagcgcaagggctgcatatgagagtggaaatccagcaattccaaacaagataaatgaatgcagatcttacccactgtacaagtttgtgagggaggagctgggaactgagttgcttactggtgaaaagaccaggtctccgggcgaggagtttgacaaattgttcacagcaatatgccagggtaaaattattgatccacttatggaatgccttggagagtggaacggtgcccctcttccaatttgttaattttaccagtcatttttttatatgatttctttgtatttataaagcgtaacattagtcatttgttttatcaattcttgtaaccactgcgtgtagaccaaaatagctgcacagctttgtaataaatctattactttctctatatgtatcctattttctcacact

SEQ ID NO: 5476 - DNA, 2367 bp, Pisum sativum
aattcttgcaaccaattctcaacaaagaaacattagttactttagtatcaattaaaatggaaacagtagcagcagccataacaaaaaacaacggttacgagtcattttgcgtgacaaatgctaagaataataacatgaaagttaacagtgctgatcctttgaattggggtgttgccgccgaggcaatgaaagggagtcacttggatgaggtgaagcgtatggtggaggagtacaggaagccggtggtccgccttggtggcgagacactgacgatttctcaggtggctgccattgccgcacatgatcatggtgttaaggtggagttgtcagaatctgctagggctggcgttaaggcgagcagtgactgggtgatggagagtatgaacaaaggcacagacagttacggtgttactaccggtttcggcgccacctctcaccggagaaccaaacaaggtggtgctttgcagaaagaactcatcaggtttttgaatgctggaatatttggaaatggaactgagtcaagccatacactaccacacacagcaacaagagctgccatgcttgtgagaatcaacacacttctccaaggttattcaggaattagatttgaaatcttggaagctataaccaaactcattaacaacaacgtcaccccatgtttactccgtggtacaatcacagcttccggagatttagtccctctttcttatattgctggtttactaacgggaagaccaaattcaaaagctcatgggacctctggggaaattcttaatgcaaaagaagcttttcagtcagctgaaatcaatgatggtttctttgaattgcaaccaaaagaaggtcttgcacttgttaatggaactgctgttggttctggtttagcttctattgttctatttgaagctaacatattggctgtcttgtctgaagtcctatccgctatttttgctgaagttatgcaagggaaacctgagtttactgatcatttgacacataaattgaagcaccatcctggtcaaattgaggctgctgctattatggaacacattttggatggaagtgcttatgtcaaagcagctaagaagttgcatgagatggatcctttgcagaaaccaaaacaagatagatatgcacttagaacttcaccgcaatggcttggtcctcttattgaagtcattagattctctactaagtcaattgagagggagatcaactctgttaatgataaccctttgattgatgtttcaagaaacaaggctttgcatggtggaaactttcaaggaacacctattggtgtatccatggataatacacgtttggctcttgcgtcaattggtaaactcttgtttgctcaattctctgaactcgtcaatgatttttacaacaacgggttgccttcgaatctctcagctagtagaaatcccagcttggattatggattcaagggatccgaaattgccatggcttcttattgttctgagttacaatatcttgcaaacccagttacaactcatgttcaaagtgctgagcaacacaaccaagatgtgaactctttgggtttgatatcttctaggaaaacatatgaagccattgagatccttcaactcatgtcttccacattcttgattgcactttgccaagcagttgacttaagacatttggaggagaatttgaaaaactcagttaagaacattgtaagccaagttgctaaaaggacccttacaacaggtgtgaatggagaacttcatccttcaaggttttgtgaaaaggacttgttgagagtggttgatagggagcatgtgtttgcctatattgatgatccttgtagtgctacatatccattgatgcaaaaattgaggcaggtgttagtggatcatgcattagtaaatggtgaatctgagaagaatttgaacacatcaatcttccaaaagattgcaacatttgaggatgagttaaagacccttttgccaaaagaggtagaaagtactagggctgcatatgagagtggaaatccaacagttccaaacaagataaatggatgcagatcttatccactttataggtttgtgagacaagagttgggaactggtttgctaacaggagaaaaggtcatttcaccaggtgaggagtgtgataagttgttcacagctatatgtcaaggaaagatcatcgatcctcttcttcaatgcttgggagactggaacggtgctcctcttccaatttcttaactttaggttattttaagaaaaattatttgtatctatatatgcatgtattgcaataatcactaggtttgtcatgcttttaacaattaatatggaaatctccatttcaatttcttttaatgtcaatgtgaaacttgtaatt

SEQ ID NO: 5477 - DNA, 2433 bp, Glycine max
aaaacctccactcattccataaatctctgtttactctcctcgattttaccgcaacatgacacaagaaggaaatggcaacaccaacttctgtatgagtgttaacaacaacggctacattagcgctaatgacccgttgaactggggcgcggcggcggaggcgatggccgggagccacctcgacgaggtcaagcgcatggtggaggagtaccggaggccggtcgtgaagctcggcggcgagaccctgacgatctcgcaggtggcggcgatcgcggcgcacgaccagggggtgaaggtggagctggcggagtcctccagggccggggttaaggccagcagcgactgggtgatggagagcatggacaagggcactgacagctacggcgtcaccactgggttcggtgctacctcccaccggagaaccaaacaaggcggtgccttgcagaaggagctaattaggtttttgaatgctggaatatttggcaatggtacagagtccaattgcaccctaccccacacagcaaccagagcagctatgctagtgagaatcaacacactcctccaaggctactcaggaattaggtttgaaattttggaggcaatcacaaagcttctgaacaacaacattaccccatgtttgccacttaggggaacaatcacagcatctggtgaccttgttcctttgtcctacattgctggtttgctaactggtagaccaaactccaaggctgttggaccctctggtgaaattctgaatgccaaagaagcctttgaattggccaacattagtgctgagttctttgagttgcaacctaaggaaggccttgcccttgtgaatggcactgctgttggttctggcttggcttcaattgttctttttgaagccaacatcattgctgtcttgtctgaggttatttcagcaatttttgctgaagtgatgcaagggaagccagagttcactgaccatttgactcataaactaaagcaccaccctggacagattgaagctgctgctatcatggaacacattttggaaggaagctcttacatcaaagctgctaagaagttgcatgagattgatcctttgcaaaagcctaaacaagaccgctatgcacttaggacttcaccacaatggcttggtcctcaaattgaagtgattagattctctaccaagtcaattgagagggagataaactcagtcaatgacaaccctttgattgatgtctcaaggaacaaggcccttcatggtggtaacttccaaggaacacctattggagtgtccatggataacacccgtttggctcttgcatcaattggcaagctcatgtttgctcaattctctgagcttgtcaatgactattacaacaatgggttgccctcaaatctcactgccagcagaaaccccagcttggattatggattcaagggagctgaaattgcaatggcctcttattgctctgaactccaatacttggcgaacccggtgacgagccacgtgcaaagcgccgagcaacacaaccaagatgtgaactctctcgggctgatttcatcaaggaagacacatgaggctattgagatcctcaagctcatgtcctccactttcctcattgcactttgccaagccattgacttgaggcatttggaggagaatttgaagaacacggtgaagaacgttgtgagccaagttgctaagcggactctcaccacaggtgtcaatggagagcttcacccttcaaggttttgtgagaaggacttgctcaaggttgttgatagggagtacacatttgcatacattgatgacccctgcagtggcacataccctttgatgcaaaagctgaggcaagtgcttgtggactatgcattggccaatggggagaacgagaagaacacgaacacatcaatcttccaaaagatcgcaacatttgaggaggagttgaagacccttttgcctaaggaagtggaaggtgcaagagttgcatatgagaatgaccaatgtgctattcccaacaagatcaaggaatgcaggtcttaccccttgtacaagtttgtgagagaggagttggggacagcattgcttactggtgaaagggttgtctcaccgggtgaagagtgtgacaaagtttttactgctatgtgccaagggaagatcattgatccacttttggaatgccttggagagtggaatggtgctccacttccaatttgttagttttgttttcttctgttttcttcaagtggtttctttctgtatacgtgtttgtgttgatataagcatttggtttgtctataaaggctgtggcaaatcaatccacatacaacaacttccagttttccttgatatgccaatcaaggaacttgtaattcatattgtaatagaattccatttgtttgccgtagctttgagtgcaaatatcaatacatagccatggcatgtga

SEQ ID NO: 5478 - DNA, 2434 bp, Glycine max
aggaaaataaaaatcaataacaatattattctcctcattccttcatttttaaacctagctccatctccctccactcaccataacatggcatcagaagcaaatgctgccaacaccaacttctgtgtaaatgttagcaacaatggctacattagtgctaatgaccccttgaactggggtgcggctgcggaggctatggctgggagccacctcgacgaggtcaagcgcatgctagaggagtaccggaggcccgtcgtcaagctcggtggagagaccctgaccatctcgcaggtcgcggcgatcgcggcccacgaccagggggtgaaggtggagctggcggagtcctccagggccggtgttaaggccagcagtgactgggtgatggagagcatgaacaagggcactgacagctacggcgtcaccaccgggttcggtgctacctcccaccggagaaccaaacagggcgctgccttgcagaaggagctaattaggtttttgaatgctggaatatttggcaatggtacagagtccaattgcaccctaccccacacagcaaccagagcagctatgctagtgagaatcaacacactcctccaaggctactcaggaatcaggtttgaaattttggaggcaatcacaaagcttctgaacaacaacattaccccatgtttgccacttaggggaacaatcacagcatctggtgatcttgttcctttgtcctacattgctggtttgctaactggtagaccaaactccaaggctgttggaccctctggtgagattctgaatgccaaagaagcctttgaattggccaacatcggtgctgagttctttgagttgcaacctaaggaaggccttgcccttgtgaatggcactgctgttggttctggcttggcctcaattgttctatttgaagccaacatcattgctgtcttgtctgaagttatttcagcaatttttgctgaagttatgcaaggaaagcctgaattcactgaccatttgactcataaactaaagcaccaccctggtcagattgaagctgctgctattatggaacacattttggaaggaagctcttacgtgaaagctgctaagaagttgcatgagattgatcctttacaaaagcctaaacaggaccgttatgctcttaggacttcaccacaatggcttggtcctctaattgaagtgattagattctctaccaagtcaattgagagggagattaactcagtcaatgacaaccctttgattgatgtgtcaaggaacaaggcacttcatggtggtaacttccaaggaactcctattggagtctccatggataatacacgtttggctcttgcttcaattggtaaactcatgtttgctcaattctctgagcttgtcaatgattattacaacaatggtttgccttcaaatctcactgccagcagaaaccccagcttggattatggattcaagggagctgaaattgccatggcatcttattgttctgaacttcaatatttggcgaatccggtgacaagccacgtgcaaagcgcggagcaacacaaccaagatgtgaactctctggggctgatttcatcaaggaagactcatgaggctattgagatcctcaagctcatgtcctccactttcctggtcgccctttgccaagccattgacttgaggcatttggaggagaatttgaagaacacggtcaagaacgttgtgagtcaagttgctaagaggactctcaccacaggtgtcaatggagagcttcacccttcaaggttttgtgagaaggacttgctcaaggttgttgatagggagtacacatttgcatacattgatgacccctgcagtggaacataccctttgatgcaaaagctaaggcaagtgcttgtggactatgcattggccaatggagagaacgagaagaacacaaacacatcaatcttccaaaagattgcaacatttgaggaagagttgaagacccttttgcctaaggaagtggaaggtgcaagagttgcatatgagaatgaccaatgtgcaattccaaacaagatcaaggaatgcaggtcttaccccttgtacaagtttgtgagagaggagttggggacagcattgctaactggtgaaagggttatctcaccgggtgaagagtgtgacaaagtgttcactgctttgtgccaagggaagatcattgatccacttttggaatgccttggggagtggaatggggcacctcttccaatatgttagtttttcttattttctgttttcttgaagagtggtttcttttctgtacacgtgtttgtgttgatattaagcatttggtttgtctatataaggctgtggcaaatcaatccacatacaacaacttcccagttttccttgatgtatgccatgcaaggaacttgtaattcataatgtaatagaattccatttgtttgccgta

SEQ ID NO: 5479 - DNA, 2412 bp, Brassica napus
taatataaaagatctctctagctataatcttctccttttaatttttaattcataatcccgatattgtaatggaggttaacggattatcacacggaggagaagtcgacgctatgttatgcggcggagagatcaagaagaatgccacggtggttggggctgatcctctcaactggggagctgcagcggagcaaatgaaagggagccatttggatgaggtgaagagaatggtgaaggagtttaggaggccagtggtgaatctcggaggcgagactctcacgatcggacaagtggcagcaatctcgacccttggaaacggtgtgaaggtggagttgtcggagacggcgagagccggtgtgaaagcgagtagtgattgggtgatggagagtatgggcaaaggaaccgatagttatggtgttactactggttttggtgctacttctcaccggagaaccaagaacggtgtcgctcttcagaaagagcttataagatttctgaacgccggaatattcggcagcacgaaggaaacatcccacacattaccacactccgccacaagagccgccatgctcgtacgcatcaacactctcctccaaggctactcaggcatacgtttcgagatcctcgaggccataacaagtttcctcaacaacaacatcactccttcactccctctccgcggcaccatcaccgcctccggagacctcgtccccctctcctacatcgccggactcttaaccggacgtcccaactccaaagccaccggtcccaacggcgaagccttgaacgcagaggaagccttcaaaatggcaggagtcacctccggcttcttcgacctccagcctaaagaaagcctcgctctagtcaacggcacggccgttggctccggcatggcgtcgatggttctcttcgaagccaacgtcctctcggtcctggccgaggttttatcagccgtcttcgccgaggtgatgagcgggaagccggagttcaccgatcatttgactcaccggctgaagcaccaccccgggcagatagaagccgcggctataatggaacacattctcgacgggagctcgtacatgaagctagctcagaagcttcacgagatggatccgttacaaaaacccaaacaagaccgttacgctctacgtacctctccccaatggctaggtcctcagatagaagtgatccgttacgcgaccaagtccatcgagcgtgagataaactccgtcaacgacaaccctttgatcgatgtctcgagaaacaaagccattcacggtggtaacttccagggaacacccatcggtgtgtctatggacaacacacgtttagctatcgcggccatagggaagctcatgttcgctcagttctccgagctggtcaacgattattacaacaacggtcttccttcgaacctaaccgcttcgaggaaccctagtttggactacggtttcaaaggagcggagatcgcgatggcttcgtactgttcagagcttcagtacttggccaaccccgtgactagccatgttcaatcagcagagcaacacaaccaagacgtgaactctttaggactaatctcatctcgcaagacatcagaagctgtagacatactcaaactcatgtcgacaacgttccttgtcggaatctgccaagccatcgatctaagacacttggaggagaatctaaaacaaacggtcaagaacacagtctctcaagtcgccaagaaagttctcaccactggagtcaacggtgagcttcacccatcacgcttctgcgagaaagacttactcaaagtcgtcgaccgtgagcaagtctacacgtacgcggacgacccatgcagcgccacgtacccgttgatccagaagctgaggcaagtcatcgttgaccatgctttggtcaacggtgagagcgagaagaatgcaatgacttcgatcttccataagattggagccttcgaggaggagctcaaggcggtgctacctaaagaagtggaggcagctagagcggcgtatgataacggaacagctgcgataccgaacaggatcaaggagtgtaggtcgtatcctttgtataggtttgtgagggaggagcttggaacagagcttttgaccggagagaaagcgacgtcgcccggagaagagtttgataaggttttcacggcgatttgtgaagggaagattattgatccgttgatggagtgtctcgatgagtggaacggagctcccattcctatatgttaagagtgattaaaggttctctgttttttttttttactataaagttttattttttaaatgtctgaataattttaccaaatgattgcctgtgaagtggtttctgtctttgtctagtttataaattctgtaaaactcattgtaagttctcaaatgaacatttttttcttgttacaagtgt

SEQ ID NO: 5480 - DNA, 2464 bp, Tropaeolum majus
cggccggggaggagagaaacaacataagtatttccatttctaccctcgccatctctagaacaaaaacaaaaaaaccaatggaaaacatgatgaagaagacacaaaacgggagtttggagagtttatgtgagaacaaccaaaatggtggtggtgtgatcggttgtgatcctttgaactggggcttggcggcagaagggttgaaggggagccatttggaggaggtgaagagaatggtggcggagtttaggaagccggtggtgaagcttggtggtgagaacttgacgatagcccaggtggctgcggtggcttacggcgatgatcgtggagtgacggtggagctttcggaatcggctagagatggggttaaggctagcagtgagtgggtgatggatagtatgaataaaggaactgatagctatggtgtcacaactgggtttggtgctacttcacataggaggaccaaacaaggtggtgctttgcagaaggaactaataagatttttaaatgctggaatattcggaaatgggaccgaaacgagtcacactttacctcattccgcgacgagagccgcgatgctagtaaggatcaacacactccttcaaggttactcgggaattcggttcgagatcttagaagcgatcaccaaactcctaaacaacaaaatcactccatgtttaccgcttcgtggcacgataaccgcctcgggtgatctcgttcctttatcctacattgccgggttacttaccggtcggcctaactcaaaggcgaccggaccgaacggcgaagccctcgatgctcgagaagcgtttcgagttgccggtataggttccgagttcttcgagttgcaacccaaagaaggtcttgcgttggttaacggaacagcggttggctccggtttagcatccatggttctgttcgaggcgaatgttctttccgtcttgtcggaagttatgtccgcgattttcgcggaagtcatgaacgggaaacccgaattcactgaccatttaacgcataagttgaagcatcacccgggccaaatcgaggcggcggctatcatggaacacattttagacggaagcggttacgtcaaagcggcggaaaagttgcacgaaatggatccgttacaaaaaccgaagcaagatcgttacgcgttgagaacatcgccgcaatggttaggtccgttgatcgaagtgattcgatactcaaccaaatcgatcgagagagagattaactcggtcaacgataacccattaatcgacgtgtcgaggaacaaagcgttgcacggcggtaacttccaaggaacaccgatcggcgtgtcgatggacaacactcgtttagccatcgcgtcgataggtaaactcatgttcgctcaattctcggaactcgttaacgacttttacaacaacgggttgccgtcgaatctatccggaggaaggaaccctagcttggattacggtttcaaaggcgcggaaatcgcgatggcttcgtattgttcggagcttcaatacctcgcgaatcccgtcaccacacacgtccaaagcgcggagcaacacaaccaagacgtgaactctttagggttaatatcgtcgaggaaaaccgcggaggcggtcgacatcttaaagctcatgtcgacgacttatctcgtcgcgctatgccaagccatcgacttgcggcatttggaggagaatttacgaaacacggtgaaaaccgtcgtgagccaagtagcgaagaaagtactaaccgttggcgcgaacggcgaactccatccgtcgcgattctgcgagaaagatttactccaagttatatatcgcgaacatgtctttacctacatcgacgacccttgtttagcgacctacccattgatgcaaaaactaagacaagtcctcgttgaccacgcactgaaaaacgacgagaacgaaaagaacgcgaacacttccatctttcaaaagattggagctttcgaggaggaagtgaaaacccttttgccgaaagaggtggagcgtacacgggttgcgatggaatgcgataatccgatcgtttctaacaggattatcgaatgtcgatcgtatccgctttatcggttcgtgagagaagagctcggtacaagattgttaacgggtgagaaagtgagttcacctggggaagtgtttgataaggttttcaatgcaatttgtgaaggtaaaatcattgatccaatgcttgagtgtcttaaggaatggaatggtgcacctcttcctatttgttaaatgtaattttattgttttttttcaaattttttagtgatgttttgtttttttttaatgtcttctggggaaatgataaatttgaatgtatgttccggatggtttgatgatttgtattttatggaatttgaaacaataagatatgaaaagtttacttatgtgtttaaacaagtttattaatacaacgattatattcgtaggaaaaaaaaaaaaaaaggccg

SEQ ID NO: 5481 - DNA, 2492 bp, Phaseolus coccineus
  misc_feature (36)..(36): n is a, c, g, or t
  misc_feature (121)..(121): n is a, c, g, or t
  misc_feature (1527)..(1527): n is a, c, g, or t
  misc_feature (1615)..(1615): n is a, c, g, or t
gattcaccacattacgcactacttttcctctctccntctcctcattccttcatttaaatctgcttccccactcacctacccaaacgcgccactaactcacatggacgcaacgcccaatggnaaagacgctttctgcgtcactgccgccaatgccgcgggggacccgctcaactgggccgctgcggcggaggcgctctcgggcagtcacctcgacgaggtcaagcgcatggtcgccgagtacgcaagcccgcggtgcgcctcggcggtcagacgctcaccatcgctcaggtagcggccactgcggcgcacgaccagggtctcaaggtggagctggcggagtccgccagggcctgcgtcaaggccagcagtgactgggtgatggagagcatggacaaggggactgacagttacggtgtcaccaccgggttcggtgcaacctcccaccgccgtaccaaacaaggtggcgccttgcagaaggagcttatcaggtttttgaatgctgggatatttggcaatggtacagagtccaactgcaccctaccccacactgcaactagagcagctatgcttgtgagagtgaacactcttctccaaggatactcaggaattagatttgaaattttggaggccatcaccaagcttttgaacaacaacattactccatgtttgccactaaggggtacaattacagcatctggtgatcttgtacctttgtcatacattgccggtttgctaactggtaggccaaactccaaggctgttggcccctctggagagattctgaatgctaaggaagcctttgaattggccaacattggttctgagttctttgagttgcaacctaaggaaggtcttgcccttgtgaatggaacggctgttggctctggcttggcctctattgttctctttgaagcaaacatccttgccgtcttgtctgaagttatttcagcaatttttgctgaagtgatgcaaggaaagcccgagttcactgatcatttgactcataagctaaagcaccatcctggccagattgaggctgctgctattatggagcacattttggatggaagctcttacatcaaagctgctaagaagttgcatgagattgatcctttgcagaaacccaaacaagatcgctatgcccttagaacttcaccccaatggcttggtcctcaaattgaagtgatcaggttttctaccaagtcaattgagagggagatcaactcagtcaatgacaaccctttgattgatgtgtctaggaaccaggccttgcatggtggtaacttccaaggaactccaattggagtctccatggataacacccgtttggctattgcttcaattggaaaactcatgtttgctcaattctctgagcttgtcaatgactattacaataatgggttgccttctaatctcactgccagcagaaaccccagcttggattatggtttcaagggagctgagattgccatggcatcttactgctctgaactccaatatttggctaaccccgtaaccagccatgtncaaagcgccgagcaacacaaccaagatgtgaactctttgggattgatttcatctaggaaaaccaatgaggctattgagatcctcaagntaatgtcttcaactttcctcgttgcactttgccaggccattgacttgaggcatttggaggagaatttgaagaacactgtgaagaatgttgtgagccaggttgccaagaggactctcaccacaggtgtcaatggagaactccacccttcaagattttgtgagaaagacttgttgaaagttgttgaaagagagtacacatttgcctacattgacgacccttgcagtggcacataccccttgatgcaaaaactaaggcaagtgcttgtggactatgcattggccaatggagagaacgagaaaaacttgaacacgtcaatcttccaaaagattgcatcatttgaggaggagttgaagaccctcttgcctaaggaagtggaaggtgcaagacttgcatatgagaacgaccaatgtgcaattcccaacaagatcaaggattgtagatcttaccccttgtacaagtttgtgagagaggagttagggacatcgttgctgactggtgaaaaggtgatctcaccgggtgaagagtgtgacaaagtgttcagtgctatgtgccaaggaaaaatcattgatcctctcttggaatgccttggagagtggaatggtgctcctcttccaatttgttagttcgtcattttatgtttattggagagtggtttctttctatatacgtatttgtgttgataagaatttggtttgtctgtaagcctgtggcaaatcaatccacatacaacttttcaggcttccttgatgtcaaggaacgtgtaattcatattgtaatagaattccatttgtttgccatagctttgagtgcaactgttaatacatgccttccatgtgaaggatgttttctcatggcgatctagaaccggacgcgtggg

SEQ ID NO: 5482 - DNA, 2523 bp, Castanea mollissima
caaagcttgaaaatttccgcaacactattctttttttgtttttgtctcattgtttttcatctctagccattttcatgcactgttgatcggtttttatcatctgggtcattgagaaaatttgacattcattcgattctcttaaaagagttttttagagtgtttgtgttcattttctttctaaaaaacaatggagtattgcaatggaaatggttcatcggttgactcttgcaagagcagtgacccattgaactgggggttagctgctgaggggctcaaagggagccaccttgatgaggtgaagcgcatggttgatgagtttcgtaaaccactggttaggctagggggtaagagcttgaccgtagctcaagtggctgcaattgctagccatgatggtgggatcaaggtggagctagctgaggaagctcgggctggggttaaggccagcagtgattgggtcatggacagcatggacaaaggcaaggacagttatggtgtcaccactggttttggtgcaacctcacataggaggaccaagcaaggtggagcccttcaaagagagcttattagattcttgaatgctggaatctttggcaatggcactgaatcatgccacacattaccccacacagcaactcgcgccgctatgttggtgaggatcaacaccctcctccaaggttactcaggcatcagatttgaaatcatggaagccatcaccaagtttctcaaccacaacattactccatgcttgccactccgtggtaccatttcttcatcgggcgacctggttcctctatcttacattgctgggcttttaataggcagacccaattccaaggctgttgggcctaatggagagtccctagacgctaccaaggcatttgaattagcagggattgatggtgggttttttgaattacaacccaaagagggtctagcactagtgaatggcactgcagttgggtctggcctagcttccatggttctttttgaggccaacgtacaagctgtttttgctgaagttttatcagcaatttttgccgaagtgatgcaaggaaagcccgaatttacagaccacttgacacataaattgaagcaccatcctggccaaattgaggcagccgctataatggaacacattttagatggaagtgcttatgttaaagcagcccaaaagttgcatgagattgatcctctgcagaagcctaaacaagatcgttatgctcttagaacctctccacaatggcttggcccacaaattgaggttatcaggacagcaaccaagatgattgagagggagattaactcagtcaatgataacccattgattgatgttgcaaggaacaaggctctacatggtggtaacttccaagggaccccaattggtgtttctatggataacacacgtctagccattgcttcagttggcaaactaatgtttgctcaattttcagagcttgtcaatgacttttacaacaatgggttgccttcaaatctcacagcaagccgcaatccaagtttggattatggtttcaaaggttcagaaattgcaatggcatcttactgctcagaactccaatacttggcaaatcctgtcaccaaccatgtccaaagtgctgagcaacataaccaagatgtaaactctttggggttgatttcctcaagaaagacagctgaggctgtggacatattgaagctcatgtcaaccaatttcttagttgcattatgccaagctgttgatttaaggcatatggaggagaacttgaagaacactgtcaagaacacagtcagtcaagtggctaaaagagtcctaaccatgggctcaaatggtgagcttcacccatccaggttctgtgaaaaagacttgctcaaggtcgttgacagagagtacgtttttacgtacattgatgacccctgcagtgcaacctatccattaatgcaaaagctaaggcaagtcctggttgagcatgctttgaacaatggtgacaaagagagcaacttgagcacttcaattttccaaaagattggagcttttgaggaggagcttaagacccttttgcccaaagaagtagagggtgcaagaatagaaattgagaatgggaaagcagcaattcctaacccaattaaggagtgcaggtcgtacccactatacaggtttgtgagagaagaactgggaacaagtttactaactggtgagagaattcgatcacctggtgaagaattcgataaggtattctcagcaatgtgcgcagggaagttgattgatcctttgctggattgtctgaaggagtggaatggtgctcctcttcctataaattaagatgctttaaagttgttacattaaaattgttattgtttcgatcggttttttttttttaatagcttactgtcaatgtatctgtgatatgtgatatcaaactgtctatgctagccgtttgttttttggttattatataataaaatatttgtgtgaacctttgagttcagtaaagtgtacaacaatggagagctgtaagccctccaaaa

SEQ ID NO: 5483 - DNA, 2130 bp, Triphysaria pusilla
gacgcgccgccacagaagggggcggcggacccgctgaactgggcggcggcggcggcggcgctttctggcagccacctcgaggaggtgaagcggatggtgggggagttccggaggccggtggtgaagctaggcggggagacgctgacgatatcgcaggtggcggcgatcgcggaagggacaatgcggtggcggtggagctggcggagtcggcgagggccggcgtgaaggccagcagtgactgggtgatggagagcatgaataaagggacggacagttatggggtcacgacggggtttggtgccacgtcacaccggaggactaagcaaggcggcgcgcttcagaaggagcttattaggttcttaaacgccggaatattcggaatcggtacggaatctaaccacacactgccgcacacggccacccgagccgccatgctcgtccgcatcaacaccctcctccaaggctactccggcatccgcttcgaaatcctagaggccatcaccaaattcctcaaccaaaacataaccccaatcctccctctccgcggcacaatcaccgcctccggtgacctcgtccccttatcctacattgccgggctcctcacgggccggcccaactccaaagccgttggcccaaccggtgaacccctcaatgccgagcaagccttcaagctcgccggcatcaccaacttcttcgagctccaacccaaagaaggcctcgccttagtcaacggaacagctgtcggctcgggattggctgccatcgccctttacgatgcaaacatcctcgccgtcctatccgtcgtcatgtcggcaattttcgccgaggttatgaatggaaagcccgaattcaccgaccacctaacacataggctaaagcaccacccaggtcaaatcgaggccgctgctataatggaacacattctagacggaagctcatacgtgaaagccgcccaaaagttacacgaaactgaccctctacaaaagcccaaacaagaccgttacgccctccgaacctcgccccaatggctcggacctcaaatcgaagtcatccgcaccgccaccaaaatgattgaacgagaaatcaattcggtcaacgacaatccattaatcgatgtttctcggaacaaagccatccacggcggtaatttccaaggcaccccgatcggagtgtcaatggacaacacaaggctcgcaatagcatcaatcggtaaattaatgttcgcccaattttccgagctcgtaaatgacttttacaacaacgggttgccttcgaatctctccggcggccggaaccctagcctcgactatggcttcaaggggtccgagatcgcaatggcctcatattgttcggagcttcaattcctcgcaaatccggtgaccaatcacgtgcagagcgccgagcaacataaccaagacgttaactcgctcggtttaatctcatcgagaaaaaccgtcgaggctatcgacattctcaaactaatgtcgtcgacttacttaattgccctatgccaggctgtagacttgcgacacgtggaggagaatatgaggcttgcggttaagaatgctgtttgccaggtggcaaaaaagacgttgacgatgggagtgaacggggagcttcacccggcgagattttgcgagaaggacttgttgcgagttgttgatcgtgagtatgtttttgcctacattgacgacccgtgtagcgggacctacccactgatgcaaaagttgaggcaagttttggtggagcacgctttgaagaacaaggaaggggagaaaaatgagggctcgtcgatttttcagaagatcgaggctttcgaggaggagttgaaggcggtgttgccgaaggaggtggagagtgcgagggcggcattggaggccgggaaagcggcaatcgggaataggattgtggaatgtcgatcttaccccttgtataagtttgttagggaggagttggggacggattatttgacgggcgagaaggctgtgtcgccgggtgaagagtgtgagaaggtgttcgaggcgttgtgtaagggttcgattgtcgacccgttgttgaagtgtcttgaggcttggaatggtgagcctctgcctatctgttgattgagagtccttgtgaaggttccaagtg

SEQ ID NO: 5484 - DNA, 2515 bp, Coffea canephora
ccaccaccaccaccaccaccatcaccaccactgtttaagcattacaatcttttgggctaattattattattatttttttaattactagcatttactagtattttcttgtgagcccggatttgttgatcgttccagtaagctagctagccagccagccagcaagcaagcaaaaatggagtgcgctaatggaaatggtaatgaccttgcggagaccttttgtactcaacgggccgggccagcacccgacccgttaaattggaacgcagccgcggagtctttaaaaggaagtcatcttgatgaagtcaagcgcatggtcgatgagttcaggaggcccctggtccggctaggtggtgagacgctgacgatagctcaggtggcggccgtagctgcttcctccgacgcagccgttaaggtggagctgtcggagggtgccagggccggcgtcaaggccagcagtgactgggttatggagagcatgagaaagggtactgatagttacggtatcaccaccggctttggtgcaacgtcacacaggagaaccaaacaaggcggagctctccaggaggagctcatccgattcttgaatgctggaatttttggcaacgggaccgaaacatgtcacacattgcctcactcggcaacaagggcttctatgcttgttcgaatcaacaccctccttcaggggtactctggcatcagatttgagattctggaagctattacaaagcttctcaacaataatatcaccccatgtttgcccctccgcggaacgatcaccgcctccggtgatttggttccactctcctacattgttggattattaacaggtcgaccaaattccaaggctgttggacctgacggaaaatttgtcaatgctactgaagcattcagcctggcggggattgacactggatttttcgagctgcaggcaaaagaaggccttgcacttgtgaatggcactgctgttggctctgccttggcttccatggttctctttgaggctaatattcttgctgttcttgctgaagttctttcaggaatttttgctgaagttatgcacgggaagccagagtttacagaccatttgactcataaactgaagcaccatcctggtcaaattgaggccgcagctattatggaacacattttggatggaagttcatttgttaaagaagctcagagggttcatgaattcgaccctttgcaaaagcccaaacaagatcgttatgcactccgaacatccccacaatggctaggtccattgattgaagtcatcagggcttcgacaaaatccatcgaaagagagatcaattctgtgaatgacaatcctttgatcgacgtttcccggaataaggccttacatggtgggaactttcaaggtacaccaattggagtctcgatggataacacccgtctagcaattgcatcaattggtaaactcatgttcgcacaattttctgagctggttaatgacttttacaacaatggattgccttcaaacctatctgggggacgtaatccaagtttggactatggtttcaaaggtgctgaaattgccatggcagcttactgctctgaacttcagttcctagccaatcctgtcacaaaccatgtgcaaagtgcagagcaacacaaccaagatgtcaactcattaggattgatctcatcaagaaaaacagcagaagctgtggacatattgaagctcatgtcatcgacctatttggttgcattgtgccaggcaattgacctgaggcacctggaggagaacttgaaggcctcagtgaaaaacacggttagccttgtagccaagaaagtgctaacaatgggctacaatggcgaattgcacccatctagattctgcgaaaaagacttgctcaaagtggtggacagagagcatgtttttgcttacattgatgacccctgtagtggaacctaccccctgatgcaaaagctaaggcaagtcctagtggagcactccttagcaaatggggacaaggagaaggacgcaaccacttcaattttccaaaagatcggtgcctttgaggatgaactaaaggcccttttgcccaaagaagtggagagtgctagatgtgagttggagaatggaaagccaggcattgccaaccgtatcaaggattgcaggtcctactcattatacaagtttgtgaggggagagttggggaccaatttcctgactggtgagaaggtgagatcacctggagaagaatttgacaaggtattcactgccatatgtgaagggaagttgattgatccattgctggattgtttgaaagagtggaatggtgctccccgtccaatttgctaagatgttttcttcatactgtggtacatttattaaatttcttgaaatttgtttttttttcctagtttgccctctttttggaatgttgtatccaagttgtcactagcttgtttaagatccttgtattttcgtcctatactgatattgttcgttgccataaatgttgaacttcaacaagtgtaattatggata

SEQ ID NO: 5485 - DNA, 2345 bp, Tropaeolum majus
aaaaaacccaccattaccctccacctcaaaaaacttaaaaccttcattatagtaaaaagggtatttttggaaagtatggaaaaaatgatgaatggtcgtcaaaatgggtgtttagagaatttttgtgagaagaaaagtgttggtgttgatcctttgaattgggggttggccgcagaagggctgaaagggagtcatttggaggaggtgatgaaaatggtgggtgagtataggaaaggtgtggtgaaccttggaggtgaaaacttgaccattgcgcaagtggcatcggtggcttatagtgaggttggtgtgggtgttaaggtggagttgtccgagtccgctagagctggtgttaaggctagcagtgattgggttatggatagcatgaataaagggactgatagttatggtgtaaccactggcttcggtgctacttcacataggagaaccaagcaaggtggtgccttgcagaaagaactcattagattcttgaatgcggggatatttggaagtgcaacggaaacaagccacacattgcctcattctgcgacaagagcagccatgcttgtccgaataaatacgctcctccaaggctactccggaattagattcaacatcttagaagcaatcacgaagtttctcaacagcaatatcacaccatgtttgccccttcgtggcacaatcactgcctcgggtgatcttgttcctttgtcctacattgcagggttacttactgggagaccgaattccaaggccactgggcccgatggaaaaactctcgatgcacaggaggcttttcgtttggctggtattgactctgggttctttgagttacagcctaaggaaggtctcgctcttgttaatggcaccgctgttggttctggtttggcctctatggtacttttcgatgccaacattctttcagttttagctgaagttttgtctgcgattttcgctgaagtaatgaatggtaaaccagagtttactgatcacttgacgcataagttgaagcaccatccaggccaaattgaggccgcagctattatggagcacattctagatggaagtgattatgttaaggcagctaagaaattgcacgaaaatgatcctcttcagaaaccaaaacaagatcgttatgccttaagaacttccccacaatggcttggtccactgattgaagtgattcgatactcaaccaaatcaattgagagagagataaactcagttaacgacaaccctctgatcgatgtttccaggaacaaagctttacatggaggaaatttccaaggaacgccaattggtgtctccatggacaacactcgtttggctattgcttcgattggaaaactcatgtttgcccaattctctgagcttgttaatgatttttacaacaacgggttgccatcaaatctgtctggtggaaggaatccaagtttagattacgggtttaaaggtgctgaaatcgccatggcttcttactgttcggagcttcaatacctagcaaacccagtcactagccatgtccaaagcgctgagcaacacaatcaagatgtgaactcattggggttaatctcttcaagaaaaacagctgaagccattgatatcttaaaactcatgtcgaccacttacttggtagcactatgtcaagctatagacttgaggcatttagaagaaaacctgaggaatacggtaaagaatgtggtgagccaagtagcgaaaaaagttctgaccacgggtcctaatggtgagcttcatccatcaaggttctgcgagaaagacttactcaaagttgtggactacgagcatgtcttcacctatattgacgacccttgcttagctacatacccattaatgcaaaagctaaggcaaataatggtggatcacgcgttgaataatggcgaaaaggaaaagaatgcaactactgcaatcttccaaaagatcaagctttttgaggaagaattgaagacccttttacctaaagaggttgagaatgcgaggatttcattggaaaatgggaaaccattgattccgaacaggataacacaatgtcgatcttacccgctttacaagttcgtaagggaagatgttgctacagggttgcttacaggggagaaagtaacgtctccgggtgaagagtttgataaagtgtttgatgcaatatgccaaggcaaaatcattgacccattgttgaattgcctcaaggaatggaatggtgccccgctacctatctcttaatttttattttatttgttggtattattttttttatttgtagagatttaatttttgtgttcttctagagtttgatgtgattactcctgtaattgtattaaataatgtcaactggt

SEQ ID NO: 5486 - DNA, 2590 bp, Solanum lycopersicum
caggaaattcagcttaatttattgctcataagttttgcaatttcctaatcccaacaaccaaaaatattgatatatacattgcaccttttatctcaattattttatcaaaatagtttgttttccccttgttcaatattgttttacgataaaaataatggagtacgttaatggaaatagtaatggtgatcaagtattttgcgttaaggctcaacaacaacaagatccgttgaattggaacgtgtccgctgacgcgctaaagggtagccacctagatgcggtgaagaaaatggtggaggagtataggaagccggtggttaggttaggaggggagacgttgacagtagctcaagtggccgccatagctgcacagtcaggtaaagacgtgactgtgcaactatcagaggcggcccgagctggtgtcaaggctagtagtgattgggtgatggaagggatgagaaatgggactgatagttatggtgttactactggttttggtgcaacatcacatagaaggaccaaacaaggtgcagccctacaaaaagagctaataaggttcttgaatgctggagtctttggcaaggggacggagtcttgccacacgttgccacactccgccacgagggcggccatgctagtgaggatcaacaccctacttcaaggctactccggcataaggtttgagattttggaagctataacaaagttgttgaacaacaatattaccccgtgtttgcccctacgtggtacgatcacagcgtctggtgacttggtaccactgtcctacattgccggccttttaacaggccgacccaactccaaggccactgggcctaacggagaactgttggacgctatcaacgcgttccaacaggctggtattgagtctggattctttgagctgcagcccaaagaaggattagctctagtgaatggtacagctgttggctctggcttggcctcaatggttctttttgaggctaacattcttgctatactttctgaagttttatcagcaatatttgctgaagttatgcaagggaagcccgaatttacggaccatttgacacacaaattgaaacatcaccctggccaaattgaagctgcagctataatggagcacattttggatggaagttcctatgtgaaagaagccaagaaaatccatgaaatggaccccttacaaaagcctaagcaagatcgttacgcgcttaggacatctccacaatggttaggcccacaaatagaggtgattcgatcatcaactaagatgattgaaagagagattaactctgttaatgacaatcctttgattgatgtgtcaaggaacaaggcattacatggtgggaatttccaagggacaccaataggtgtgtcaatggacaacactaggctagcacttgcttcaattggcaaactcctatttgcacaattctctgaacttgtcaatgactactacaacaatggtttgccttcgaatctcaccggtggaaggaatcctagcttggattatggtttcaaaggtgctgaaatcgctatggcctcgtactgttctgaactccaatttctcgcgaatccagtaactaaccatgtacaaagtgctgaacaacacaaccaagatgtcaactcactaggcctaatctcatcaagaaagacagaggaggcagttgacatattgaaactcatgtcatccacttacctagtagcactatgtcaagcaattgacttgaggcatttggaagaaaatctcaaagccacggtgaaaagtgcagtgagtttagcagctaagaaagtcttgatcactggccaaaatggtgaacttcatcaatcaagattctgtgagaaagacttgctcacaatggttgacagagagtatgtttttgcatatgctgatgacccctgcagtgctaattaccctttaatgcaaaagttgagacaagttttggtggatcatgcactaaagaattctaacactgaaatcttccaaaagattagtgcatttgaggaagaattgaaacttgttttgcccaaggagattgagagtgttagatgtgatttggaaaatggaaaggcaccaattggtaatagaattcaagaatgcaggtcatatccattgtacaaatttgtgagggaagaattaggtgctaagtatttgacaggtgaaaaagctctatctcctggtgaagtatttgataaagtgtttacagctatgaatgaaggtaagttgatagatccattgcttaattgcttgaaggaatggaatggtgctcctcttccactttgctaagagaaactaggacttatgttgcttggacacttcaaagcgtgcgtgtcggatcctttaaaagtggtatatttttagaggatttgagacagtgcaagcgacatagggaaaacatatttgtcttaatattgtaggtacattatttttcaagtttatttttctagttttgtggaactttttctaatggtttgtatgaatatttgtgaatctttgaacttatagatgacactctaaagcaattgtatttgaacttttgtggcttctttcaagaagaaaatgttgtatagtcaataagaagattacttcaac

SEQ ID NO: 5487 - DNA, 2638 bp, Brassica napus
cgtatcggccattacggccggggaggacaaaactcctaaaacaaacaaaaatatatattaagacatctctcaccttagagatccctccataatctcctacattttaattaactcaatatccaaatggagattaacggatcatcatacaaagtcgacgctatgttatgcggcggagagaccaagaatgtcacggtggctgcggcggatcctctgaactggggagctgcggcggatcaaatgaaagggagccatttggatgaagtgaagagaatggttatggagtttaggaagcctgtggtgaatctcggaggagagactctgacgatcgggcaagtagcagcgatctcgaccgttggaaatggtgtgaaggtggagctgtcggagacggcaagagccggtgtgaaggcgagcagtgattgggtgatggagagtatgggcaaaggcactgatagttatggtgttactactggttttggtgctacttctcatcgtagaaccaaaaatggcgtcgcacttcagaaggagcttataagattcctgaacgccggaatattcggcagcacgaaagaaacatgccacacactgccacactccgccacaagagctgccatgctcgtacgcataaacactctcctccaaggatactccggcatccgcttcgagatcctcgaggccataaccagcttcctcaacaccaacatcactccttccctccctctccgcggcaccatcaccgcctccggagacctcgtccccctctcctacatcgccggcctcctcaccggccgtcccaactccaaagccaccggtcccaacggcgaagccttgaacgcagaggaagccttcaagaaggccggaatcccctctggattctttgacttgcagcccaaggaaggtctcgccctagtcaacggcacagccgttggctccggcatggcctcgatggttctcttcgagacaaacgtcctctcggttctggccgaggttctctcagctgtcttcgccgaggtgatgagcggcaagccggagttcaccgaccatttaacccacaggctgaagcaccaccccggccagatcgaagccgcggcgataatggagcacatcctcgacgggagctcgtacatgaagctagctcagaagctacacgagatggatccgttacagaaacctaaacaagaccgttacgcgctccgcacatcacctcaatggctaggtcctcagatagaagtgatccgttacgccaccaagtccatcgagcgtgagataaactccgtcaacgacaaccctttgatcgacgtttcaagaaacaaagcgattcacggaggtaacttccaggggacacccatcggtgtctccatggacaacacgcgtctcgctatagcatcgatagggaagctcatgttcgctcagttctccgagcttgttaacgacttctacaacaacggtcttccttctaacctaaccgcttcgaggaaccctagtttggactacggtttcaaaggagcggagatcgctatggcttcctactgttcagagcttcagtacttggccaatccagttacaacccatgttcagtcagcagagcaacacaaccaagacgtgaactctttaggactaatctcatcacggaagacggcagaagctgtcgacatactcaaactcatgtcgacaacgttcctcgtcgcaatctgccaagctgtggatctaagacacttggaggagaatctaaaacaaaccgtgaagaacactgtctctcaagtggccaagaaagttctaaccactggagtcaacggtgagcttcacccatctcgcttctgcgagaaagatttactcaaagtcgttgaccgtgaacaagtctacacgtacgcggacgatccatgcagcgccacgtacccgttgatccagaagctaaggcaagttatcgttgaccatgctttggtcaacggtgagagcgagaagaacgctatgacttcgatcttccacaagattggtgctttcgaggaggagctcaaggcggtgcttcctgatgaagtggaggcagctagagtggcgtacgataacgggacatctgctataccgaaccggatcaaggagtgtaggtcgtatcctttgtataggttcgtgagggaggagcttggaactgagcttttgaccggagagaaggtgacgtcgccgggagaagagtttgataaggttttcacggcgatatgtgaagggaagatcattgatccgttgatggagtgtctcagtgagtggaacggagctcccattccaatatgctaagagtgaagggtttctgtttttttttactacaaaagttcttttttttcctttaaatatctgaataatttgtactaaatggtactctgtgaagtcctttttatttgtctaatttcaaagttgtgttataaaactcattgtaagttctcaattgaacaattttcttgttacaaaatgtggaatgatataatcttcttcggtatatggatgtctccataaggacaccatataacataggcggacaattgttataatattttttgaaataatgttaatttattcaaaaaaaaaaacatttgtacaatgactgtgactttacctgagtgtttttagaaaataagacttaaacttagaatcc

SEQ ID NO: 5488 - DNA, 2319 bp, Cucumis sativus
tatatccttaacatatggcacccattgatcagacaaatgacgacagcagcttttgcaccaatactactcatccagacccactcaattggggtttggctgctgattccctcaagggaagccatcttgatgaggtgaagcgcatggtccaggagtatcgaaggcctcttgtcaagcttggtggtgaaactcttaccatttctcaggtggctgctattgctactcgggatactgatgttattgttgagctttctgaatctgctagagctggtgttaaggctagcagtgattgggttatggagagtatgaataaagggaccgatagttatggtgttactactggatttggtgctacttctcatagaagaaccaaacaaggtggtgctcttcaaaaggagttgattagatttttgaatgcggggatttttggaagtggagctgagtctgatcatactttgcctcattctgctacgagagcggccatgttggtgagaatcaacactctacttcagggctactcgggtattagatttgagattttggaagccattaccaaactcttgaataataatattactccttgcttgcctcttcgtggaaccattactgcttctggagatcttgttcctctttcttacattgctggattgcttactggtcgtccaaattctaaagctattggtccaaatggagaaagtcttgatgcaaaggaagctttccaacaagctggtattccatctgggttttttgagttgcagccaaaggaagggttggcacttgttaatggcactgccgttggttctgggttggcttctatcgttctctttgaggcaaatattttggctgttttgtctgagattttgtctgccatctttgctgaagttatgcaaggcaagccagaatttactgatcatttgacccataagttgaagcatcatccagggcagattgaagcagctgcaatcatggaacacattttggatggaagttcttacatgaaaacagctaagaagttgcatgaaatggatcctcttcaaaagcccaaacaagatcgctatgcccttagaacttcaccccaatggttgggtccattgattgaagttattcgattctctacaaagtctattgagagggagattaattcagtcaatgacaaccctttgattgatgtttcaaggaataaggctttgcatggaggcaacttccaaggaaccccaataggagtctccatggacaacactcgtctggctattgcttcaattggaaagcttctttttgctcaattttcagaacttgtcaatgatttctataataatgggctaccctcaaatctctctgcaagcagaaacccaagtttggattatggattcaaaggtgctgagattgccatggcttcatattgctctgagcttcaatacttagcaaatcccgttactagtcatgtccaaagtgccgagcaacataatcaagatgtcaactctcttggtttaatctcatcaaggaaaacagctgaggccgttgacattctaaagctcatgtcgtccacatttttggttgctctttgccaagcaattgacttgagacatttggaagaaaatttgaagaatgtagtgaagagcacggtaagtcaagtggccaagaaagttctcaccacaggtgttaacggtgcacttcacccatcaagattttgtgaaaaagatttactgaaagtggttgacagagaatacacctttgcctatgtcgatgatgcatgcagtgccacttatccattgatgcaaaagctaagacaagttcttgttgaacatgctttggaaaatggtgaagatgaaaagaatacaaacacttccatttttcaaaagattggagctttcgaggaggaattgaaagccatcttaccaaaagaagtagaaaatgcaagattgtcctatgaaaatggaacgtccaccattgaaaaccaaattaaagaatgtagatcttatccattgtacaagttcgtgagggaggagttgagaactggattgttgaccggagaaaaggtgatatctccaggagaagagtgtgaaaaggtattcacagctctttgtcaaggaaaaatgatcgatccaattttagagtgtttgaaggagtggaatggtgctccaatccccatctgctagttatgttactgccaaaccgaaggatccaacagtgatcgtgatgataaagaaaaaagccattggccttaaatattttgttctgtttttcatttttcagttttaaatatacatccatgtgtaatatttgggaaaattttccctaaattaatatttaacgtaaatttct

SEQ ID NO: 5489 - DNA, 2175 bp, Pisum sativum
atggaagcaataggtgcagccattacaaaaaacaacagcggttacgattcattctgtttgaccaatgctaaaaacaataacatcaaagtgagtgactctgatcctttgaattggggtgttgcggcggaggcaatgaaaggtagtcacttggacgaggtgaaacgtatggtggatgagtaccggaagccggtggtccgtcttggtggtgagacgctcacaatttctcaggtagctgccattgccgcacatgatcatggtgtgaaggtggagctgtcagaatctgctagggctggcgttaaggcgagcagtgactgggtaatggagagtatgaacaaaggcacagacagttacggtgtcaccaccgttcatggcgccacctctcaccgtcgaaccaaacaaggcggtgctttgcagaaagaactcattagatttttgaatgctggaatatttggaaatggaagtgagtcaactcatacactaccacacacagcaacaagagctgctatgcttgtgagaatcaacacacttctccaaggttattcaggaattagatttgaaatcttggaagctataaccaaactcattaacaacaacgtcaccccatgtttactccgtggtacaatcacagcttctggagatttagtccctctttcttacattgctggtttattaactggaagaccaaattccaaagctcatggaccgtctggagaaatacttaatgctagagaagcttttcagtcagctggaatcaatgatggtttctttgaattgcaaccgaaagaaggtcttgcacttgttaacggaactgctgttggttctggtttagcttctattgttctctttgaagctaacatattagctgtgttgtctgaagtcctatccgctatttttgctgaagttatgcaagggaaacctgagtttactgatcatttgacacataagttgaagcaccatcctggtcaaattgaggctgctgctattatggaacacattttggatggaagtgcttatgtcaaagctgctaagaagttgcatgagatggatcctttgcagaagccaaaacaagatagatatgcacttagaacttcaccacaatggcttggtcctcttattgaagtcattagattctctactaagtcaattgagagggagatcaactctgttaatgataaccctttgattgatgtttcaagaaacaaggctttgcatggtggaaactttcaaggaacacctattggtgtatccatggataatacacgtttggctcttgcgtcaattggtaaactcttgtttgctcaattctctgaactcgtcaatgatttttacaacaacgggttgccttctaatctctcagctagtagaaatcccagcttggattatggattcaagggatccgaaattgccatggcttcttattgttcggagttacaatatcttgcgaacccagttacaactcatgttcaaagtgctgagcaacacaaccaagatgtgaactctttgggtttgatatcttctaggaaaacatatgaagccattgagatccttcagctcatgtcttcgacattcttgattgcactttgtcaagcaattgatttaagacatttggaggagaacttgaaaaactcagtcaagaatatggtgagccatgttgccaaaaggactcttactacaggtatcaatggagaacttcatccttcaagattttgtgaaaaggacttgctgagagtggttgatagggaacatgtgttctcctatattgacgacccttgtagtgctacatatccattgatgcaaaagctaaggcaagtgttagtggaccatgcattagtaaatggtgaatctgagaagaatttgaacacatcaatcttccaaaagattgcaacttttgaggatgagttgaagaccctcttgccaaaagaggttgaaagtgcaaggggtgcatacgagaatggaaatacaacaatttcaaacaagatcaaagaatgcagatcctatccactttacaagtttgtgagagaagaactgggaactagtttactaaccggagaaaaggtcatttcacccggtgaagaatgtgataaattgttcacagctatttgtcagggaaaaatcatcgatcctcttcttgaatgcttgggagactggaacggtgctcctcttccaatttcttaa

SEQ ID NO: 5490 - DNA, 2392 bp, Cucumis sativus
ttttcatttccttcatcaataatcctaaaagaagaggaaaaataaaccccatatatttttcttcatggcacctgcccagttggaacaatttgctcaccaaaatggctcgatggagagcttttgcacaagccacgttgtcgatccactcaattggggtgtggcagctgaggctctcaagggaagccatcttgatgaggtgaagcggatggtggatgagtatagaaggcctgttgtaaagcttgggggtgagactctcactatttctcaggtggctgctattgccactcgtgataatgatgtagttgtgaaattggctgagtctgccagagcgggtgttaaagctagtagtgattgggtgatggagagtatgaataaaggaactgatagttatggtgtaactactgggtttggtgctacatctcatagaaggacaaaacaaggtggagctcttcagaaggagttgattcgatttttaaatgctggaatttttggaaatggagctgagtcgaatcatactttgcctcattcagctacgagggcagccatgttagtgaggatcaatactttgcttcaaggttactcgggcattcgatttgagattttggaagctattactaatcttctcaatgaaaacgttactccatgtttgccactacgaggaacaattacggcatcgggggatcttgtccctttatcgtatattgctgggctacttacgggtcgtcctaattccaaggccattgggcctaatggggaaactcttgacgctgaggctgcctttaaacaagctggtattccttctagctttttcgagttgcagcctaaagaaggtcttgctcttgttaatggcacggctgtaggttctgggttagcttctattgtcctatttgaggcaaatattctagctgttctatcagaaattctttctgctatctttgctgaggtcatgcaaggaaagcctgaattcactgatcatttgactcacaagttgaaacatcaccctggtcaaattgaagccgccgcaatcatggaacacattttggatggaagttcttacatgaaagcagccaagaaactacatgaaattgatcctctccaaaagcctaaacaagatcgttatgctcttagaacttcaccacaatggcttgggccattgattgaagtgattcgattttccaccaaatctattgagcgagagattaactcagtcaatgataaccctttgattgatgtttcaagaaacaaggcattgcacggaggcaacttccaaggaacaccgattggagtttccatggataacactcgtttggccattgcttcaattggaaagctcatgtttgcccaattctcagaacttgtcaatgacttctacaacaatggtttaccttctaatctttctgccagtagaaatcctagcttggattatgggtttaaaggagctgaaattgcaatggcttcatactgctctgaacttcaatatcttgcaaatccagtgacaagtcatgttcaaagtgctgagcaacataaccaagatgttaattctcttggtttaatttcttcaagaaaaactgcagaagccatcgatatcttgaaactcatgtcatccacatttttggttgcactctgccaagcaattgacttgaggcatctggaggaaaacttgaagagcacggttaaaagtgtagtgagtcaagtagcgaaaaaggtattaaccacatcctccattggcacactacacccatcaagattttgcgagaaagatctacttaaagtcgttgacagagaatacacatttgcatacattgatgatccatgtagtgctacttatccattgatgcaaaagttgagacaagttctagttgaccatgccctcaccaatggcgaaaatgaaaaaaacatgaacacgtccatcttccaaaagattactgcttttgaagaagaactaaaggtagctttaccgaaggaagttgaaaatacaaggttggcatatgagagcggaaattctaaagttgcaaatcaaataaaggattgtcgatcttatccattatataaatttgtgagagaagacttgggagcaaaacttctaacaggagaaagagtgatatctccaggagaagaatgcgagaaggtattcacagctttgtgtcaaggaaagatgatcgactctattttggagtgcttaaaagagtggaacggggctcccattcctatatgttagaataaggatataagattaaatttacacttttactataattttttttttttaattttactgtcacatttttatttcaagaagttaatttgattaatgaacaaaaagttagcaaaataagatactgtgttattgtgatagcccctttgttctaaaacttacccttttctaattagt

SEQ ID NO: 5491 - DNA, 2319 bp, Lotus japonicus
ctgcactgctgctaatggtactgctactgctactgatcccttaagttggggtgtggcagcggagtcaatgaaggggagccacctgaacgaggtgaagcgcatggtggcggagtaccggaagccggtggtcaagcttggcggagagactctgacaatagctcaggtagctgccatcgccgcaaacgaacaaggcgtgagcgttgagctgtgtgaatcagctagagctggagttaaggcgagcagtgactgggtgatgaacagcatgaacaacggcactgacagttacggtgtcaccaccggcttcggcgccacctcccaccgcagaaccaaaaatggcaatgctttgcagctagaactcatcaggtttttgaatgctggaatatttggcaatggtactgagtcaactcacaccctgccacagcctgcaactagagcagccatgctagtgaggatcaacactcttctccaaggatactcaggcattagatttgaaatccttgaagcaatcaccaagctcatcaacaacaacatcaccccatgtttaccacttcgcggtaccgtcacggcctctggtgatttagtccctctttcttacattgccggcttgcttaccggccgaccgaactccaaagctgttggaccatccggcgaggttcttaatgctaagaatgctttccaattggctggcatagactctggtttctttgaattgcagcctaaggaagggcttgcccttgttaatggtactgctgttggttctgggttagcttcgattgttctatttgatgcgaacgtattggctatactggctgaagttctatcagctattttcgccgaagtgatgcaagggaaacctgaattcactgaccacttgactcataagctgaagcatcaccctggacaaattgaggctgctgctatcatggagcacattttggatgggagttcctacatgaaagcagcaaagaagttgcacgaggtggatcctttgcaaaagccaaaacaagatcgatatgcacttagaacttcacctcagtggcttggtcctctgattgaagtgattcggttctcaacaaagtcgatcgagagagagattaattctgtgaacgacaaccctttgattgatgtttccagaaacaaagccttgcatggtggtaatttccaaggaaccccaatcggagtttctatggacaacacacgcctggctcttgcagcgattggcaaactcatgtttgctcaattcactgagcttgtggatgatcattacaacaacgggttgccttcaaatctcacagcaagtagaaatcccagcttggattatggtctaaagggagctgaaattgccatggcttcttattgctccgagctccaatatcttgcgaatccagtcacaactcatgtccaaagtgctgagcaacataaccaagatgtgaattccttgggtttgatttcttctagaaaaacaaatgaagccattgaaatccttaagctcatgtcttccacattcttgatcgcactttgccaagcaattgacttaaggcatttagaggagaacttgaagtactcggtgaagagcactgtaagtcaagttgtgaagaggactcttaccacaggtgtcaacggagaactccatccttctagattttgtgaaaaagatttgctgaaggtggtcgatagggaaactctattttcctatattgatgatccttgcagcgctacatacccgttgatgcaaaaactaaggcaagtgcttgtcgatcacgcactagtaaacggagaaaacgagaaggactcgaagacatcaatctttcaaaagattgcaacttttgaggatgagttgaagagtctcttgccaaaggaggttgaaagtgcaagggctgcatatgagagtggaaatccaacaattccaaacaagatcaatgaatgcagatcttacccgctatacaagtttgtgagagaggagttgggaaccgagttgctaaccggtgaaaagaccagatcaccaggcgaggagtgtgacaagttgttcacagcaatatgccagggtaaaattattgatcctcttttggaatgccttggggagtggaacggtgcccctcttccaatttgttaacttacaagttatgtttaggaaatgcattctttgtatttaagcaaatgcaatgttagtcatttgatttatcaagccttgggcaaaataatatggaaatcttcatcttagtttccttgatgtcaaggaggaacttgtaattgaatattgcaatagaagttttagttatttttcaaagaatacaaaatacaaaaattaagtcataattt

SEQ ID NO: 5492 - DNA, 2261 bp, Quercus alba
aactgggggttagctgctgaggggctcaaagggagccaccttgatgaggtgaagcgcatggttgatgagtttcgtaagccactggttaagccagggggtaagagcttgaccatagctcaagtggctgcaattgctagccaagatggtgcgatcaaggtggagctatctgaggaagctcgggctggggttaaggccagcagtgattgggtcatggacagcatggacaaaggcaaggacagttatggtgtcaccactggttttggtgcaacctcgcataggaggaccaagcaaggtggggcccttcaaagagagcttattagattcttgaatgctggaatctttggcaatggcactgaatcttgccacacattacctcacacggcgactcgtgctgctatgttggtgaggatcaacaccctcctccaaggttactcaggcatcagatttgaaatcatggaagccatcaccaagtttctcaaccacaacattactccatgcttgccactccggggtaccatcactgcatcgggcgacctggttcctctatcttacattgctgggcttttaacaggcagacccaattccaaggctgttgggcctaatggagagtctctagacgctaccaaggcctttgaattagcagggattgatggtgggttttttgaattacaacccaaagagggtctagcactagtaaatggaactgcagttgggtctggcctagcttccatggttctttttgaggccaacatacaagctgtttttgctgaagttttatcagcaatttttgccgaagtgatgcaaggaaagcccgaatttacagaccacttgacacataaattgaagcaccatcctggccagattgaggcagcagctataatggaacacattttagatggaagtgcttatattaaagcagcccaaaagttgcatgaggttgatcctcttcagaagcctaaacaagatcgttatgctcttagaacctctccacaatggcttggcccacaaattgaggttatcaggacagcaaacaagatgattgagagggagattaactcggtgaatgataacccattgattgatgttgcaaggaacaaggctctacatggtggtaacttccaagggaccccaattggtgtttctatggataacactcgtctagccattgcttcagttggcaaactaatgtttgctcaattttcagagcttgtcaatgacttttacaacaatggattgccttcaaatctcacagcaagccgcaatccaagtttggattatggtttcaaaggtgcagaaattgcaatggcatcttactgctcagaactccaattcttagccaatcctgtcaccaaccatgtccaaagtgctgagcaacataaccaagatgtaaactctttggggttgatttcctcaagaaagacagctgaggctgtggacatattgaagctcatgtcaaccactttcttagttgcattgtgccaagctgttgatttaaggcatatggaggagaacttgaagaacactgtcaagaacacagtcagtcaagtggctaaaagagtcctaaccatgggctcaaatggtgagcttcacccatccaggttctgtgaaaaagacttgctcaaggttgttgacagagagtacgtttttgcatacattgatgacccctgcagtgcaacctatccattaatgcaaaagctaaggcaagtcctggttgagcatgctttgaacaacggtgacaaagagaccaacttgagcacttcaattttccaaaagattggagcttttgaggaggagcttaagacccttttgcccaaagaagtagagggtgcaaggatagaaattgagaatgggaaagcagcaattcctaacccaattaaggagtgcaggtcgtacccactatacaggtttgtgagagaagaactgggaacaagtttactaactggtgagagaattcgatcacctggtgaagaattcgataaggtattctcagcaatgtgcgcagggaagttgattgatcctttgctggattgtctgaaggagtggaatggtgctcctcttcctataaattaagatgctttaatttgttacattaaaattgttattgtttcaatcgtttttttttttaatagcttattgtcaatgtatctggtatatgtaatatcaaactgtctatgctagccgtttgtttttttgttcctatataataatatttgtgtgtacttttgaattcagtaaaagtgtacaacaatggagagctttaa

SEQ ID NO: 5493 - DNA, 2461 bp, Solanum phureja
attaaaaaataatggagtacgttaatggaaatagtaatggtactcatgatgatcaagttttttgcgttaaggatccgttgaattggaacatgtcagctgacgcactcaggggtagccacctagatgaggtgaagaaaatggtggaggagtataggaagccggtggttcggctaggaggggagaccttgacagtagctcaagtggccgccatagctgcacagtcaggtacagacgtgactgtgcagctatcagaggcggcccgagctggtgtcaaggctagtagtgattgggtgatggaagggatgagaaatgggactgatagttatggtgttactactggttttggtgcaacatcacatagaaggaccaaacaaggtgcagccctacagaaagagctaataaggttcttgaatgccggagtctttggcaacgggacggagtcttgccacatgttgccacactccaccacgagggcagctatgctagtgaggatcaacaccctacttcaaggctactcaggcataaggtttgagattttggaagctataacaaagttgttgaacaacaacattactccgtgtttgcccctacgtggcacgatcacagcgtctggtgacttggtaccactgtcctacattgctggtcttttaacaggccggaccaactccaaggccaccgggcctaatggagaactgttggacgctgtcaacgcgttccaacgggctggtattgagtctggattctttgagctgcagcccaaagaaggattagctttagtgaatggtacagctgttggctctggcttggcctcaatggttctttttgaggctaacattcttgctatactttctgaagttttatcagcaatatttgctgaagttatgcaaggaaagccagaatttacagaccatttgacacacaaattgaaacatcaccctggccaaattgaagctgcagctataatggaacacattttggatggaagttcctatgtgaaagaagccaagaaaatccatgaaatggacccgttacaaaagcctaaacaagatcgttacgcgcttaggacatctccacaatggttaggcccacaaatcgaggtgattcgatcatcaactaagatgattgaaagagagattaactctgttaatgacaatcctttgattgatgtgtcaagaaacaaggcattacatggtgggaatttccaagggacaccaataggtgtgtcaatggacaacactaggctagcacttgcctcaattggcaaactcctatttgcacaattctctgaacttgtcaatgactattacaacaatggtttgccttcgaatctcaccggtggaaggaatcctagcttggattatggtttcaaaggtgctgaaatcgctatggcctcgtactgttctgaactccaatttctcgcgaatccagtaactaaccatgtacaaagtgctgaacaacacaaccaagatgtcaactcactaggcctaatctcatcaagaaagacagaggaggcagttgacatattgaaactcatgtcatccacttacctagtagcactatgtcaagcaattgacttgaggcatttggaagaaaatctcaaagccacagtgaaaagtgcagtgagtttagcagccaagaaagtcttgatcactggccaaaatggtgaacttcatcaatcaagattctgtgagaaagacttgctcaaaatggttgacagagagtatgttttttcatatgctgatgacccctgcagtgctaattaccctttaatgcaaaagttgagacaagttttggtggatcatgcactaaagaattctaacactgaaatcttccaaaagattagtgcatttgaggaagaattgaaacttgttttgcctaaggagattgagagtattagatgtgatttggagaatggaaaggcaccaattggtaatagaattcaagaatgcaggtcatatccattgtacaaatttgtgagggaagaattaggtgctaagtatttgacaggtgaaaacgttttatctcctggtgaagtatttgataaagtgtttacagctatgaatgaaggtaagttgatagatccattgcttaattgcttgaaggaatggaatggtgctcctcttccacttcgctaagagaaagaaggacttatgttgcttggacacttcaaagggtacgtgtcggatcctttaaaagtggtgtatttttggaggatttgagacggtgcaagcaacatagggaaaatatatttgtcgtaataatgtaggtacattactttttaagtttatttttctagttttgtggaactttttctaatggtttgtatgaatatttgtgaatctttaaacttattgatgatactctagatagcaattgtatttaaacttttgtggcttctttcaagaagaaatgttgtatagacaataagaagactacttcaacaaattttaaatatttttca

SEQ ID NO: 5494 - DNA, 2368 bp, Glycine max
cttagcaatggcaatgcaaatggttcattgaatctttgcaatggtagcacggacccacttaactggggcatggctgcggaagctttgaaaggtagccaccttgatgaggtgaagcgaatggtggaggactaccgtaaccccgtggtgaagttgggtggcaagagcctcaccgtgtctcaggtggcggcggttgccacccggcaccacggcggagttacggtggagctggccaaggagacccgccacggtgtcaaggccagcagtgactgggtcatggatagcatggttaagggcactgatagttacggagtcaccacagggttcggtgcaacctcacatagaagaaccaaacaaggtgctgccctccaaaacgaactcatcagatttttgaatgctggcatttttggtaatggcacagaatcttgtcacaccttacctcactcagctacaagggcagccatgttggttagaatcaataccttgcttcaaggatattcaggcattagatttgaaatcatggaggccatttctaagtttttgaaccataacataaccccatgtcttcctcttcgtggcacaatcactgcatcaggtgacttggttcctttatcatatgttgctggcctcttaattggaaggccaaactccaagtctattggacctaatggacaagttcttaatgctaaagaggcctttcaactagcaggaattgatggtggtttctttgagttgcaacctaaagagggtttggcactagtaaatggcactgcagtaggatctggcttggcttccgtggtcctttttgaggcaaacttacttgtcattctttctgaagtcttgtctgcaatttttgctgaagttatgcaaggaaaaccagagttcaccgaccacttgactcataaattgaagcaccaccctggccaaattgaggctgcagctatcatggaacatatattagatggaagctcatattgtaaggcagcacggaagttacatgagattgatccacttcaaaagcctaaacaagataggtatgctcttagaacatcacctcaatggcttggaccacaaattgaagtaattaggcatgcaacaaagatgattgaaagggagataaactctgtaaatgataaccccttgattgatgtttcaaggaataaggcactacatggggggaatttccaaggtaccccaattggtgtttcaatggataacacccgtttagccattgcatcaattgggaaacttatgtttgcccaattctctgaacttgtaaatgacttctacaacaatggtttgccttcaaatctaacagctagtcgcaatccgagcttagattatggattcaaaggtgctgaaattgcaatggcatcctattgttcagaacttcaataccttgccaatcctgtcaccaatcatgtccaaagcgctgagcaacataaccaagatgtgaactctttaggcttagtttcttcaagaaagacagctgaagcaatagatatattaaagcttatgtcatccactttcttagttgctttgtgccaagccattgatttgaggcatttggaggaaaacttgaagaacactgttaggaataccgttagtcaagtggccaaaagagttctcacagttggcatcaatggtgagttacatccttctaggttctgtgagaaagacttgcttaaaattgttgatcgtgagtatgtctatgcttacattgatgacccctgtagtgcaacctaccctctgatgcaaaaattgagattagtcctagttgatcatgcattacaaaatggtgacaaagaggtgaattcaagtacctcaattttccaaaagattggtgcctttgaggaagagctcaatgcccttttgccaaaagaggtggaaagttctaggattgaagttgagaatggaaatcctgccattcctaaccgaattaaggaatgcagatcttacccattatataagtttgttagagaaaatttgggtacaactttgctaacaggagagaaagtcaagtcacctggtgaggaatttgataaggtatttactgcattgtgtgaagggaagttaattgatcctttgttggactgtctaaaagagtggaagggtgctcctctaccaatatgctgagaggctgctaccttttttcgtaagaaaaccaaaatttacttttcattttcctatgatgtatgtttttataaagctattggacatgtatttgaaactgttataggaatttgtatttcaatttaatatatgttctttatctgtaaacaacaagagatgcatgaccatgaaatcgtaaacaaaaccaaaaatatacaaagtttaaagtcaaaacataagacaaaaattacttccttca

SEQ ID NO: 5495 - DNA, 2179 bp, Ricinus communis
cattgaaaccaatggaaatgtcggatggagagacaaatgaagatgcatacagtagtgggttatgtccaaaagatccattaaagtggggaatagcggcagaagcattgaaaggtagccatctagacgaggtgaagaaaatggttagagaatataggaatccagtggttaggctcggtggtgagacactgaccatagggcaggtggctgcggtggccgttggtgctggggccgcaggcaatagagtggcagttgagctgtgcgagtcggctagggctggagtcaaggcaagtagcgattgggttatggaaagtatggagaaagggacagatagttatggtgttaccactggatttggtgcaacttcccatagaagaactaagcaaggagctgccctacagaaagaacttattaggtttttaaatgctggaattcttggccatggaacggaatcatcccacatattgccacaatcagcaacaagggctgctatgctagtaaggataaacaccctcctccaaggatactcaggcatcaggtttgagatattagaagccattactaagctaattaaccacaacatcactccatgcctgcctctgcgtggctccataactgcttcaggcgatttattacccttttcctacattgctggattcctgacaggcagaccgaattccattgctttagggcctaatggaggttcccttgatgctggagaagcctttcggctggcgggtattgatgcagggtttttcgagttgcagcctaaggaaggtcttgcacttgttaatggcacaggagttggtgctggcttggcatcaatagtcctttttgaggccaacatattggcacttctatcagaagttgtatctgctatttttgctgaagttatgcaaggaaaacctgagtttacggatcatttgacgcataagttgaagcatcatcctgggcagattgaggctgcagctataatggaacatattttggatggaagttcatatgttaagcaagcaaagaagttacatgaaatggatcccttacaaaagcctaaacaggaccggtatgctcttcgaacttcaccacaatggttaggtcctcaaatcgaagtgattcgatcatcgactaagtctatagagagagaaataaactcagtgaacgataatccattgattgatgtttcaagaaataaagccttacatggtgggaactttcagggcaccccaattggtgtatcaatggacaacaccagattggcattagcttccataggaaaactcatgtttgcacaattctcagaattggttaatgatttctacaataatgggttgccttcgaatctaacaggaggaagaaatccaagcttggattatggttttaagggtgctgagatagctatggcagcttattgctctgagctccaataccttgccaatcccgtcacaaaccatgtccagagtgctgagcagcacaatcaagatgtcaactcattaggtctgatatcttcaagaaaaacagcagaagcagttgatatcttaaagctaatgtcctcaactttcttggttgcactttgccaagctatagatttaaggcatttagaagagaatttgaagagtgcagttaagaacacagtgagccaagtggctaggacagttctgacaataggaataaatggtgagcttcatccttcaagattctgtgagaaggatctgctaagagtagtcaatcgcgagcatgtgtttgcatacattgacgagccatgtagttcaacttatcctctaatgcaaaagctgaggcaagtacttgttgatcatgcattgataaacaatgatgatacgaacaacgtaaatgcttcaatattcctgaagataggtgctttcgaggaggaattgaaagccgtattgccaaaagaggttgaagctgcaagaaatgcttttgaaagtggaaatccggaaattccaaatagaatcagggagagcaggtcttatccgctgtataagtttgtaagagaagatttagggactgaaatcttaacaggggagaagatcaaatcaccaggtgaggaatttgataagttgtttagagcaatgtgtgaaggaaagatagttgaccctcttcttgagtgtctcaaaaattgggatggtatgcctctgccaatttgttaaaggcctgcattctaacc

SEQ ID NO: 5496 - DNA, 2393 bp, Trifolium pratense
  misc_feature (353)..(353): n is a, c, g, or t
  misc_feature (2335)..(2335): n is a, c, g, or t
gactctttcattctttcatattttgttttaagtttccattctctttcaaaatttctctttagctaccaaatcataacaaagtaacacttaagatggaagcagtagcagcagccataacaaaaaacaacattaatgattatgattcattttgcttaactcatgctaatgctaataacatgaaagtgaatggtgctgatcctttgaattggggtgtggctgctgaggcaatgaaagggagtcacttggatgaggtgaagcgtatggtggaggagtaccggaaaccggttgtccgtcttggtggcgagacactgacaatttctcaggtggctgccattgctgcacacgatggtgcnacggtggagctgtcggaatctgctagagccggcgttaaggcgagcagtgactgggttatggagagtatgaacaaaggtactgatagttacggtgtcaccacagggttcggcgctacctcgcaccgccgaaccaaacaaggtggtgctttgcagaaagagctcataaggtttttgaatgcaggaatatttggaaatggaactgagtcaaaccacatcctaccacacacagcaacacgagcagccatgttagtaagaatcaacacacttctacaaggttattcaggcattagatttgaaatcttagaagccataaccaagctccttaacaacaatattactccatgtttaccacttcgcggtacaatcacagcttcaggagatttagtgcctctttcttacattgctggtttactaactggtagaccaaattcaaaagctcatggaccctctggagaaatacttaatgctaaagaagcttttcaattggctggaatcaatgctgatttctttgagttacaaccgaaagaaggtcttgcacttgttaatggaactgctgttggttctggtttagcttctattgttctgtttgaggctaacatattggcggtgttgtctgaagttctatctgcaattttcgctgaagttatgcaagggaagcctgaatttaccgatcatttgacacataagttgaagcaccaccctggtcaaattgaggctgctgctattatggaacacattttggatggaagtgcttatgtcaaagcagctaaaaagttgcacgagatcgatcctttgcagaagccaaaacaagatagatatgcacttagaacttcaccacaatggcttggtcctctaattgaagtcattagattttctaccaagtcaattgagagggagattaactcagttaatgacaaccctttgattgatgtttcaagaaacaaggctttgcacggtggaaattttcaaggaacgcctatcggagtatccatggataatacacgtttagctcttgcatcaatcggtaaacttatgtttgctcaattctctgagcttgtcaacgatttttacaacaacgggttgccttcaaatctctctgctagtagaaatcctagcttggattatgggttcaagggatccgaaattgccatggcttcctattgttctgagttacaatatcttgcaaatcccgttacaactcatgtccaaagtgccgagcaacacaaccaagatgtgaactctttaggtttaatttcttctcgaaaaacaaaagaagccattgagatccttcaactcatgtcttccacattcttgattgcactttgccaagcaattgatttaagacatttggaggagaacttgaaaaactcagtcaagaataccgtaagccaagtggccaaaaagaccttaactataggtgtcaatggagaacttcatccttcaagattctgtgaaaaagacttgttgaaagtggttgatagggagcatgtgttttcctatattgacgatccttgtagtgcgacataccccttgtcgcaaaaactcaggcaagtgctagtagaacatgctttagtcaatggagaaagtgagaagaattcgaacacatcaatcttccaaaagattgcaacttttgaggaagagttgaagaccctcttgccaaaagaggttgaaagtgcaaggactgcatatgagagtggaaattcaacaattgcaaacaagattaatggatgcagatcttatccactttacaagtttgtgagagaggagttgggaacttctttgctaactggagaaagagtcatttcaccaggtgaggagtgtgacaagctattcacagctatgtgtcaagggaaaatcattgatcctcttcttgaatgtttgggagagtggaatggtgctcctcttccaatttgttaactttattagttaattttaaaaatgttttatttgtatctatgcaagtgtagcaataatcatttgantttcatgtcttttgacaaaattaatacatgaaaaataagcttcatttcaattttctcg

SEQ ID NO: 5497 - DNA, 2314 bp, Cucumis sativus
ggggcaagatcgtaatttaacaaacgttattttctatttaagcttctccgacgtccatcggtaactcaggaaatccaaatctgaatttaaagatttcatttcctccatcaaacaaaactcccttcttcttcttcatcttcttttctatatcttttacaataatattttctgatggcggaactcggtcaccaaaatggcgtcgagttttgcatcggcggccgtaataacatcaataacgatccgttgaattggggagcggcagcggagtcgttgaagggaagccatttggaagaagtgaagaggatggtagaggagtaccggcggccggtggtgaaacttggaggagagactctgacgatatctcaggtggctgcgatcgcctccagggattccggcgtggtggtggagctgtcggagtcggcgagaggcggggttgaggcgagcagtaagtgggtgatggacagcatgaatcaaggaacggatagctacggcgtcacgaccggctttggtgccacctcccatcgccggactaaagagggcggcgctctgcagagggagctcatacgatttttgaatgcgggagtatttggaaatggcactgaatcgagtcacactttacctcatttagcaacaagagcagccatgttagttaggatcaacaccctccttcaaggctactcgggtattaggtttgaaatcttggaagctataaccaaacttctcaaccacaacgtcactccatgtttgcctcttagaggaacgattactgcttctggagatcttgttcctctttcttacattgctgggttgcttactggtcgatcaaattcgaaagctattggtccaaatggagaaagtcttgatgcaaaggaggctttcaaacaagctagtattccctctgggttctttgagttgcaacctaaagaaggattggctcttgtcaatggaactgctgttggttcagggttagcctctattgtgttatttgaggcaaacattttggcagttttagctgaaattatgtctgctatttttgctgaggtcatgcaaggtaagcctgaatttaccgatcatttaactcataaattgaagcatcatcctggtcagattgaggcagctgcaatcatggaacacattttagatggaagttcttacatgaaaacggctaagaagttgcatgaaatggatcctctccaaaagcccaaacaagatcgctacgcccttagaacttcaccccaatggttgggtccgttgattgaagttattcgattctctacaaaatctattgagagggagattaattcagtcaacgacaatcctttgattgatgtttcaaggaacaaggctttacacggaggtaacttccaaggaacaccaattggagtctcgatggataacactcgcttggccattgcttcaattggtaagctcatctttgctcaattttctgagcttgttaatgatttttacaacaatggcttgccttcaaatctctctgcaagtagaaacccaagcttagattatggactcaaaggtaccgaaattgctatggcttcttattgctccgagcttcaatatttggcaaatccggtaacaagtcatgtccaaagtgctgagcaacacaatcaagatgttaactctcttggtttaatctcctcgagaaaaacagaagaagcaattgacattttgaaactcatgtcttcaacatttttagtagcactttgtcaagcaattgacttgagacatttggaagaaaatctaaagagcacagtaaagaacacagtaagccaagtggccaagaagatccttaccactggtgctaatggagctcttcacccgtctagattttgtgagaaggatttactcaaggttgttgatagagaatacatatttgcttacatcgatgacccatgcagtgccacttatccattaatgcaaaagttaagacaagttcttgtggagcatgcactttcaaatggagaagatgagaagaacgccaacagttcaatctttcaaaagattcatgttttcgaagaggaactaaaagttgttttacctaaggaggtagaaagtgcaaggtttgcttatgaaaatgggaactctacggttcaaaatcaaattaagaaatgtagatcatatccactctacaagttcataagaaaagagttaggaactgagttgcttacaggagaaaaggcaaaatctcccggagaagtgtgcgaaaaagtgttcatagctttatgtcaaggaaagatgatcgatccgatcttagagtgtttaaaggaatggaatggtgctccaattcctatttgct

SEQ ID NO: 5498 - DNA, 2582 bp, Arabidopsis thaliana
gaaactagctatctctatacgcttacctaccaacaaacactaccaccttatttaaaccacccttcattcatctaattttcctcaggaacaaatacaattccttaaccaacaatattacaaataagctcctatcttctttctttcttttagagatcttgtaatctcctcttagttaatcttctattgtaaaactaagatcaaaagtctaaatggagattaacggggcacacaagagcaacggaggaggagtggacgctatgttatgcggcggagacatcaagacaaagaacatggtgatcaacgcggaggatcctctcaactggggagctgcagcggagcaaatgaaaggtagccatttggatgaagtgaagagaatggttgctgagtttaggaagccagttgtgaatcttggtggtgagactctgaccattggacaagtggctgcgatctcaactattggtaacagtgtgaaggtggagctatcggagacagctagagccggtgtgaatgctagtagtgattgggttatggagagtatgaacaaaggcactgatagttatggtgttactactggttttggtgctacttctcatcggagaaccaaaaacggtgtcgcacttcagaaggaacttattagattccttaacgccggaatattcggaagcacgaaagaaacaagccacacattgccacactccgccacaagagccgccatgcttgtacgaatcaacactctcctccaaggattttccggtatccgatttgagattctcgaagcaattaccagtttcctcaacaacaacatcactccatctctccccctccgtggtacaatcaccgcctccggagatctcgttcctctctcctacatcgccggacttctcaccggtcgtcccaattccaaagctactggtcccaacggtgaagctttaacagcagaggaagctttcaaattagcaggaatcagctccggattctttgatctccagcctaaggaaggtctcgcgctagtcaatggcacggcggttggatctggaatggcgtcaatggtgttattcgaaacgaatgttctctctgttttggctgagattttgtcggcggttttcgcagaggtgatgagtggtaagcctgagttcaccgatcatctcactcacagacttaaacatcatcccggtcaaatcgaagcggcggcgataatggagcatatcctcgacggaagctcgtacatgaaattagctcagaagcttcacgagatggatccgttacagaaacctaaacaagatcgttacgctcttcgtacttctcctcaatggttaggtcctcaaatcgaagtgatccgttacgcaacgaaatcgatcgagcgtgagattaactccgtcaacgataatccgttgatcgatgtttcgaggaacaaggcgattcacggtggtaacttccaaggaacaccaatcggagtttcaatggataacacgagattggcgatagcagcgattggtaaactcatgtttgctcaattctcagagcttgtgaatgatttctacaacaatggtttaccctcgaatctaaccgcttcgaggaatccaagtttggattatggattcaagggagctgagattgcaatggcttcttattgttcagagcttcaatacttagctaatcctgtgactagccatgttcaatcagcagagcaacataaccaagatgtcaactctttgggactaatctcgtctcgcaaaacttctgaagctgttgatattctcaagcttatgtcaacaacgttcctcgttgcgatttgtcaagctgtggatttgagacatttggaggagaatttgagacagactgtgaagaacactgtctctcaagtggcgaagaaagttcttactactggagtcaatggtgagcttcatccttctcgcttctgcgaaaaggatttactcaaagttgtagaccgtgaacaagtctacacatacgcggatgatccttgtagcgcaacgtacccgttgattcagaagctgagacaagttattgttgaccatgctttgatcaatggtgagagtgagaagaatgcagtgacttcaatcttccataagattggagctttcgaggaggagcttaaggcagtgctaccgaaagaagtggaagcagcaagagcagcctacgataacggaacatcggctatcccgaacaggatcaaggaatgtaggtcgtatccattgtatagattcgtgagggaagagcttggaacagagcttttgaccggagagaaagtgacgtcgcctggagaagagttcgacaaggttttcacggcgatttgtgaaggtaaaatcattgatccgatgatggaatgtctcaacgagtggaacggagctcccattccaatatgttaagagtatagtcctctgtttttttcttaccataaagtctttttttttttacatgtctgaataattttaccaaatgattgtctgtgaagtggttttatgtctgtctaatttaaatttgtgtgtaaaactcattgtaagttctcaaatgaacaatttttcttttacaaattaatgtgtgaatcataccttcttcttttt

SEQ ID NO: 5499 - DNA, 2444 bp, Vitis vinifera
ctcttttcttcattattttcccattaaccaaacaccctcccgagcttaatttgatatacagcactcaccattttctcttcggatttttacaaaatggaattctcacaccacaacggcaacggaaacggaaaggtggacgccaatggcttctgcatgaaggccgcggatcccctctactgggcggcggcggcggagactctgaaggggagccatttggaggaggtgaagagaatggtggcggacttcagaaaaccggtggtgaggcttgggggtgagagcctcaacatcgcacaggtggcggcggtggcggccaccggaagcgacggggtgacagtggaactgtcggagtcggcgagggccggggtgcaggccagcagcaactgggtgatggagagcatgaaccaaggcaccgacagttatggggtgactaccgggttcggtgcgacttcccatagaagaaccaaacaaggaaatgctcttcagaaagaactgatcagattcttgaacgctggaatatttgggaagggaacagagtcatgccacacattgcctcacagtgcgacaagagcagcaatgctggtgaggatcaataccctcctccaaggatactcaggcatcagatttgagatcttggaagccaccgttaagctcctcaacgccaacattagtccttgcttgcctctgcgtggcaccatcagtgcctctggtgatctcgtccctctttcttacattgccggtctcctcaccggcaggcctaactccagggccgtagggcctaacggagagtccctcaatgctgaggaagcctttcgccttgccggaattgatggagggttctttgagttgcagcctaaggagggtcttgcactcgttaatggcacggcagtagggtctggtttggcttcaacagttctctttgaggctaacatacttgctgttttatcagaagttttgtcggctatatttgctgaggttatgcaggggaagccagagtttactgatcatttgacgcacaaattgaaacaccatccgggacaaattgaagctgcggctattatggaacacattttggatggaagcgcttatgttaaagcggctcagatgctgcacgagatcgatcccctccagaagcccaagcaagatcggtatgctcttaggacttcaccccagtggttgggtcctcagattgaagttattcgaacatcaacgaagtccatagaacgagagatcaattcggtgaatgacaacccattgattgatgtgtcaaggaacaaggccttgcatggtgggaacttccagggtaccccaattggtgtttccatggacaacaccagattagcaatagcctccattgggaagctcatgtttgcgcaattctctgagctggttaacgatttttacaacaatgggttgccctcaaatctctctggtggaaggaatccaagtctggattatgggttcaagggtgctgagatagcaatggcagcatattgttctgagctccaattcctagccaacccagtcaccaatcatgttcagagcgctgagcaacacaaccaggatgtgaactccttaggattgatctcttcgcgaaaaacggaagaagcaattgacatcttaaagctcatgtcctcaacctacctggtggcactttgccaggctattgatttgaggcatttggaggagaacttgaagaacacagtcaagaacacagtgagccaagtggccaaaaaggtgctagccattgggatcaatggggagcttcacccgtctagattctgcgagaaggacttgcttaaagtagtagaccgcgagcacgtttttgcctacatcgatgacccatgcagtgcaacataccccttgatgcaaaacctaaggcaagtcctggttgatcatgcgctgatgaacaacgaggatttgaggaattcaagtacttcaatctttctcaagattggggcatttgaggaagaactgaagacccttttgcctaaagacgtggagagcacgagaattgcctttgataatgggaatctggccattccaaaccgcatcaaggagtgcaggtcctaccctctgtacaagtttgtgagggaagagtcagggactgagtttctgacaggagaaaaggttacctcgccaggggaggagtttgataaggtgttctctgcaatatgtgaggggaagatcatcgatccgctgctcaaatgtctcaatgattgggatgggactcctcttccaatttgctgaaaccaacttgtcttttgagtttattcatgggatttatggccttgtagtgttattgtcaaccgttctgttcttttttctttggttacattttttaagcacttctcacatgtttgtgtataacaagaaatgtattggccttgtttatctgtctccaaaatttgctctataaaattccagtttattaaatttccatgtca

SEQ ID NO: 5500 - DNA, 2352 bp, Cucumis sativus
ttatacaaatacaattatacatggctcagaaggtttgtgctaaccaaaatggttcggtggagaccttgtgcaatacccatcaggatccactcaactggggtttggccgctgattccatgaagggaagccatctggatgaggtcaagcggatggtggaagagtatcgaaggcctttggttaagcttggaggacaaactctcaccatttctcaggttgctgccattgccactcgtgataatgatgtccttgtagaattggccgagtctgcaagggccggtgtcaaagctagcagcgattgggtgatggagagcatgggtaaaggcactgatagttatggtgttactactggctttggtgctacttcccatagaagaaccaatcaaggtggagctcttcaaaaggagttgattcggtttttgaattctggcatctttggaaatggaagtgaatcaaatcacactttgcctcactctgcaacaagagcagctatgttggtgagaatcaacactcttcttcaagggtattctggcattcgattcgagattttggaagccattactaatctcttgaaccacaacgtcactccatgtttgccacttcgaggaacaattactgcttcgggagatttggttcctttgtcttatattgcggggttgcttaccggtcgtcacaattcaaaagctattggaccgaatggagaaacccttgatgcaaaggctgcttttacacaggctggtattgattctgggttctttgaattgcagcctaaggaaggtcttgctcttgttaatggcactgccgtcggttctggattggcttccattgttctctttgaggcaaatattttagccgttttgtctgaaattttatcggccatatttgctgaggtgatgcaaggaaagcccgaattcaccgaccatttgacccataagttgaagcaccatcctggtcaaattgaagcagctgcaatcatggagcacattttagatggaagctcctacatgaaaacggcaaagaaattgcatgaaatggatcctctccaaaagcccaaacaagatcgttacgctcttagaacttctcctcaatggttgggtcctttgattgaagtgattcgtttctccactaagtcaattgagcgggaaattaattcagttaatgacaaccctttgattgatgtttcaagaaacaaggcgctacatggaggtaacttccaaggaacgccgattggagtttctatggacaacactcgtttggccgttgcatccattggaaagctaatgtttgctcaattttcagaattagtcaatgatttttacaataatggtttgccttctaacctttctgcaagtagaaatccaagcttggattatggctttaaaggtgctgaaattgccatggcttcttattgctctgagcttcaatatcttgcaaatcctgtcacaagtcacgtccaaagcgccgagcaacacaaccaagatgttaactctcttggtttaatttcctcaaggaaaacagctgaagccatcgatattcttaaactcatgtcttccacattcttagttgctttatgtcaagcaattgacttgaggcatttggaggaaaacttgaagagcgtggtgaaaagcacagttagccaagtagcaaaaaaagtgttgactacctcttccaatggcgcacttcatccatcaagattttgtgagaaagatttactcaaagttgtcgacagagaatacacttttgcatacatagatgatccatgcagtgctacctaccctcttatgcagaagttaaggcaaattcttgtcgagcatgcacttaaaaatggtgatagcgaaacgaacgaaaacacctcaatcttccaaaagattggtgctttcgaagaggagttgaaggcaatcttaccaaaggaggtagaaaacgtaaggttggcatatgagaatggaaattccgaaattgaaaatcaaatcaaggattgcaggtcttacccattatacaaatttgtgagagaggagttgggaacaagattgctaaccggcgaaaaggtaatttctccaggagaagagtgcgagaaggtattcactgctttaagtcaaggaaagatgatcgattcgatcttcgaatgcttgaaggagtggaatggagcaccccttcctatttgctaatagcttataataattcttatgctattcgtttagttggacgatgcatttctcaaattattgaaagatatatgattacattttgtattggctattgtttttcattcacattttaaatcaattttaaacacaattgatatccacatgtaacttttattttttgaataatcaccatatacattatattttgaca

SEQ ID NO: 5501 - DNA, 2579 bp, Arabidopsis lyrata
gaaactagctatctctatgcgcttacctaccaacaaacactaccaccttatttaaaccagccttccttcatctaattttcctcaggaacaaatacaattccttaacaaacaaaatatcaaatatctcttctcttctaatttagagatcttgtaatctcctcttaattagtcgtctcctcttgtaaactaagatccaaaagtcaaaatggagattaacggagaacacaaagctaacggaggatcaatcgacgctatgttatgtggcggagacatcaagacaaagaacatggtgatcaacgcggaagatcctctcaactggggagctgccgcggagcaaatgaaaggtagccatttggatgaagtgaagagaatggttgttgagtttaggaagccagtggtgaatcttggaggtgagactctgaccattggacaagtggctgcgatctcaaccattggtaacggtgtgaaggtggagctgtcggagaccgctagagccggtgtgaatgcgagtagtgattgggttatggagagtatgaacaaaggcactgatagttatggtgttactactggttttggtgctacttctcatcggagaaccaaaaacggtgtcgcacttcagaaggagcttattagattccttaacgccggaatattcggaagcacgaaagaaacaagccacacattgccgcactccgccacaagagccgccatgcttgtacgaatcaacactctcctccaaggattttccggtatccgattcgagattctcgaagcaatcaccagtttcctcaacaacaacatcactccatctctcccactccgcggtacaatcaccgcctccggagatctcgttcctctttcctacatcgccggaattttaaccggccgtcccaattccaaagctaccggtcccaacggtgaagctttaacagctgaagaagccttcaaattagctggaatcagctccggattcttcgatctccagcctaaggaaggtctcgcgcttgtcaatggcacggcggttggatctggaatggcgtcaatggtgttattcgaaacgaatgttctctccgttttggctgagattttgtcggcggttttcgcggaggttatgagtggtaaacctgaattcaccgatcatctaactcacagactcaaacatcaccccggtcaaatcgaagcggcggcgataatggaacatatcctcgacggaagctcatacatgaaattagctcagaagcttcacgaaatggatccgttacagaaaccaaaacaagatcgttacgctcttcgtacttctcctcaatggttaggtcctcaaatcgaagtaatccgttacgcaacgaaatcgatcgagcgtgagattaactccgtcaacgataatccgttgatcgatgtatcgaggaacaaggcgattcacggtggtaacttccaaggaacaccaatcggagtttcaatggataacacgagattggcgattgctgcaattggtaaactcatgtttgctcaattctcagagctggtgaatgatttctacaacaatggtttaccttcgaatctaaccgcatcgaggaatccaagtttggattatggattcaaaggagctgagattgcaatggcttcttattgttcagagcttcaatacttagctaatcctgtgactagccatgttcaatcagcagagcaacataaccaagatgtgaactctttgggactaatctcatctcgcaaaacttctgaagctgttgatattctcaagcttatgtcaacaacgttcctcgttgcgatttgtcaagctgtggatttgagacatttggaggagaatctgaaacagactgtgaagaacactgtttctcaagtggccaagaaagttcttactactggtgtcaatggtgagcttcatccttctcgcttctgcgagaaggatttactcaaagtcgtggaccgtgaacaagtctacacatacgcggatgatccttgtagcgcaacgtacccgttgattcagaagctaagacaagttatagttgatcatgctttgatcaatggtgagagtgagaagaatgcagtgacttcaatcttccataagattggagcttttgaggaggagcttaaagcggtgctaccgaaagaagtggaggcagcaagagcggcgtacgacaacggaacatcagctatcccgaacaggatcaaggaatgtaggtcgtatcctttgtatagattcgtgagggaggagcttggaacagagcttttgaccggagagaaagtgacgtcaccaggagaagagttcgataaggtgttcacggcgatttgtgaaggtaaaatcattgatccgatgatggaatgtctcaacgagtggaacggagctcccattcctatatgttaagagtaaattcctctgttttttcccttaccataaagtcttttttttttttacatgtctgaataattttaccaaatgattgtctgtgaagtggttttatgtctgtctaatttaaatttgtgtgtaaaactcattgtaagttctcaaatgaacaatttttcttttactacaaaatgtgtgaatcatacctttctttttt

SEQ ID NO: 5502 - DNA, 2531 bp, Citrus sinensis
  misc_feature (419)..(419): n is a, c, g, or t
  misc_feature (470)..(470): n is a, c, g, or t
  misc_feature (489)..(489): n is a, c, g, or t
  misc_feature (657)..(657): n is a, c, g, or t
  misc_feature (1509)..(1509): n is a, c, g, or t
  misc_feature (1933)..(1933): n is a, c, g, or t
  misc_feature (2355)..(2355): n is a, c, g, or t
ctttcctagaaaccaaacagctgcggaacttacaaatgtccgtttggtttctgtgcgctctctctttattgtttcaaggcttttgaaataattatcttttttggtcgctacacatatcgttttggacccgttaaaggaaatattcattccttggtaacatctaaactatggaggcatcgcatgagaatcaaagtggaggcaatattccctcgggaaaattgtgcactaacattgatccattgaattgggtatcagcttcggagtcgttgaaggggagccatttggatgaagtgaagaggatggttagcgagtaccggaagccggtggtgaggctaggcggcgagaccctgacgatagctcaggtggcggcggtggctagccgtgatgacggggtcacggtggagcttaacgaggaggcnagggctggcgtcaaggctagcagtgattgggttatggagagcatgaacaangggacagatagctatggtntcacgactggttttggtgcaacttctcataggaggaccaaacagggagctgccttgcaaaaggagctcattaggtttttgaatgctgggatctttggcaaagggacagaatcctgtcacatgttgccccacacagcaacaagagctgcaatgctggtgaggatcaatncacttctccagggctactcaggcattagatttgagattcttgaagctataacaaagtttctcaatcgcaacattactccatgcttgcctctgcgtgcctccatcactgcctccggcgatttagtccccttttcgtacatcgccgggctgctaaccggccgtccgaattctgtagctgttgggccaaatggggagtcgttgaatgctgctgaggcttttagccaggctggaattgatggaggtttcttcgagttgcagcctaaagagggacttgcgttagttaacggaacaggagtgggtgctggcttggcttctattgttctttttgaggctaatattttaactgttttgtccgaagttttgtcagcaatttttgcggaagctatgcaaggaaagcctgagtttacggatcatttgactcacaagctgaagcatcaccctggacaaattgaagctgcagctataatggaacatatcttggatggtagctcttatgttgaggcagcacaaaaattccatgaaattgaccctttacagaagcctaagcaagatcggtatgctcttcgaacttcaccacaatggttaggccctcaagctgaagtgattcgagcatcgacaaagtctattgagagggagattaactctgtgaatgataatccgttgattgatgtttcaaggaacaaggcattacacggtggcaatttccagggcactccaattggtgtctctatggataattcaagattggcaattgcttcgattgggaaactcatgtttgctcaattttctgagctggttaatgatttttacagtaatgggttgccttcaaatctgtctggtggtaggaatccangcttggattatgggttcaaaggtgccgaaatagcaatggctgcgtattgttccgagctccagtttctagccaatcctgtgactaatcacgtccaaagtgctgagcaacacaaccaagatgtgaactctttagggctgatctctgccagaaaaacagctgaagctgttgatatcttgaagctcatgtcctcaacttacttgattgcactctgccaagctatagacttgaggcacttggaggagaatctgaagagcacagttaagaacacaatcagccaagtagctaagaaagtcctgacgatgggggtcaatggggagctccatccttcaagattctgcgagaaagatttgctgaaagtagttgatcgcgagtacgttttttcatacgctgatgatccctgcagcgcaacttacccgttgatgcngaaactgagacaagtccttgttgatcatgcattgacaaacaatgaagatttgaagaatgcaaatgcttcaatcttcttaaagataggtgctttcgaggaggagttgaagacccttttgccgaaagaagttgagagtgctagaagtgcttttgagagtggtaatttggaaataccaaacaggattaaggagtgcaggtcctacccattgtataggtttgtaagggaagagttgggggctcggtatctgacaggagagaaggcgatatcaccaggcgaggaatgtgataaggtgtttacagcgatttgtcagggaaaaataattgatccactgcttgaatgtcttaaagaatgggatgggagtcctcttccaatttgttaatgctttcttttatgcctttttttttatatatattttaatgtcncttggaaggttaacaaatataattcttctactgtgaggatgatactgtctctatgcttttactttgtgttcttaattctatttttcccccttcttaaagtctgtaattttggtgaaatttatgtacagttgcaactcaataataagatgggcctttgataatcaatcgcaaaattg

SEQ ID NO: 5503 - DNA, 2365 bp, Lotus japonicus
ccaaactaacatttccacattcagctcaccaatctcttcctcattttcccttctcataactctagcaaacttagtccatttttcttaagataatcaatcttgtaagtgagagatcatatatactaagatggcaccaaccaccaacagcaaccacgagagcctaaatagttccatcttctgcactgctgctaaagcaggcagtgatcccttgagttggggtgtagcagcagattcgatgaaggggagccacctggatgaggtcaagcgcatggtggctgagtacaggaagcctgtggtcaagctaggcggggaaactctgacaatagctcaggtagctgccattgcagcaaacgaccaaggcgtaagcgttgagctgtgcgaatcagctagagctggcgttaaggcgagcagtgactgggtcatgaacagcatgaacaatggcactgacagttacggtgtcaccaccggcttcggcgccacctcccaccgtagaaccaaaaatggcaatgctttgcagctagaactcatcagttgttgatgtatatatcttcttgttcttcaggtttttgaatgctggaatatttggcaatggaactgagacaagtcacacactaccacagcctgcaactagagcagccatgctagtgaggatcaacacacttctccagggatactcaggcattaggtttgaaatccttgaagccatcaccaagctcatcaacaacaacatcaccccatgtttaccacttcgtgggactgtcacggcttctggtgatttggtccctctttcttacattgccggtttgcttactgggagacaaaactccaaagctgttggaccatccggcgaggtggttaatgccaaggaagctttccaattggctggcatagacacagggttctttgaattgcagcccaaggaagggcttgcccttgtgaatggtactgctgttggatcagggttagcttctattgttctatttgatgctaacgtattggctattctggctgaagttctatcagctattttcgccgaagtgatgcaagggaaacctgaattcactgaccatttgacacataagttgaagcaccaccctggccaaattgaggcggcagctatcatggaacacattttggatggaagttcctacatgaaagcagcaaagaagttgcacgaggtggatcctttgcaaaagccaaaacaagatcgatatgcacttagaacttcacctcagtggcttggccctctgattgaagtgattcgattctcaacaaagtcgatcgaaagagagattaactccgtgaatgacaaccctttgattgatgtttccagaaacaaggccttgcacggtggtaattttcaaggaacccctattggagtgtccatggacaacacacgtctggctcttgcagcaattggaaaactcatgtttgctcagttcactgagcttgtggatgatcattacaacaatggcttaccttcaaatctcactgctagtagaaatcccagcttggattatggtctaaagggagctgaaattgccatggcttcttattgctctgaactccaataccttgcaaatcctgtcacaacccatgtccaaagtgctgagcaacacaaccaagatgtgaactctttgggtttgatttcttctagaaaaaccaatgaggctattgagatccttaagctcatgtcttccacattcttgattgctctctgccaagcaattgacttgaggcatttggaggagaacttgaaacactcggtgaagagcactgtaagtcaagttgccaagaggactcttaccacaagtgtcaatggagaactccatccttccagattttgtgaaaaagatttgctgaaggtggttgatagggaaactctatttgcctatattgatgatccatgcagtgctacatacccattgatgcaaaaactaaggcaagttcttgtggatcatgcattagtaaatggagaaaacgagaagaactcgaagacatcaatctttcaaaagattgcaacttttgaggatgagttgaagagtctcttgccaaaggaggttgaaagtgcaagggctgcatatgagagtggaaatccaacaattccaaacaagatcaatgaatgcagatcttacccgctgtacaagtttgtgagagaggagttgggaaccgagttgctaaccggtgaaaagaccagatcaccaggcgaggagtgtgacaagttgttcacagcaatatgccagggtaaaattattgatcctcttttggaatgccttggggagtggaacggtgcccctcttccaatttgttaacttacaagttatgtttaggaaatgtattctctgtatttatgcaaatgcaatgt

SEQ ID NO: 5504 - DNA, 2414 bp, Brassica napus
gaggaacacaaaaccaaactccttcaccaacatttcaaaagctctcctctctttcatccttcaccaacaattcaaaagatctgttcctatttatcaaacactaactcaaaaaccaatggatcagatcaacggatcagttcaccaaaacggcaaaaccgaagccatgttgttgtgcggcggactagagaagactaaagtgacggtggcggcggatccgttgaattggggtgctgcggcggagcagatgaaagggagtcatttggatgaggtgaagaggatggttgaggattaccgtaaaccggtggtgaatctcggcggagaaacactgacgatcggacaagtcgctgcgatctcgaacgtaggcggtggcgttaaggttgagctagcggaggcttcaagagccggcgtgaaagctagcagcgattgggtcatggagagtatgggtaaaggtactgacagttacggtgtaaccaccgggtttggagctacctctcaccggagaacaaaaaacggcaccgctttgcaaaccgaactcatcaggtttttgaacgccggaatattcgggaacacgaaggagacatgccacacgctaccggaatccgccacgagagccgccatgctcgtccgagtcaacacactcctccaaggatactccgggatccgattcgaaatcctcgaagcgatcaccagcctcctcaaccacaacatctctccgtctctccccctccgtggaaccataaccgcctccggcgatctcgtccccctctcctacatcgccggtctcctcaccggccgtccaaactccaaagccaccggtcccaacggcgaatccctaaccgccgaggaagccttcaagaaagcgggaatcacttccggattcttcgatctacagcctaaggaaggcttagcgctcgtcaacggcacggcggttggatccggcatggcgtcgatggttctcttcgaagcgaatgttcaatcggtcctcgccgaggttttatccgcgatcttcgcggaggtgatgagcgggaagccggagttcaccgatcatttgactcaccgactcaaacaccaccccggacaaatcgaggcggcggcgatcatggagcacatcctcgacggaagctcgtacatgaagctagcggcaaagctccacgagatggatccgttacaaaaaccgaaacaagaccgttacgcgctccgcacgtctcctcagtggctcggccctcagatcgaagtgatccgtcacgccacgaagtcaatcgagcgtgagatcaactccgttaacgataatccgttaatcgacgtttcgaggaacaaggcgattcacggtggtaacttccaggggactccgataggagtctctatggacaacacacgtttagcggttgcagctattgggaagctcatgttcgctcagttctcggagcttgttaacgacttctacaacaacggtcttccttcgaatctaacggcttccaacaacccaagcttggattatggattcaaaggagcggagatcgctatggcttcttactgctctgagcttcagtaccttgcgaatccggttacaacccatgttcaatcagctgagcagcataaccaagatgttaactctttaggactcatctcgtctcgtaagacgtcagaagctgttgacattctcaagctcatgtctacaacgttcctcgtagcgatttgtcaagctgttgatttgagacatctcgaggagaatctgagacagaccgtgaagaacacggtttctcaagtggcgaagaaagtgttgactactggagtcaacggggagttgcatccatcgcggttctgtgagaaagacttgcttaaggtcgttgatcgtgaacaagtgtttacatacgttgacgatccttgtagcgctacgtacccattgatgcagaagctaagacaagttatcgttgatcacgcgttatccaatggtgagactgagaagaacgcagtgacttcgatctttcaaaagattggagcttttgaggaggagcttaagatggtgcttcctaaggaagtggatgcgactagagaggcttacggtaatggaacggcggcgattccgaacaggattaaggaatgtcggtcttatccattatataagtttgtgagggaagagctcgggacgaagttgctgaccggagaaaaggttgtctctccgggagaggagtttgataaggtgttcactgcaatgtgtgaaggtaagattattgatccattgatggattgtctcaaggaatggaacggagctcccattcccatatgttaagagagccttcctctgttatgctctgttctgttttgtccagcttcagttttgttgcttttgcttgtttgaaatttgagtgtaatgtcaatggtgtcactttgtataatatatatgaaaattacgt

SEQ ID NO: 5505 - DNA, 2666 bp, Brassica napus
caaccgttggatccttacaagtcatccaacgatcatcatatcgttaaactctcacccacccctcattgacaaaactcgttcacttctctttgttgtgcttacctaacattaaacactacttcattgtctccttatttaaaccaatcttctcccttctcttcttcctcaggaactcaacaaactccaaagcacttcacctacaattcaagaagctctctctctatctcgcttccttcacctttaattcaaaagaatctgatccctatatattaaacagaaaggtcaaatacctatggatcagactaacggttcagttcaccagaacggcaagatcgaagccatgttgtgcggtggagtagagaagacaaaagtggctgtggcggcggatccgttgaactggggtgcagcagcggaacagatgaaagggagtcacttggatgagttgaagaggatggttgaggagtaccgcagaccggtggtgaatctcgggggagagacgctaacaatcggacaagtcgcggcgatctccaccgcaggcggaggtgttaaggttgagctagcggaggcttcgagagctggcgtgaaagctagcagtgattgggttatggaaagtatgggcaaaggtactgacagttacggtgtcaccaccgggtttggagcgacctctcaccggagaaccaaaaacggcaccgcattgcaaacggaactcatcagatttttgaacgccggaatattcggtaacacgaaggagacatgccacacgctaccggaatccgccacgagagccgccatgctcgtccgagtcaacactctcctccaaggatactccgggatccgattcgaaatcctcgaagcgatcaccagcttcctcaaccacaacatctctccatctctccccctccgtggaaccataaccgcctccggcgatctcgtccccctctcctacatcgccggcctcctcaccggccgtccgaactccaaagccacaggtcccaacggcgaatccctaaccgccgaagaggccttcaaacaagccggaatcgcttccggattcttcgatctacaacccaaggaaggcttagcgctcgttaacggcacggcggttggatccggcatggcgtcgatggttctattcgaagcgaacgttcaatcggtgttagcggaggtcttatccgcgatcttcgcggaggtgatgagcgggaagcctgagttcaccgatcatctaacgcacaggctgaagcaccaccccgggcaaatcgaagcggcggcgatcatggagcacatcctcgacggaagctcgtacatgaagctagcgcagaagcttcacgagatggatccgttacaaaagccgaaacaagaccgttacgctctccgtacctctcctcagtggctcggccctcagatcgaagtgatccgtcacgcaacgaagtcgatcgagcgtgagatcaactccgttaacgataatccgttgatcgatgtttctagaaacaaagcgattcacggtggtaacttccaggggactccaatcggagtctccatggataacactcgtttagcgattgcttcgatagggaagctcatgttcgctcaattctcggagcttgttaacgatttctacaacaacggtcttccttcgaatctaacggcttcgaacaatccaagcttggattacggattcaaaggagctgaggtcgctatggcttcgtattgctctgagcttcagtacttggcgaatccagttacaagccatgttcaatcagctgagcaacataaccaagatgtgaactctttgggactcatctcgtctcgcaaaacgtcagaagctgttgacatcctcaagcttatgtcggcaacgttccttgtggctatatgccaagctgttgatttgagacatcttgaggagaatctgagacaaacggtgaagaacacagtttctcaagtggcgaagaaagttttaaccactggagtctacggtgagctgcatccgtcgcggttctgcgagaaggacttgcttaaggtcgttgatcgcgagcaagtgttcacgtacgtggatgatccttgtagcgctacgtacccgttgatgcagaaactgagacaagttattgttgatcatgctttgtctaacggtgagactgagaagaacgcagtgacttcgatctttcaaaagatcggagctttcgaggaagagctcaagatggtgctccctaaagaagtggatgcggctagagaggcttacggtaacggaacggcggcgattccgaacaggattaaggaatgtcggtcttacccgttgtataagttcgtgagggaagagcttggaacgaagctgttgaccggagaaaaggttgtgtctccgggagaggagtttgataaggtgttcactgcaatgtgtgaaggtaagatcattgatccgttgatggagtgcctcaaggaatggaacggagctccgattccgatatgctaagacatcattcctctgtttttttgttgcttttacctttttatatgtttgaattgagtgttttatcagtgagtaattgtaatgtgaatggtgtcactttgtatgatatatatgaaaatcacgtgtaactatttgtggattcgacagagttgacaaaagagttagatcaatacttcttatttattgtctggtagtttcaaaatgt

SEQ ID NO: 5506 - DNA, 2507 bp, Gossypium hirsutum
  misc_feature (1604)..(1604): n is a, c, g, or t
  misc_feature (1617)..(1618): n is a, c, g, or t
  misc_feature (1639)..(1639): n is a, c, g, or t
  misc_feature (1665)..(1665): n is a, c, g, or t
  misc_feature (1667)..(1667): n is a, c, g, or t
  misc_feature (1673)..(1673): n is a, c, g, or t
  misc_feature (1676)..(1676): n is a, c, g, or t
  misc_feature (1679)..(1679): n is a, c, g, or t
  misc_feature (1780)..(1780): n is a, c, g, or t
  misc_feature (1842)..(1842): n is a, c, g, or t
  misc_feature (1907)..(1907): n is a, c, g, or t
  misc_feature (2365)..(2365): n is a, c, g, or t
ctttccctgaaaaatttcctttccatttcaagaaggaaaagaaaattctttagttccaaaacttcccagacgccaaacattagccatttgaatcaatggaaccaatggagttacagttttgtaatggcggaaacggttcgtcactggccgaccccttgaactgggccgcgtcagctcagtcaatgaaaggtagccatctggatgaagtgaagcgcatggttgaggagtacaagaaaccggtggttcgtctcggtggtgagacgttaacgatagctcaagtcacggccattgcgaaccgcgacgtcgccgttcaggttgagctctcggaggcggctcggccggccgttaaggccagcagtgattgggttatggaaggaatgaatcgaggtacggacagttatggtgtcaccactggctttggtgcaacatctcatcggagaactaaacaaggcggtgccctccaaaaggagcttataaggttcttgaatgctggagttttcgggcaaggaaccgagtcatgccattctttgccacacactgcaacgagggcagccatgcttgtgcggatcaacactctgttgcaaggctattccggcattagatttgagatcctagaagccattactaagctcctcaacgtcaacatcactccatgtgtgccactcaggggttcaatcactgcatccggtgacctggttccactttcctacattgctggccttttgactggcaggccaaactctaaagctttaggacctaatggtgaaacattgaatccaactgaagcctttagcaaagctgggatcaatggtgggttctttgagttgcaaccaaaagagggtttggctatggttaatggaaccgctgttgggtctgggttagcttccttggtcctttttgaagctaatgtattggctgttctctcagaagttctgtcagccatttttgctgaagttatgcaagggaaacctgaatttacagaccatttgactcacaaattgaagcatcatccaggtcagattgaagctgctgcaattatggaacatattttgagtggtagctcttacattaaagcagcacaaaaattgcatgaactggatccgttgcagaagccaaagcaagaccgatatgctcttcgaacatcgcctcaatggctcggtcctcagatcgaaactatcaggtttgcaaccaaaatgatcgaaagagagatcaattcagtgaacgacaatcccttgattgatgtctcaagagataaggccttacatggagggaacttccaaggtactccaattggtgtatcaatggacaacactcgtttagctattgctgcaattggcaaactcatgtttgctcaattctctgagcttgttaatgattactacaacaatgggttaccttcgaacttgtcagcaagccggaacccgagcctggattatggtttcaagggggcggaaatcgcgatggcttcgtactgctctgagcttcaataccttggcaaccctgtcaccaaccatgtgcaaagtgctgagcaacataaccaagatgtgaactctttaggcttaatctcagcaagaaaaacagctgaagctattgacatattgaanctcatgtcttcanntttcttggttgccttatgccnagccattgatttgaggcatttggaananaatttnaanaanactgtgaagaacacagttagccaagtggctaaaagagtcctaacaatgggatccaatggtgaactccacccatcgagattctgtgaaaaggaccttctacnagtcgtcgatcgcgaatatctctatgcctacgccgacgacccttgcagtgcaaattaccccntaatacagaaactgagacaagtactagtagaccatgcattgatgaatggtgacagagaaaaagantccaccacttcaatcttccaaaagattggagtctttgaagaagagctgaaaacccaattgcctaaagaagtcgaaagcgcccgaaccgaattcgagaacgggagtccggctatcgcgaacaagatcgaagaatgcaggtcctacccattgtacaagtttgtgagggaagttcttgggactcatttgttaacaggtgagaaagtgatttcaccaggagaagaatgtgacaaggttttcacagcaatgtgtgcagggaagttgattgatccgttgctggattgcttgaaagactggaatggtgctcctttgcccatatgctaaaaagggtgtttcttttctcaaagtttgagagcgacaacaaagccacactgttctataagttctttaacctgtgctcatatataaagacatatatatagcttgtttaagtttttcattcgaaaaatttgtgaaaaacnagaactgctgctgtttttagtgacttgttcttttcttttcttttctttttggggaatttaattacttgcattaaatgtttctttgtatcaagacgttgattacagcaaaatgaaatgaatatataagatactgtttctaccc

SEQ ID NO: 5507 - DNA, 2404 bp, Camellia sinensis
gcctcagcctcagctcaccatatattcattcatttagtatatattgatttcccatttcacatatattcatttagtatatgtaacccatctcatctcatctctctctaaatccctcttcattttcgttgctcaaaaaaacgttttctctgtgtttttctgttgacgatggagttttgtcacgaaaatggcaacgggaatggccacgtgattaaagatccattgagttgggaattagccgcggactcaatgaaggggagccacttggatgaagtaaaaaggatggtcagagagtttcgccagccggccatccgcctaggcggggagaccctcaccatttctcaggtggcggccgtggcggcgggatgcctgccggtggagctcagcgaggccgccagagccgccgttcaagcaagcagtgagtgggttatggagagcatgaataaaggaacagatagttatggggttaccactgggtttggtgctacttctcataggaggactaaacaaggtggtgcccttcaaaaggagcttatcagatttttgaatgctggaatatttggaaatgggacagagtcatgccacacattgcctcactcatctacgagggctgcaatgttggtgagaatcaacacactccttcaaggctactctggcatcagatttgaaatccttgaagccctcacaaaactcatcaaccacaacatcactccatgcttgcctctccgcggcacaatcaccgcctctggcgacctagtccccctatcttacatcgccggggttctaacgggccggcccaactcgaaatgtgttgggcccactggagaaccccttgatgccactgaagcattccgtcgggccggtattgatggcgggttttttgagttgcagcccaaagaaggccttgcacttgtcaatggcacagctgttgggtctggattggcctcaattgtcctctttgatgccaatgtattagccgttttgtctgtagttttgtcagcgattttcgccgaggttatgcaagggaaaccggagtttacggaccatttgacacacaaattgaagcaccatcctggccaaattgaggctgcagctataatggaacatgttttagatggtagttcttatgtcaaggcagcccaaaagttgcatgaaatggacccacttcaaaagcccaaacaagaccggtacgctctccgaacctcccctcagtggttaggtccactgatcgaagtcattcgatcatcgaccaaatccattgagagggagataaattcggtgaacgacaaccccttgatcgacgtgtctaggaacaaggccttacatggtgggaatttccaaggcaccccgattggtgtctcaatggacaacactaggctagctttggcatcaattgggaaactcatgtttgcacaattttcagagctagtgaatgacttttacaataatggcttgccttcaaatctgtccggtgggcgaaaccctagcttggattacgggtttaagggcgcagagatagctatggcggcctattgttctgaactccaatttcttgctaacccggtcacaaaccatgtccaaagcgctgagcaacacaaccaagatgtgaactctttggggctaatctcttcacgaaaaacagccgaagcgatcgatatcttgaagctcatgtcatctacctacttggttgggctttgccaagccattgatttgaggtatttggaggagaatttgaagaacacagtgaggaacacagtgagccaagtggctaagaaagtcctcacaatgggcatcaatggggagcttcacccttcaaggttttgtgagaaggacttgattaaagttgttgatcgcgagcacattttcacatatatcgatgacccatgcagtgctacatacccattgatgcagaaactaagacaagtccttgtcgatcacgctttgatcaacaacgatgacaccaagaacatgaacgcatccatctttttaaagattggagcttttgaggaagaattaaagacccaattgccaaaggaagttgagtgcacaagaagtgctttggagagtggaaatccaacgattccaaacaggatcaaagattgtagatcttacccattgtacaagtttgtgagggaggaattggggactgggtttttgacaggagagaagatcgtgtcgccgggtgaggaattcgacaaagtttttactgcgatttgcaatgggaagatgatcgatccgctgctcgaatgtctcaaggaatggaacggtgctctccttccaatatgttaagatcatcatgagaccaaaaaactgttcaaatttctgttatttactgttacaactgtttttgtattttggattatataatgggattactgtcattagtcttttaatattaagctgtgtc

SEQ ID NO: 5508 - DNA, 1773 bp, Brachypodium distachyon
cggagcagcagccacgtaccgaccacccgtcgtccgtacaccctcgaaaacggcccgcgctggccacacgtagacggacacgccccgcaccgcatcctgaagtcggccgtgacctcatcccgaccgtgcaaccaaatcctgtaataaaatcccgcgccgctgtgaagccaagccagcggcaccttcctggaaaggccgcaagagccagcaccacacgtgcccatttcctccccaaggaaccccctccacgcagccgcctagcgttcctccccagcccactccgccgaagcttccagacccccccctcccccctcccctatttatcccccctcgaatcctcactcccttttctcattcaacgcccatcaccacacactcacagcgtagctcagccaaaggaagcagcaaaggcagagagattcaacgatcgacctgattcgattcgaagcaagcaaagcaactcccaacaacaacaacaaacagaggatcgtggggatggcagtgagaggcaccaggagggagcgtgacgcggaggcggagctgaacctgccgccggggttccgcttccacccgacagacgacgagctcgtcgagcactacctatgccggaaagccgcggggggccgtctgccggtgccgatcatcgccgaggtcgacctctacaagttcgacccgtgggcgctgcccgacagggcgctcttcgggaccaaggagtggtacttcttcaccccgagggaccgcaagtaccccaacgggtcccgccccaaccgcgccgccggcaacgggtactggaaggccacgggcgccgataagcccgtcgcgccccatggacgcaccttggggatcaagaaggccctcgtgttttatgctgggaaggctcccaaaggggttaagactgattggatcatgcatgagtaccgcctcgctgatgctggccgcgccgccgccgccggtgccaagaaggggtccctcaggttggatgattgggttctgtgccggctgtacaacaagaagaacgagtgggagaagatgcagatgcagcagcagctggtgggggcgaaggaggccacgaagcaggagtcgtcggacatggtgatcacctcgcactccaacaacaacaacaactcgcagcagtcgcactcgtggggcgaggcgcgcacgccggagtcggagatcgtggaccacgacgacccgtcttccttcccggcggcgttccagagccccgcggcgcaggagatgctggccaccatgatggtgcccaagaaggaggcggcggacgacgccggcgccggggcaggcaggaacgacctgttcgtggacctcagctacgacgacatccagagcatgtacagcggcctcgacatgatgccgccgggcgacgacctcctctactccaccctcttcgcgtcgcctagggtcaggggcaccaaccaggccggcgccggcgtcggcggcatgccgggccccttctgagcgcagacgagctagcagagaagaagaaccagagaccagagacaagtgccagtcgagtttcctcctggctgctacgagcgagcttgcagaccactgtaaatacggcataggagacggggagagaggtcgtgttcgtcggggcggccgtggcctggtgcggctccggcgccggggcgtgttgtatatgtggagcccggcgccggcgctgggtcattcttttgtttttaccctttcactcacatacgtatatgtagctcttgctcatcctctccaatagaatcgaaccgaccagaccagacc

SEQ ID NO: 5509 - DNA, 495 bp, Phaseolus coccineus
  misc_feature (69)..(69): n is a, c, g, or t
  misc_feature (114)..(114): n is a, c, g, or t
  misc_feature (137)..(137): n is a, c, g, or t
gagatgtcggatgcgccagccagcccgagtcacgagagtgggggcgagcagagcccgcgcggttcctcntctgggccagggagcaggaccgctaccttcctattgccaacatcngccgcatcatgaagaagggtctncctcccaacggcaagattgctaaggacgccaaagataccatgcaagaggcgagtgagaaatgtcagaaagagaagagaaagactattaatggagacgatttgttatgggcaatggccactttaggttttgaagactacatagagccgcttaaggtgtacctggcaaggtacagagaggcggagggtgacaccaaaggatctgcaagaggtggtgatggatctgctagaccagatcaagttggccttgcaggtcaaaattctcagcttgttcatcagggctcactgaactatattagtttgcaggtgcaaccacaacatatggttttgccttcaatacaaagccatgaatagtgtagat

SEQ ID NO: 5510 - protein, 240 aa, Brachypodium distachyon
MKLVVLSALLLLSLVAVSSAEEFDFFYLVQQWPGSFCDTKKGCCFPDTGKPAVDFGIHGLWPNYAACKTRGELDGALEMVTKRKKKCWPENCNSERLKLWEIKDLVTELDANWPTLACKGGKSIEFWTHEWEKHGTCSNLDQHGYFATALGFKARHNLTGILADAGIVPSDSETYFLSSIRDAIKEGTGFTANLECNRGVAGETQLFQVYQCIDRAGENLIDCPLPMQGNCKDRVQLPAF

SEQ ID NO: 5511 - protein, 240 aa, Leymus cinereus x Leymus triticoides
MKLVVLSALLLLSLLAVSSAEEFDFFYLVQQWPGSFCDTKKGCCFPDTGKPATDFGIHGLWPNYAKCKTRGELDGALEMVTKRKKKCWPESCNSERLKLWEIKDLVKELDANWPTLACKGGKSIEFWTHEWEKHGTCSNLDQHGYFATALGFKARHNLTGILADAGIVPSDSETYFLSSIRDAIKEGTGFTANLECNRGVAGETQLFQVYQCIDRAGENLIDCPLPMQGNCKDRVQLPAF

SEQ ID NO: 5512 - protein, 241 aa, Triticum aestivum
MKLVVVLSALLLLSLLAVSSAEEFDFFYLVQQWPGSFCDTKKGCCFPDTGKPATDFGIHGLWPNYAKCKTRGELDGALEMVTKRKKKCWPENCNSERLKLWEIKDLVTELDANWPTLACKGGKSIEFWTHEWEKHGTCSNLDQHGYFATALGFKARHNLTGILADAGIVPSDSETYFLSSIRDAIKEGTGFTANLECNRGVAGETQLFQVYQCIDSAGENLIDCPLPMQGNCKDRVQLPAF

SEQ ID NO: 5513 - protein, 240 aa, Triticum aestivum
MKLFVLSALLLLSLVAVSSAEEFDFFYLVQQWPGSFCDTKKGCCFPDTGKPATDFGIHGLWPNYAKCKTRGELDGALEMVTKRKKKCWPENCNSEPLKLWEIKDLVTELDANWPTLACKSGKSIEFWTHEWEKHGTCSNLDQHGYFKTALGFKARHNLTGILADAGIVPSDSETYFLSSIRDAIKEGTGFTANLECNRGVAGETQLFQVYQCIDRAGKNLIDCPLPMQGNCKDRVQLPAF

SEQ ID NO: 5514 - protein, 241 aa, Pseudoroegneria spicata
  misc_feature (120)..(120): Xaa can be any naturally occurring amino acid
  misc_feature (227)..(227): Xaa can be any naturally occurring amino acid
MKLVVVLSALFLLSLVAVSSAEEFDFFYLVQQWPGSFCDTKKGCCFPDTGKPATDFGIHGLWPNYAKCKTRGELDGALEMVTKRKKKCWPESCNSEPLKLWEIKDLLKELDSNWPTLACXSGKSIEFWTHEWEKHGTCSNLDQHGYFATALGFKARHNLTGILADAGIVPSDSETYFLSSIRDAIKQGTGFTANLECNRGVAGETQLYQVYQCIDRAGENLIDCPLXMQGNCKDRVQLPAF

SEQ ID NO: 5515 - protein, 246 aa, Avena sativa
MKLVALSVLLLLSLVAVSSAEEFDFFYLVQQWPGSFCDTKKGCCFPDTGKPAADFGIHGLWPNYAKCKTRHDLLVDGAAPGLEMVTKRKKKCWPEFCNNGEPLKIAAIADLLKQLEANWPTLACKSGKSFDFWSQEWKKHGTCSDLGQHGYFATSLGFKAQHNLTAILADAGIVPSDDKTYFLSSIKDAIKEGTGFTANIECNRGVAGETQLFQVYQCVDRAGENLIDCPLPMTGNCKDRVQLPAF

SEQ ID NO: 5516 - protein, 381 aa, Pseudoroegneria spicata
MDGKDYTTPPTAPGAPPHSYPPTHHAMDGKDATAPQPGAPPHPSSPQTQQAMEMEGAYAAPQPGSGAPPHPSSPKTQQAMEMEGKYAAPQPGTGATPPSSSPLAQQSMDGKDAAPAPPADAQEPGESAKRGTRQMGPPAAPGAHPENQQAAQWTASRGDQELPPYVMGGPEPAQAASARQTDKETKDGPMEHILDFFNIWSRKAEELSSNIWLNLKTAPSMSDAAMGKLSLGAKAITGGGFEKLYKQTFASGPDEHVKKTFACYLSTATGPVAGTLYLTNMNVAFCSDRPLSFAAPSGQTAWSYYKIMIPLAKLATVEPVTAKESPPERYIHIVTVDSHDFWFMGFVSYDKAVHHLSGAVSSSQHHGAAPAAAPAPAPTYE

SEQ ID NO: 5517 - protein, 413 aa, Triticum aestivum
VSHLRFQINHRHHHLPAPRAHAPPAPQHQHHQLAAMDGKGYTTPPTAPAAQAEAGAPPHSYPPTQHGNDAAAPQPGSQVSYPSMEHAMDGLDATAPQPGAPPHPSSPLTQQAMEMEGKYAAPQPGTGAPPPSSSPLAQQSMDGKDAAPAPPADAESAKWGTRQMGPPAAPGAHPENQQAAQWTASRGDQELPPYVIMGGPEPAPAASTRRTDKETKDSPMEHILDFFNVWSRKAEELSSNIWLNLKTAPSMSDAAMGKLSLGAKAITGGGFEKLYKQTFASGPDEHVKKTFACYLSTATGPVAGTLYLTNMNVAFCSDRPLSFTAPSGQTAWSYYKIMIPLAKLAAVEPVTAKESPPEKYIHIVTVDSHDFWFMGFVSYDKAVRHLGGAVSSSQHHGAAPAAAPAPAPTPTYE

SEQ ID NO: 5518 - protein, 418 aa, Triticum aestivum
LALSVPNPTTSIISLHPRAHASPVPQHQYQHHRLAMDDKDYATPPTAPAPQAEAGAPQHSYPPTHHAMDGKDATAPQPGPQVSYPLMEHAIDGLDATAPQPGAPPHPSSPLTQQAMEMEGKYAAPQPGTGATPPSSSPLMQQAVDGKDAAQAPPGASVPPAESARWGTRQMGPPAAPGAHPENQQAAQWTASRGDQELPPYVIMGGPEPAAAASARRTDKETKDSPMEHILDFFNVWSRKAEELSSNIWLNLKTAPSMSDAAMGKLSLGAKAITGGGFEKLYKQTFASGPDEHVKKTFACYLSTATGPVAGTLYLTNMNVAFCSDRPLSFTAPSGQTAWSYYKIMIPLAKLAAVEPVTAKESPPEKYIHIVTVDSHDFWFMGFVSYDKAVHHLGGAVSSSQHHGAAPAAAPAPAPTYE

SEQ ID NO: 5519 - protein, 619 aa, Triticum aestivum
MATNPGLFSEWPWKRLGSFKYVVLAPWVAHGVQQVATKGWREADLGYLVILPSMMLRGLHNQAWITVSRLQNARGKRQIVDRGIEFEQIDRERNWDDQIILSAILFFLGALHLPGAQNLPLWRTDGAVLIALLHAGPVELIYYWFHRALHHHFLYTRYHSHHHASIVTEPITSVIHPFAELVAYELLFSIPMIACALTGTASIMTFELYMLYIDFMNNMGHCNFELVPSWLFTWFPPLKYLMYTPSFHSLHHTQFRTNYSLFMPFYDYIYNTMDKSSDTLHEKSIESKEEAVDVVHLTHLTSLQSIYHMRPGFAEFASKPYASKWYMRIMWPLSWLSMVLTWTYGSWFTAERNVMKKLRIQSWAIPRYNFHYGLNWEKEALNNLIVKAICEADKKGAKVVSLGLLNQAQSLNGSGELYLQKYPKLGLKLVDGTSLAAAVVANSIPQGTDQVVLSGNISKVACAVAAALCKKNIKVIITNKQDYHFLQPKIPEDAADNLLLSKTGIAKVWIIGEGADATEQLRAPKGTRFIPYSQFPPRMARKDGCTYSTTPAMSVPKTLQNVHSCENWLPRWVMSAWRVAGIVHALEGWDEHECGDMVLDMDKVWSAALLHGFRPVAEA

SEQ ID NO: 5520 - protein, 619 aa, Triticum aestivum
MATNPGLFSEWPWKMLGSFKYVVLAPWVAHGIQQVATKGWREADLGYLVILPSMILRGLHNQAWITVSRLQNARGKRQIVDRGIEFEQIDRERNWDDQIILSAILLFLGALHLPGGQNLPLWRTDGAVLLALLHAGPVEFLYYWFHRALHHHFLYTRYHSHHHASIVTEPITSVIHPFAELVAYELLFSIPMIACVLTGTASIMTFELYMLYIDFMNNMGHCNFELVPTWLFTWFPPLKYLMYTPSFHSLHHTQFRTNYSLFMPFYDYIYNTMDKSSDTLHEKSIESKEEAVDVVHLTHLTSLQSIYHMRPGFAEFAAKPYASKWYMRIMWPLSWLSMVLTWAYGSWFTVERNVMEKLKIQSWAIPRYNFHYGLNWEKEAINNLIVKAICEADKKGAKVVSLGLLNQAQSLNGSGELYLQKYPKLGLKLVDGTSLAAAVVVNSIPHGADQVVLSGNISKVACAVAAALCKKNIKVIITNKQDYHFLQPKIPEDAADNLLLSKTGMAKVWIIGEGADATEQLRAPKGTRFIPYSQFPPRMARKDGCTYSTTPAMSVPKTLQNVHSCENWLPRRVMSAWRVAGIVHALEGWDEHECGDTVLDMDKVWSAALLHGFRPVAEA

SEQ ID NO: 5521 - protein, 619 aa, Brachypodium distachyon
MATNPGFLSEWPWKRLGSFKYLVLAPWVAHGFHQLATKGWRETDLGYIAILPSMLLRALHNQAWITVSRLQNARGRKQIVDRGIEFEQVDRERNWDDQIILSAILFYLGALHLPGGQHLPLWRTDGAVLVALLHAGPVELLYYWFHRALHHHFLYTRYHSHHHASIVTEPITSVIHPFAELVAYELLFSIPMIASALTGTASIVAFEMYMLYIDFMNNMGHCNFELVPTWLFRWFPPLKYFMYTPSFHSLHHTQFRTNYSLFMPFYDYIYNTMDKSSDKLHENSLKNKEEAVDVVHLTHLTSLQSIYHMRPGFAEYASKPYTSKWYMRIMWPLSWLSMVLTWVYGSWFTVERNVMKKLRIQSWAIPRYNFHYGLNWEKEAINSLIIKAIHEADKNGAKVVSLGLLNQAQSLNGSGELYLQKYPKLGVKLVDGSSLAAAVVANSIPQGTDQVVLAGNISKVARAVATALCKNNIKVIMSNKQDYHFLKPKIPEDAADNLILSKTSIAKVWVIGEGLDTAEQFRAPKGTHFIPYSPFPPRAVRKDCCTYSTTPAMGVPKTLQNVHSCENWLPRRVMSAWRIAGIIHALEGWNEHECGDTVLDMDKIWSAAILHGFCPVAQA

SEQ ID NO: 5522 - protein, 619 aa, Cenchrus ciliaris
MATNPGLFTEWPWKKLGNFKYLLLAPWVAHGGYLAATKGWRAADVGYLAILPSLLLRALHNQAWITVSRVQNARSRRQIVDRGIEFEQVDRERNWDDQILLSGILLYLGALYMPGGQHLPLWRADGFLLIALLHAGPVEFLYYWFHRALHHHFLYTRYHSHHHASIVTEPITSVIHPFAELVAYELLFAIPLITCALSGCASIIAFEIYVLYIDFMNNMGHCNFELVPNWLFKWFPPLKYLMYTPSFHSLHHTQFRTNYSLFMPFYDYIYNTMDKSSDALYEKSLKDKEETVDVVHLTHLTSLQSIYHMRPGFAEYASKPYTSKWYMRMMWPVSWLSMVLTWTYGSSFTVERNVMKKLKMQSWAIPRYSFHYGLTWEKEAINNLIEKAICEADKKGAKVVSLGLLNQAHNLNGNGELYLQKYPKLGVRLVDGTSLAAAVVVNSIPQGTDQVVLAGNISKVARAVAAALCKKNVKVVMTNKQDYHFLKPNMPEDAVDNFLFSKTATAKVWLLGEGLDASEQFKAQKGTQFIPYSQFPPRMVRKDSCTYSTTPAMAVPKTLQNVHSCENWLPRRVMSAWRIAGMVHALEGWNDHECGDIVLDMEKVWSAALLHGFRPVAQV

SEQ ID NO: 5523 - protein, 620 aa, Panicum virgatum
MATNPGPFTEWPWKKLGNFKYLLLAPWVAHGGYLAATKGWRAADPGYLAILPSLLLRALHNQAWITASRVQNARSRRQVVADRGIEFEQVDRERNWDDQIILSGILLYLGALYLPGGQRPPLWRADGFLLIALLHAGPVEFLYYWFHRALHHHFLYTRYHSHHHSSIVTEPITSVIHPFAELVAYEVLFAIPLITCALTGTASIVAFEIYVLYIDFMNNMGHCNFELVPSWLFKWFPPLKYLMYTPSFHSLHHTQFRTNYSLFMPFYDYIYNTMDKSSDTLYEKSLKAKDETVGVVHLTHLTSLQSIYHMRPGFAEYASKPYTSKWYMRMMWPVSWLSMVLTWTYGTSFAVERNLMKKLRMQSWAIPRYSFHYGLSWEKEAINNLIEKAICEADKKGAKVVSLGLLNQAHNLNGNGELYLQKYPKLEVRLVDGTSLAAAVVVNSIPQGTDQVVLAGNISKVAHAIAAALCKKNVKVVMTNKQDYHFLKPNMPEDAAENLLFSKTPTAKVWLIGEGLDASEQFKAQKGTQFIPYSQFPPKMVRKDSCTYSTTPAMSVPKTLQNVHSCENWLPRRVMSAWRIAGMVHALEGWNEHECGNSVLDMEKVWSAALLHGFCPIAQV

SEQ ID NO: 5524 - protein, 621 aa, Oryza sativa
MATNPGLFTEWPWKKLGSFKYVLLAPWVAHGWYEVATKGWREVDLGYIAILPSLLLRMLHNQAWITISRLQNARGRRQIVRRGIEFDQVDRERNWDDQIILSGILLYLGALYVPGGQHLPLWRTDGAGLIALLHAGPVEFLYYWFHRALHHHFLYTHYHSHHHSSIVTEPITSVIHPFAELVAYELLFSIPLIACALTGTASIIAFEMYLIYIDFMNNMGHCNFELVPSWLFTWFPPLKYLMYTPSFHSLHHTQFRTNYSLFMPFYDYIYNTMDKSSDTLYENSLKNNEEEEAVDVVHLTHLTTLHSIYHMRPGFAEFASRPYVSRWYMRMMWPLSWLSMVLTWTYGSSFTVERNVMKKIRMQSWAIPRYSFHYGLDWEKEAINDLIEKAVCEADKNGAKVVSLGLLNQAHTLNKSGEQYLLKYPKLGARIVDGTSLAAAVVVNSIPQGTDQVILAGNVSKVARAVAQALCKKNIKVTMTNKQDYHLLKPEIPETVADNLSFSKTGTAKVWLIGDGLDSAEQFRAQKGTLFIPYSQFPPKMVRKDSCSYSTTPAMAVPKTLQNVHSCENWLPRRVMSAWRIAGILHALEGWNEHECGDKVLDMDKVWSAAIMHGFCPVAQG

SEQ ID NO: 5525 - protein, 619 aa, Sorghum bicolor
MATNPGLFTEWPWKKLGNFKYLLVAPWVAHGVYLVATKGWKAADLGYMAIFPSLLLRMLQNQVWITVSRLQNARGRRQIVDRGIEFEQVDRERNWDDQILLSGILMYLGFMYIPGGQHLPLWRTDGAVLIALLHAGPVELIYYWFHRALHHHFLYTRYHSHHHASIVTEPITSVIHPFAELVAYELLFSIPLFVCIFNGTASILAFVIYVSYIDFMNNMGHCNFELVPNWLFKWFPPLKYLMYTPSFHSLHHTQFRTNYSLFMPFYDYIYNTMDKSSDTLYEKSLKGKEETVDVVHLTHLTSLHSIYHMRPGFAEYASRPYASKWYVRMMWPMSWISMVLTWTYGSSFTVERNVMKKLKMQSWAIPRYSFHYGLTWEKEAINSLIEKAICEADKNGAKVVSLGLLNQAHNLNGNGELYLQKYPKLGVRLVDGTSLAAAVVMNSIPQGTDQVVLAGNISKVARAVATALCRKNIKVVMTNKQDYHFLKPSMAEDAAENLLFSKTATAKVWLIGEGLDASEQFKAHKGTQFIPYSQFPPRMARKDTCTYSITPAMAVPKTLQNVHSCENWLPRRVMSAWRIAGMVHALEGWNEHECGDIVLDMEKVWSGALLHGFRPVAQV

SEQ ID NO: 5526 - protein, 619 aa, Zea mays
MATNPGLFTEWPWKKLGNFKYLLLAPWVAHGGYQAATKGWRAADLGYVAILPSLLLRALHNQAWITASRLQSARGRRQVVDRGIEFEQVDRERNWDDQILLSGILLYLGSTYLPGGQHLPLWRADGAALIALLHAGPVELVYYWLHRALHHHFLYSRYHSHHHASIVTEPITSVIHPFAELVAYELLFSIPLIVCTLNGTASIIAFEIYVIYIDFMNNMGHCNFELVPNWLFKWFPPLKYLMYTPSFHSLHHTQFRTNYSLFMPFYDYIYNTMDKSSDTLYEKSLKGKEETADVVHLTHLTSLHSIYHMRPGFAEYASRPYTAKWYVRMMWPMSWLSMVLTWSYGSSFTVERNVMKKLKMQSWVIPRYSFHYGLSWEKEAINSLVEKAICEADKKGAKVVTLGLLNQAHNLNRNGELYLQKCPKLGVRLVDGTSLAAAVVVNSVPQGTDQVVLAGNISKVARAVAAALCRKNIKVVMTNKQDYHFLKPNMAEDAAENLLFSKTTTAKVWLIGDGLDASEQFKAQKGTQFIPYSQFPPRMARKDTCTYSTTPAMVVPKTLQNVHSCENWLPRRVMSAWRIAGMVHALEGWNEHECGDIVLDMEKMWSGALLHGFRPVAQV

SEQ ID NO: 5527 - protein, 620 aa, Panicum virgatum
MATNPGPLTEWPWKKLGNFKYLLVAPWVLHGWYLAATKGWRAADPGYLAIFPSLLLRAAHNQAWITASRVQNARSRRQIVADRGIEFEQVDRERNWDDQILLSGILLYLGALYMPGGQHPPLWRADGFLLIALLHAGPVEFLYYWFHRALHHHFLYTRYHSHHHSSIVTEPITSVIHPFVELVAYEVLFAIPLITCALTGTASILAFEIYVIYVDFMNNMGHCNFELVPSWLFKWFPPLKYLMYTPSFHSLHHTQFRTNYSLFMPFYDYIYNTMDKSSDALYEKSLKAKEDTVDVVHLTHLTSLQSIYHMRPGFAEYASKPYTSKWYMRMMWPVSWLSMVLTWTYGTSFAVERNIMKKLKMQSWAIPRYSFHYGLTWEKEAINNLIEKAICEADKKGAKVVSLGLLNQAHSLNGNGELYLRKYPKLEVRLVDGTSLAAAVVVNSIPQGTYQVVLAGNISKVARAVTAALCKKNVKVVMTNKQDYHFLKPNMPEDAAENLLFSKTPTAKLWLIGEGLDASEQFKAQKGTQFIPYSQFPPKMVRKDSCTYSSTPAMSVPKTLQNVHSCENWLPRRVMSAWRIAGMVHALEGWNEHECGDSVLDMEKVWSAALLHGFRPIAQV

SEQ ID NO: 5528 - protein, 621 aa, Brachypodium distachyon
MATNPGILSEWPWKRLGSFKYLVLAPWVVHGCHLAATKGWRELDLGYVAILPSMLLRALHDQAWITVSRLYNARGKRQIVRRGIEFDQVDRERNWDDQIILSAILLLLGAVYLPGGQHLPLWRTDGAVLLALLHAGPVEFLYYWFHRALHHHVLYTRYHSHHHASIVTEPITSVIHPFAELLAYQLLFSIPMITCALTGTASIITFEIYVIYIDFMNNMGHCNFELVPNWLFEWIPPLKYLMYTPSFHSLHHTQFRTNYSLFMPFYDYIYNTMDKSSETLYQDSLKDKNEEKEVDVVHLTHLTSLQSIYHIRPGFAQYASRPYTSMWHLRIMWPVSWLSMVLTWSYGSWFTVERNVMGKLRMQSWAIPRYRFHYGLKQEKEAINDLIEKAISEADKKGTKVVSLGLLNQAHNLNRSGELYLQKYPKLGVRIVDGTSLAAAVVVNSIPKGTNQVILAGNISKVALAVASALCKKNVKVILTNKQDYHSLKPNIPQNSASNLVLSNTDSAKVWVIGEGLDAAEQLKAEKGTQFIPYSQFPPRMVRKDCCTYLTTPAMSVPKTMQNLHSCENWLPRRVMSAWRIAGIVHALEGWKEDECGDTVLDMEKVWSAAVMHGFSPVAHA

SEQ ID NO: 5529 - protein, 477 aa, Triticum aestivum
MQRLASSRRLLRAALAPGRAHSSLSAAAVAAAPENGAGAPKMPPFAYTPPPYDGPRVAEIAQKRAQFLSPSLFHFYDRPLNIVDGKMQYLFDEDGRRYLDAFGGIATVCCGHCHPDVIEAIVNQAKKIQHSTVLYLNHAIADFAEALAAKMPGDLKVVFFTNSGTEANELALMIARLYTGSHDIISLRNGYHGNAAATMGATAQSNWKFNVVQTGVHHALNPDPYRGAFGSDGEKYARDIQETIDYGTTGRVAGFISEAIQGVGGIVELAPGYLPAAYDMVRKAGGLCIADEVQAGVARTGSHFWGFEGQGVIPDIVTMAKGIGNGIPIGAVVTTPEIAKVLTRRSYFNTFGGNPVSTAAGHAVLKVLEKEKLQENAFVVGSYLKEKLNALKEKHDIIGDVRGKGLLLGVELVTDRQKKTPAKAEIAQVMNHMKDMGVLVGKGGFFGNVFRVTPPLCFSKEDSDFMIEVMDIALSKL

SEQ ID NO: 5530 - protein, 478 aa, Brachypodium distachyon
MQRLASSRRLLQAALAPGGRAHSSLSAAAVAASPQNGGGAPKMPPFDYTPPPYDGPRVAEVARKRAEFLSPSLFHFYDRPLNIVDGKMQYLFDEDGRRYLDAFGGIATVCCGHCHPDVIEAIVNQANKIQHSTVLYLNHAIADFAEALASKMPGDLKVVFFTNSGTEANELALMIARLYTGCHDIISLRNGYHGNAAATMGATAQCNWKFNVVQTGVHHALNPDPYRGAFGSDGEKYARDIQETIDYGTTGRVGGFISEAIQGVGGIVELAPGYLPAAYNMIRNAGGLCIADEVQAGVARTGSHFWGFEGHGVIPDIVTMAKGIGNGIPIGAVVTTPEIAQVLTRRSYFNTFGGNPVSTAAGHAVLKVLEKEKLQENAFVVGSYLKDQLNILKEKHDIIGDVRGRGFLLGVELVTDHQKKTPAKVEIAHVMNHMKDMGVLVGKGGFYGNVFRVTPPLCFSKEDSDFFIEVMDTALSKL

SEQ ID NO: 5531 - protein, 479 aa, Sorghum bicolor
MQRLASSRRLLQAALVPARANSSLSAAAVAAPAPENGADAVPKMPAFDYTPPPYDGPRADEIFRKRAQFLSPSLFHFYDRPLNIVDGKKQYLFDEDGRRYLDAFGGIATVCCGHCHPDVVEAIVNQAKRIQHSTVLYLNHAIADFAEALASKMPGDLKVVFFTNSGTEANELALMIARLYTGCNDIISLRNGYHGNAAGTMGATAQSNWKFNVVQTGVHHALNPDPYRGAFGSDGEKYARDVQEIIEFGTTGRVGGFISEAIQGVGGIVELAPGYLPVAYDMVRKAGGLCIADEVQAGVARTGSHFWGFEGHGVIPDIVTMAKGIGNGIPIGAVVTTPEIAQVLTRRSYFNTFGGNPVSTAGGHAVLKVLEKEKLQENAFVVGSYLKEQLNKLKEKHEIIGDVRGKGFLLGVELVTDREKKTPAKAEISHVMNHMKDMGVLVGKGGFYGNVFRITPPLCFTKEDSDFFIEVMDIALSKL

SEQ ID NO: 5532 - protein, 480 aa, Oryza sativa
MQRLASSRRLLQAALAPVRAQSSLSAAAAAAAPAPENAFAAAPKMPPFDYTPPPYDGPRAEEISRKRAEFLSPSLFHFYDRPLNIVDGKMQYLFDEDGRRYLDAFGGIATVCCGHCHPDVVEAMVNQAKRIQHSTVLYLNHAIADFAEALAAKMPGDLKVVFFTNSGTEANELALMIARLYTGCHDIISLRNGYHGNAAGTMGATAQCNWKFNVVQTGVHHALNPDPYRGAFGSDGEKYARDVQEIIDFGTTGRVGGFISEAIQGVGGIVELAPGYLPAVYNMVRKAGGLCIADEVQAGVARTGSHFWGFESHGVIPDIVTMAKGIGNGIPIGAVVTTPEIAQVLTRRSYFNTFGGNPVSTAGGHAVLKVLEKEKLQENAFVVGSYLKERLNKLKEKHDIIGDVRGKGFLLGVELVTDRQKKTPAKVEIGHVMNHMKDMGVLVGKGGFYGNVFRVTPPLCFTKEDSDFFIEAMDISLSKL

SEQ ID NO: 5533 - protein, 477 aa, Zea mays
MQRLASSRRLLQAALAPARANSSLSAAAVAAPAPANGAFPKMPAFDYTPPPYDGPRAEEIFRKRAQFLSPSLFHFYDRPLNIVEGKMQYLFDEDGRRYLDAFGGIATVCCGHCHPDVVEAIVNQAKRIQHSTVLYLNHAIADFAEALASKMPGDLKVVFFTNSGTEANELALMIARLYTGCNDIISLRNGYHGNAAGTMGATAQSNWKFNVVQTGVHHALNPDPFRGAFGSDGEKYARDVQEIIEFGTTGRVGGFISEAIQGVGGIVELAPGYLPVAYSMVRKAGGLCIADEVQAGVARTGSHFWGFEGHGVIPDIVTMAKGIGNGIPIGAVVTTPEIAQVLTRRSYFNTFGGNPVSTAGGHAVLKVLEKEKLQENAFVVGSYLKEQLNNLKDKHEIIGDVRGKGFLLGVELVTDHEKKTPAKAEISRVMNHMKDMGVLVGKGGFYGNVFRITPPLCFTKEDSDFFIEVMDIALSKL

SEQ ID NO: 5534 - protein, 480 aa, Panicum virgatum
MQRLASSSSRRLLGAALAPARANSSLSAAVAAAPAGECAAASPKMPGFDYTPPPYDGPRAEEIFRKRAEFLSPSLFHFYDRPLNIVDGKMQYLFDEDGRRYLDAFGGIATVCCGHCHPDVVEAIVNQAKRIQHSTVLYLNHAIVDFAESLASKMPGDLKVVFFTNSGTEANELALMIARLYTGCNDIISLRNGYHGNASGTMGATAQSNWKFNVVQTGVHHALNPDPYRGAFGSDGEKYARDVQEIIQFGTTGRVAGFISEAIQGVGGIVELAPGYLPAAYDIVRKAGGLCIADEVQAGVARTGSHFWGFEGHGVIPDIVTMAKGIGNGIPIGAVVTTPEIAQVLTRRSYFNTFGGNPVSTAGGHAVLKVLEKEKLQENAFVVGSYLKEQLNKLKEKHDIIGDVRGKGFLLGVELVTDREKKTPAKAEISHVMNHMKDMGVLVGKGGFYGNVFRITPPLCFTKEDSDFFIDVMDIALSKL

SEQ ID NO: 5535 - protein, 469 aa, Zea mays
MQRLASSRRLLQAALAAAAVAAPAPANGAFPKMPAFDYTPPPYNGPRAEIFRKRAQFLSPSLFHFYDRPLDIVEGKMQYLFDEDGRRYLDAFGGIATVCCGHCHPDVVEAIVNQAKRIQHSTVLYLNHAIADFAEALASKMPGDLKVVFFTNSGTEANELALMIARLYTGCNDIISLRNGYHGNAAGTMGATAQSNWKFKVVQMGVHHALNPDPFRGAFGSDGEKYARDVQEIIEFGTTGRVGGFISEAIQGVGGIVELAPGYLPVAYSMVRKAGGLCIADEVQAGVARTGSHFWGFEGHGVIPDIVTMAKGIGNGIPIGAVVTTPEIAQVLTRKSYFNRSTFDGNPVSTAGGHAVLKVLEKEKLQENAFVVGSYLKEQLNNLKDKHEIIGDVRGKGFLLGVELVTDREKKTPAKAEISRVMNHMKDMGVLVGKGGFYGNVFRITPPLCFTKEDSDFFIEVMDIALSKL

SEQ ID NO: 5536 - protein, 264 aa, Triticum aestivum
MLAIFQKQVAHAPQELNSPRGSTAKPKNPDEILRDFHAAHPSDAFSTSFGGGAALACVAAQPRNLAAAGYQRMFCGLDDIYCVFMGTLDNLSALMRQYGLTGRSTNEALLVIEAYRTLRDRGPYPADQVVKDLSGSFAFVVFDNRGRSGSGAAVFAAQSTDGGVPLHWGVAADGSVVICDDRGVAKAGCGRSYAPFPPGCMFHSEGGLKSFEHPMNRLKAFPRVDSEGVMCGANFKVDAFTKINSMPRVGSATNWAATWDDAAI

SEQ ID NO: 5537 - protein, 264 aa, Triticum aestivum
MLAIFQKQVAHAPQELNSPRGSTAKPKNPDEILRDFHAAHPSDAFSTSFGGGAALACVAAQPRNLAAGGYQRMFCGLDDIYCVFMGTLDNLSALMRQYGLTGRSTNEALLVIEAYRTLRDRGPYPADQVVKDLSGSFAFVVFDNRGRSGSGAAVFAAQSTDGGVPLHWGVAADGSVVICDDRAVAKAGCGRSYAPFPPGCMFHSEGGLKSFEHPMNRLKALPRVDSEGVMCGANFKVDAFTKINSMPRVGSATNWAATWDEAAI

SEQ ID NO: 5538 - protein, 264 aa, Pseudoroegneria spicata
MLAIFQKQVAHAPQELNSPRGSTAKPKNPDEILRDFHAAHPADAFSTSFGGGAALACVAAQPRSLAAGGYQRMFCGVDDIYCVFMGTLDNLSSLMRQYGLTGRSTNEALLVIEAYRTLRDRGPYPADQVVKDLSGSFAFVVFDNRGRSGSGAAVFAAQSTDGGVPLHWGVAADGSVVICDDRAVAKAGCGKSYAPFPPGCMFHSEGGLKSFEHPMNRLKAMPRVDSEGVMCGANFKVDAFTKINSMPRVGSATNWAATWDDAAI

SEQ ID NO: 5539 - protein, 264 aa, Leymus cinereus x Leymus triticoides
MLAIFQKQVAHAPQELNSPRGSTAKPKNPDEILRDFHAAHPTDAFSTSFGGGAALACVAAQPRSLAAGGYQRMFCGLDDIYCVFTGTLDNLSSLMRQYGLTGRSTNEALLVIEAYRTLRDRGPYPADQVVKDLSGSFAFVVFDNRGRSGSGAAVFAAQSTDGGVPLHWGVAADGSVVICDDRSVAKAGCGKSYAPFPPGCMFHSEGGLKSFEHPMNRLKAMPRVDSEGVMCGANFKVDTFTKINSMPRVGSATNWAATWDDAAI

SEQ ID NO: 5540 - protein, 263 aa, Leymus cinereus x Leymus triticoides
  misc_feature (62)..(62): Xaa can be any naturally occurring amino acid
  misc_feature (76)..(76): Xaa can be any naturally occurring amino acid
MLAIFQKQVAHAPQELNSPRSGAAKPKNPDEILRDFHAAHPADAFSTSFGGGAALACVAAQXRSLAAGYQRMFCGXDDIYCVFMGTLDNLSSVMRQYGLTGRSTNEALLVIEAYRTLRDRGPYPADQVVKDLSGSFAFVVFDNRGRSGSGAAVFAAQSTDGGVPLHWGVAADGSVVICDDRAVAKAGCGKSYAPFPPGCMFHSEGGLKSFEHPMNRLKAMPRVDSEGVMCGANFKVDAFTKINSMPRVGSATNWAATWDDAAI

SEQ ID NO: 5541 - protein, 258 aa, Oryza sativa
MLAIFQKQVAHAPAELNSPRSSAAKPKNPDEILRDFHALHPIEAFSTSFGGGAALACVAGHARNGLSGYERMFCGLDDIYCVFMGRLDNLSSLIRQYGLCSRSTNEALLVIEAYRTLRDRGPYPADQVVKDLSGSFAFVVFDNKSGAVFAALSTDGEVPLYWGIAADGSVVICDEREIVKGGCGKSYAPFPVGCMFHSEGGLKSFEHPMNRLKAMPRVDSEGVMCGATFKVDTFTKINSMPRVGSATNWAATWDDAAA

SEQ ID NO: 5542 - protein, 261 aa, Panicum virgatum
MLAIFQKQVAHAPQELNSPRSGGAAKPRSPDEILRDFHAAHPADAFSTSFGGGAALACVGARACPAAGAGHHQRMFCGLDDIYCVFLGRLDNLSALIRQYGLCGKSTNEALLVIEAYRTLRDRGPYPADQVVKDLAGSFAFVVFDNKSGAVFAALSADGGVPLYWGIAADGSVVICEDREIVKRGCGKSYAPFPVGCMFHSEGGLKSFEHPMNRLKAMPRVDSEGVMCGATFKVDTFTKINSMPRVGSATNWAAAWDDKAI

SEQ ID NO: 5543 - protein, 259 aa, Panicum virgatum
MLAIFQKQVAHAPQELNSPRSGGAKPRSPDEILRDFHAAHPADAFSASFGGGAALACVAARACPAAGAGHHQRMFCGLDDIYCVFLGRLDNLSALIRQYGLCNKSTNEALLVIEAYRTLRDRGPYPADQVVKDLAGSFAFVVFDNKSGAVFAALSADGGVPLFWGIAADGSVVICEDREIVKRGCGKSYAPFPVGCMFHSEGGLKSFEHPMNRLKALPRVDSEGVMCGATFKVDTFTKINSMPRVGSATNWAAWDDQAI

SEQ ID NO: 5544 - protein, 264 aa, Saccharum officinarum
MLAIFQKQVAHAPQELNSPRSGGAAANKPRNPDEILRDFHAAHPTNAFSTSFGGGSALACVGPTAAAASSGGYQRMFCGLDDIYCVFLGRLDNLSGLIRQYGLCGRSTNEALLVIEAYRTLRDRGPYPADQVVKDLAGAFAFVVFDNRSGAVFAALGGNDGGDSVPLYWGVAADGSAVISDDREVVKRGCGKSYAPFPAGCMFHSEGGLKSFEHPMNRLKAMPRVDSEGAMCGATFKVDTFTKINSMPRVGSATNWAAAWDDAI

SEQ ID NO: 5545 - protein, 264 aa, Saccharum officinarum
MLAIFQKQVAHAPQELNSPRSGGASSNKPRNPDEILRDFHAAHPTNAFSTSFGGGAALACVGPTASSGAGSTYQRMFCGLDDIYCVFLGRLDNLSGLIRQYGLCGRSTNEALLVIEAYRTLRDRGPYPADQVVKDLAGAFAFVVFDNRSGAVFAALGGNDGGDSVPLYWGVAADGSAVISDDRDVVKRGCGKSYAPFPAGCMFHSEGGLKSFEHPMNRLKAMPRVDSEGAMCGATFKVDTFTKINSMPRVGSATNWAAAWDDAI

SEQ ID NO: 5546 - protein, 267 aa, Saccharum officinarum
MLAIFQKQVAHAPQELNSPRSGGASSNKPRNPDEIMRDFHAAHPTNAFSTSFGGGAALACVGPTAAAASSGAGSTYQRMFCGLDDIYCVFLGRLDNLSGLIRQYGLCGRSTNEALLVIEAYRTLRDRGPYPADQVVKDLAGAFAFVVFDNRSGAVFAALGGNDGGDSVPLYWGVAADGSAVISDDRDVVKRGCGKSYAPFPAGCMFHSEGGLKSFEHPMNRLKAMPRVDSEGAMCGATFKVDTFTKINSMPRVGSATNWAAAWDDAI

SEQ ID NO: 5547 - protein, 566 aa, Avena sativa
MDKGHLGGGGGGLLALDASPRPLGFLNLLSPPAPFHRSSMEADDGGGGGGRGRRSVEVDFFSDEKKNMKKTRVSASAADAEENKSQADGLAIKKEDLTINLLPGNNNARSDRSMVVDDDAASRRHEEGRNNTELAAMQSELSRLNEENQRLRGMLTQVTNSYQALQMHLVALMQQRTQQLPPTQPQQPPTHQDGNKTEQGAMVPRQFLGLGPSGGAGADVAEEPSNSSTEVGSPRRSSSNGNEDPERGDNPDGPSTAAGWLPGRAMSQQLGAAAKGHDQQAQEATMRKARVSVRARSEAPIIADGCQWRKYGQKMAKGNPCPRAYYRCTMATGCPVRKQVQRCAEDRSILITTYEGTHNHPLPPAAMAMASTTSAAASMLLSGSMPSADGSGLMSSNFLARTVLPCSSSMATISASAPFPTVTLDLTHGPHGPPNALPLNAARPPAPGQFQIPLPGGGMAPAFAMPPHMLYNQSKFSGLQMSSAESVDAAAAAQFAQPRPPMGQISDTVSAAAAAITADPNFTVALAAAITSIIGGQHAAAAGNNHNTNSNNNTNNVTTTSTTQRA

SEQ ID NO: 5548 - protein, 169 aa, Lolium multiflorum
MAMRALVLPPSQSSSFGLHQSMPCFKPSSASPRSVKAYAKADEEEEKVPKQSLFGNITEALDFSQVRSEKDAELLYEARDSIKEEGRMTREQYAALRRKIGGTYKDFFKSYVDVDGEYVEEGWVDKTCKVCKKDTRGEPRQVDKLGRYMHVACAENSKPTNFFSKLFGR

SEQ ID NO: 5549 - protein, 171 aa, Avena sativa
MAMRALALPPSQSSSFGLHQNMPSFRPSSASPRSVKAYAKANDEEEEKKVPKQSLFGNITEALDFSQVRSEKDAELLYEARDSIKEEGRMTREQYGALRRKIGGTYKDFFKSFVDVDGEYVEEGWVDKTCKVCKKDTRGEPRQVDKLGRYMHVACAENSKPTNFFAKLFGG

SEQ ID NO: 5550 - protein, 171 aa, Avena sativa
MAMRALALPPSQSSSFGLHQSMPSFRPSSASPRSVKAYAKANEEEEEKKVPKQSLFGNITEALDFSQVRSEKDAELLYEARDSIKEEGRMTREQYGALRRKIGGTYKDFFKSFVDVDGEYVEEGWVDKTCKVCKKDTRGEPRQVDKLGRYMHVACAENSKPTNFFSKLFGG

SEQ ID NO: 5551 - protein, 172 aa, Hordeum vulgare
MAMRALALSPTQSSSFGLHQSTPCFKPSSASPTRSVRAYAKADEEEGEKKVPKQSLFGNITEALDFSQVRSEKDAELLYEARDSIKDEGRMTREQYAALRRKIGGTYKDFFKSYVEVDGEYVEEGWVDKTCKVCKKDTRGEPRQVDNLGRYMHVACAENSKPTNFFSKLFGR

SEQ ID NO: 5552 - protein, 172 aa, Triticum aestivum
MAMRALALSPSQSSSFGLHQSMPSFKPSSTSPARSVRAYAKADEQEEKKKVPKQSLFGNITEALDFSQVRSEKDAELLYEARDSIKDEGRMTREQYAALRRKIGGTYKDFFKSYVEVDGEYVEEGWVDKTCKVCKKDTRGEPRQVDNLGRYMHVACAENSKPTNFFSKLFGR

SEQ ID NO: 5553 - protein, 171 aa, Leymus cinereus x Leymus triticoides
MAMRALALPPSQSSSFGLHQSFKPSSASPARSVRAYAKADEQEEKEKEKVPKQSLFGNITEALDFSQVRSEKDAELLYEARGSIKEEGRMTREQYAALRRKIGGTYKDFFKSYVEVDGEYVEEGWVDKTCKVCKKDTRGEPRQVDNLGRYMHVACAENSKPTNFFAKLFGR

SEQ ID NO: 5554 - protein, 173 aa, Triticum aestivum
MAMRALALSPSQSSSFGLHQSMPSFKPSSASPARPVRAYAKADEQEEEKKKVPKQSLFGNITEALDFSQVRSEKDAELLYEARDSIKDEGRMTREQYAALRRKIGGTYKDFFKSYVEVDGEYVEEGWVDKTCKVCKKDTRGEPRQVDNLGRYMHVACAENSKPTNFFSKLFSR

SEQ ID NO: 5555 - protein, 173 aa, Triticum aestivum
MAMRALALSPAQSSSFGLHQSMPSFKPGSASPARSVRAYAKADEQEEEKKKVPKQSLFGNITEALDFSQVRSEKDAELLYEARDSIKDEGRMTREQYAALRRKIGGTYKDFFKSYVEVDGEYVEEGWVDKTCKVCKKDTRGEPRQVDNLGRYMHVACAENSKPTNFFSKLFGR

SEQ ID NO: 5556 - protein, 170 aa, Oryza sativa
MAMRAITLSHSQSASFGHHHHQTMPSSFRPSTASTRSVKVYAKEDEEKGSKQSLFGSITEALDFSQVRSEKDAELLYEAREATKDGGRMTKEQYGALRRKIGGTYKDFFKSYVDVDGEYVEEGWVDKTCKVCKKDTRGEPRQVDKLGRYAHVACLENPKPTNIFAKLFAR

SEQ ID NO: 5557 - protein, 261 aa, Unknown
  Sequence found in Organisms: Brassica napus, Brassica oleracea
MAFSPINCLIFDLDDTLYPLKTGIAPAVKKNIDDFLMEKFGFSESKASSLRVELFKTYGSTLAGLRALGHDVHPDEYHSVVHGRLPYGSIQPNSKLRNLLNKIKQRKIIFTNSDRNHAMKVLERLGLEDCFEEIICFETMNPNLFGSTTRPDEHPVVLKPSLTAMDVCIRAANVDPRRAVFLDDNVHNISAGKSVGLRTILVGRSEKTKDADYAVESVTEIATAVPDIWATATAGCDDGGERIRRSKSELEGMASITAVGA

SEQ ID NO: 5558 - protein, 263 aa, Arabidopsis thaliana
MDFSPINCLIFDLDDTLYPLKTGIAPAVKKNIDDFLVEKFGFSESKASSLRVELFKTYGSTLAGLRALGHDVHPDEYHSFVHGRLPYGSIEPNNKLRNLLNKIKQRKIIFTNSDKNHAVKVLKKLGLEDCFEEMICFETMNPNLFGSTTRPDEYPVVLKPSLTAMDICIRVANVDPRRTVFLDDNIHNITAGKSVGLRTILVGRAEKTKDADYAVETVTEIATAVPEIWATATATGGFDVGGERIRRSKSELEGMASIAAVGA

SEQ ID NO: 5559 - protein, 264 aa, Arabidopsis lyrata
MDFSSPINCLIFDLDDTLYPLKTGIAPAVKKNIDDFLVEKYGFSESKASSLRVELFKTYGSTLVGLRALGHDVHPDEYHSFVHGRLPYGSIEPNNKLRNLLNKIKQRKIIFTNSDRNHAVKVLKKLGLEDCFEEMICFETMNPNLFGSTTRPDEHPVVLKPSLTAMDICIRVANVDPRRTIFLDDNIHNITAGKSVGLRTILVGRAEKTKDADYAVETVTEIATAVPEIWKTATATGGFDVGGERIRRSKSELEGMASITAVGA

SEQ ID NO: 5560 - protein, 217 aa, Raphanus sativus
MASSPINCLIFDLDDTLYPLKTGIAPAVKKNIDDFLMEKFGFSESKASSLRVELFKTYGSTLAGLRALGHDVHPDEYHSVVHGRLPYGSIQPNSKLRNLLNKIKQRKIIFTNSDRNHAMKVLERLGLEDCFEEIICFETMNPNLFGPTTRPDEHPVVLKPSLTAMDVCIRIANVDPRRAVFLDDNVHNITAGKSVGLHTILVGRSERLKMRIMQWRV

SEQ ID NO: 5561 - protein, 522 aa, Manihot esculenta
MGPLSEPLPERNQNKPYGIQFIECIKKKRLSYKTCQAIVLIVTFFAYASYHAARKTTSIVKSALDPQSTRVGLKFIPWRITYLSEPEERRFSWVLGDGWAPFSGSDGTALLGELDLAFLSIYAIGMYFSGHIGDRMDLRIFLTIGMIGTGVFTSLFGVGYWANVHNFYYFLIMQMIAGLFQSTGWPSVVAVVGDWFGKSKRGLIMGIWNAHTSIGNISGSLIASAMLSYGWGWSFVVPGFLIAFIGLMVFLVLPVSPDSVGIDRREDELHDPRKIGEEVTEPLLGSDSEVKETAVGFIEAWKIPGVAPFALCLFFAKLVAYTFLYWLPFYISHTAIDGKYLSDGTAGNLSTLFDVGGVIGGILAGHISDRLDARAITAASFMYCAIPALFFYRSYGHISLGVNIALMFITGLFVNGPYALITTAVSADLGTHSSLKGNSRALATVTAIIDGTGSVGAAIGPLLTGYISAKSWSAVFTMLMAAALIAGLLLTRLVVAEVAAKIAESRSQTSAPSRTPAVQLDV

SEQ ID NO: 5562 - protein, 380 aa, Panicum virgatum
MMMMGEGVSVPPWSHHLPVSGVDVGGGTTGGDEMTPYLLSALHQYLPCNDAGAGADDDEAAAAAAMAAGVDGYGSDEFRMYEFKVRRCARARSHDWTECPFAHPGEKARRRDPRKYHYSGTACPDFRKGGCKRGDACEFAHGVFECWLHPARYRTQPCKDGTACRRRVCFFAHTPDQLRVLLAQQSSPRGAGAAASPLAESYDGSPLRRQAFETYLTKSIMSSSPTSTLMSPPKSPPSDSPPLSPDGAAAFRRGSWPGVGSPVNEVLASLRQLRLSKANSSPAGGWSGYPSSAVAYGSPTAAGLYSLPSTPTTMGGFMANLEPLDVSFIGGEEEPVQRVESGRALRAKVFERLSREGAVSGDATAATGGPDVGWVSDLIN

SEQ ID NO: 5563 - protein, 379 aa, Hordeum vulgare
MMMMSEGVSVPPWGNLPVSGVDAGGGDETPFLFAALRQYLPCNDMAGAGGDDEDEAAAMAAAVDAYACDEFRMYDFKVRRCARGRSHDWTECPFAHPGEKARRRDPRKYHYSGTACPDFRKGGCKRGDACEYAHGVFECWLHPARYRTQPCKDGTACRRRVCFFAHTPDQLRAMPSQHSSPRSTPLSPLAESYDGSPLRRQAFESYLSKSIMSSSPTSTLLSSPPKSPPSESPPLSPDGAAASFRRGSWPGVGSPVNDVLASLRQLRLAKAQASPSGGWPAYPTSPAAYGSPKAGGLYSLPTTPMGTQTSASSFMANLEPLNLRFLDDEEPVQRVESGRALREKVFERLSRDGAAPRSCDVGAGAGGGPDVGWVSDLIN

SEQ ID NO: 5564 - protein, 622 aa, Brachypodium distachyon
MGGANSREDLDLTSSSGEEEEDDEEYDAEESPASGRQREDPLRTTTPASIELLDARLKSLDLKYQHPNAAKLYLHVGGASADARWIPAERRATYAFVDKASQDSSDSSSSEPRWVLEVGPGRRVTAPVGPELQLKALPSQRRADFAASGSVWALRLPTDAAFRRFREEYDRCLFENTYGVEATDEGRREVFGADFAAWARPGLADDAVWADAEDDFSPPATASARDLLEEFEEEAGDGSSIQSLALGALDNSFLVGGAGIQVVKNFRHGVHGKGVSVKISGGRGGSSSTSYSTPKKALLMRGETNMLLMSPGDAGAPRSNGIHHVDIETGKVVTEWRFEKDGTDITMRDIANDSKSAQLEPSGSTFLGLDDNRLCRWDMRDARGRVQTIGSSSESPVLHWSQGHQFSRGTNFQCFASTGDGSIVVGSVDGKIRLYSKSSMRMAKTVFPGLGSPITHVDVTYDGKWILGTTDTYLILICTIFKDKDGKEKTGFGGRMGSKIAAPRLLKLSPLDSILAGTDNKFHGGQFSWVTENGKQEKHLVATVGKFSLIWNFQQVKDSNHHCYRDQEGLKSCYCYKVVLKDESIVDSRFMHENFATSDSPEAPLVVATPMKVSSFSIANRR

SEQ ID NO: 5565 - protein, 618 aa, Sorghum bicolor
MGGSHSREDIDLTSSDEEKEYEDDYDARSPIAEAAASAGQRDDDLLRTATPSSLEAIDAKLRSLDLKYQRPTSAKLYLHVGGASPSAHWVPAERRATYAFVDKSSDNDSSPRWFLEVGPGPRVSAPVDSALQLKTIPAQRRADFAASGSVWALRLPTDAELRRFRVEYERCLFENTYGVEATDEGRKEVFGADFAAWARPAEADDAVWADAEESLTPPAAAPAKDLLEEFEEEAGDGDSIQSLALGALDNSFLVGGAGIQVVKNFRHGLHGKGASVKISGGRGGSGSAYSTPKKALLMRGETNMLLMSPGEAVRSNGVHHVDIETGKVVAEWRFEKDGADITMRDIANDSKGAQLEPSGSTFLGLDCNRLCRWDMRDSRGRVQTIGSSSESPVLNWSQGHQFSRGTNFQCFASTGDGSIVVGSVDGKIRLYSKSSMRMAKTAFPGLGSPITHVDVTYDGKWILGTTDTYLILICTIFKDKDGKEKTGFSGRMGNKIAAPRLLKLTPLDSILAGTDNKFHGGQFSWVTENGKQEKHLVATVGKFSVIWNFQQVKDSNHECYRDQQGLKSCYCYKVVLKDESIVDSRFMHEKFASSDSPEAPLVVATPMKVSSFSIANRR

SEQ ID NO: 5566 - protein, 618 aa, Zea mays
MGGSHSREDVDLTSSDEEEEFEDDYDARSPIAEAAASAGQRDDDLLRTATPSSLEAIDAKLRSLDLKYQRPTAAKLYLHVGGASPSARWVPAERRATYAFVDQSSDDASSPRWFLEVGPGPRVSAPVDSALQLKTIPAQRRADFAASGSVWALRLPTDAELRRFRVEYERCLFENTYGVEATDEGRKEVFGADFAAWARPAEADDTVWADAEESLTPPAAAPGKDLLKEFEEEAGDGDSIQSLALGALDNSFLVGGAGIQVVKNFRHGLHGKGASVKISGGRGGSGSAYSTPKKALLMRGETNMLLMSPGEALHSNGVHHVDVETGKVVAEWRFEKDGADITMRDIANDSKGAQLEPSGSTFLGLDDNRLCRWDMRDARGRVQTIGSSSDSPVLNWSQGHQFSRGTNFQCFASTGDGSIVVGSVDGKIRLYSKSSMRMAKTAFPGLGSPITHVDVTYDGKWILGTTDTYLILICTIFKDKDGKEKTGFSGRMGNRIAAPRLLKLTPLDSVLAGTDNKFHGGQFSWVTENGKQEKHLVATVGKFSVIWNFQQVKDSNHECYRDQQGLKSCYCYKVVLKDESIVDSRFMHEKFATSDSPEAPLVVATPMKVSSFSIANRR

SEQ ID NO: 5567 - protein, 629 aa, Avena sativa
MGGANSREDLDITSSSGEEDEDDYQDEDYDPRSPASGARQRADDPLRATTPASIQFLDAKLKALDLKYKQPQTDNAARLYLHVGGASADARWVPALRHATYNFVDKAANEDDSDRARWVLEVGPGRKVSAPVGPELQLKALPAQRRADFAASGSVWALRLPDDAAFRRFRDEYDRCLFENTYGVEATDEGRKEVFGADFAAWARPAEADDAVWADAEDGFTPPPPVAASARDLLEEFEEEAGDGTGIQSLALGALDNSFLVGGTGIQVVKNFRHGVHGKGVSVKISGGRRGSTTASTYSTPKKALLMRGETNMLLMSPGDTGAARSNGVHHVDIETGKVVTEWRFEKDGTDITMRDIANDSKSSQLEPSGSTFLGLDDNRLCRWDMRDARGRVQTIGTSSESPVLHWSQGHQFSRGTNFNCFASTGDGSIVVGSIDGKIRLYSKSSMRMAKTAFPGLGSPITHVDVTYDGKWILGTTDTYLILICTIFKDKDGKDKTGFSGRMGNRIAAPRLLKLSPLDSILAGNDNKFHGGQFSWVTENGKQEKHLVATVGKFSLIWNFHQVKDSNHHCYRDQEGLKSCYCYKVVLKEESIVDSRFMHENFATSDSPDAPLVVATPQKVSSFSIANRR

SEQ ID NO: 5568 - protein, 315 aa, Panicum virgatum
MRVLEDDLFPSTPGKVKIERAGTMNRQLHRCFASTSTMFLWALFLVAMTASYLSFQSFVDTSSKYFAASWGGLHWERQIRASAAPRRPPGSADGAGMSVLVTGAAGFVGTHCSLALRKRGRRRRRRRQLQRLLRPLAQEGPQGAALLAWGVRRRGRHQRRPPPGQALRRRALHARAPPRRAGRRALRHGEPGVLRALQHRRPRHAPRGLQGRRPAAGHRLGVLLLRLRPQRQGPLLGARPHRSAGVAVRGDQEGRRGDHAHVQPHLRPLHHRPPLLHRVRALGTAGHGLLLFHPQHPAGEAHHGVPRQGPRRPGP

SEQ ID NO: 5569 - protein, 439 aa, Sorghum bicolor
MRVLEEDLFPSTPGKVKIERAGAMNRQLHRCFASTSTMFLWALFLVAMTASYLSFQSFVDTSSKYFAASWGGLHWERQIRASAAPRRPPGSAAGAGMSVLVTGAAGFVGTHCSLALRKRGDGVVGVDNFNAYYDPSLKKARKALLASHGVFVVEGDINDGRLLAKLFDVVPFTHVLHLAAQAGVRYAMENPASYVHSNIAGLVTLLEACKDADPQPAIVWASSSSVYGLNDKVPFSERDRTDQPASLYAATKKAGEEITHTYNHIYGLSITGLRFFTVYGPWGRPDMAYFSFTRNILQGKPITVYRGKDHVDLARDFTYIDDIVKGCLGSLDTAGKSTGTGGKKRGPAPYRIFNLGNTSPVTVPNLVSILEKHLRVKAKKHVVEMPGNGDVPFTHANISLAREQLGYKPSTNLDVGLKKFVKWYLSYYGYTRGSKNSRQ

SEQ ID NO: 5570 - protein, 439 aa, Zea mays
MRVLEEDLFPSTPGKVKIERAGAMNRQLHRCFASTSTMFLWALFLVAMTASYLSFQSFVDTSSKYLAASWGGLHWERQIRASAAPRRPPGSAAGAGMSVLVTGAAGFVGTHCSLALRKRGDGVVGVDNFNAYYDPSLKKARRALLASHGVFIVEGDINDGRLLAKLFDVVPFTHVLHLAAQAGVRYAMQNPASYVHSNIAGLVTLLEACKDADPQPAIVWASSSSVYGLNDKVPFSERDRTDQPASLYAATKKAGEEITHTYNHIYGLSITGLRFFTVYGPWGRPDMAYFSFTRNILQGKPITVYRGKDRVDLARDFTYIDDIVKGCLGSLDTAGKSTGTGGKKRGPAPYRIFNLGNTAPVTVPNLVSILEKHLRVKAKKNVVEMPGNGDVPFTHANITLARQQLGYKPTTNLDVGLKKFVKWYQSYYGYTRGSKNSRQ

SEQ ID NO: 5571 - protein, 440 aa, Zea mays
MRVLEEDLFPSTPGKVKIERAGAMNRQLHRCFASTSTMFLWALFLVAMTASYLSFQSFVDTSSKYFAASWGGLHWERQIRASAVPRRPPGSAAGAGMSVLVTGAAGFVGTHCSLALRRRGDGVVGVDNFNAYYDPSLKKARRALLASHGVFVVEGDINDGRLLAKLFDVVPFTHVLHLAAQAGVRYAMENPASYVHSNVAGLVTLLEACKDADPQPAIVWASSSSVYGLNDKVPFSERDRTDQPASLYAATKKAGEEITHTYNHIYGLSITGLRFFTVYGPWGRPDMAYFSFTRNILQGKPITVYRGKDHVDLARDFTYIDDIVKGCLASLETAGKSTGTGGKKRGPAPYRIFNLGNTSPVTVPNLVSILEKHLRVKAKKNVVEMPGNGDVPFTHANISLAREQLGYKPTTNLDVGLKKFVKWYLSYYGYTRGGSKNSRH

SEQ ID NO: 5572 - protein, 441 aa, Brachypodium distachyon
MRALEDDLFPSTPGKVKIERAGGGAMAMNRQLHRCFASTSTMFLWALFLVAMTASYLSFQSFVDTSSKYFAASWGGLHWERQIRASAAVRRPPGSAAGAGMSVLVTGAAGFVGTHCSLALRKRGDGVVGIDNFNSYYDPSLKKARKALLTSHGVFVVEGDINDGRLLAKLFDVVPFTHVLHLAAQAGVRYAMENPASYVHSNVAGLVTLLEACKNADPQPAIVWASSSSVYGLNDKVPFSEADRTDQPASLYAATKKAGEEITHSYNHIYGLSITGLRFFTVYGPWGRPDMAYFSFTRNILQGKPITVYRGKNHVDLARDFTYIDDIVKGCLGSLDTAGRSTGTGGKKRGPAPYRIFNLGNTSPVTVPTLVSILEKHLRVKAKKHVIEMPGNGDVPFTHANISLARQQLGYKPTTNLDAGLKKFVKWYLSYYGYTRGSKNL

SEQ ID NO: 5573 - protein, 482 aa, Avena sativa
MRALEDDLFPSTPGKVKIERAGGAMNRQLHRCFASTSTMFLWALFLVAMTASYLSFQSFVDTSSKYFAASWGGLHWERQIRASAAPRRPPGSAAGAGMSVLVTGASGFVGAHCSLALRKRGDGVVGIDNFNAYYDPSLKKARKALLASHGVYVVEGDINDGRLLAKLFDVVPFTHVLHLAAQPGCATPWRTRHPTCTPTSRGSSRSSRPARTPTRSRPSSGPPHRPSTASTTRCPSPSPTAPTSRRPSTPPPRRPARRSPTRTTTSTASPSPASASSPSTGHGAAPTWHTSPSHATSCRGSPSPSTGARTTSTSPATSHTSTTSSRAAWAHSTRPAGARAPAARSAARRRTGSSTSATHPRSRCPPSCPSSRSTSASRPRSTWLRCQATATCHSHTPTSPSPGSSSGTSPPPTSTPASRSSSNGTSRTTATAGDPRTCDRCCCAATPPSQFFPPPFPFLLLILYSLLGPTLAAAGHSRIEHF

SEQ ID NO: 5574 - protein, 438 aa, Triticum aestivum
  misc_feature (89)..(89): Xaa can be any naturally occurring amino acid
  misc_feature (108)..(109): Xaa can be any naturally occurring amino acid
  misc_feature (229)..(229): Xaa can be any naturally occurring amino acid
  misc_feature (233)..(233): Xaa can be any naturally occurring amino acid
MRALEDDLFPSTPGKVKIERAGGTMNRQLHRCFASTSTMFLWALFLVAMTASYLSFQSFVDTSSKYFAASWGGLHWERQIRASAAPRRXPGSAAGAGMSVLVTGASGXXGAHCSLALRKRGDGVVGIDNFNAYYDPSLKKARKALLTSHGVFVVEGDINDGRLLAKLFDVVPFTHVLHLAAQAGVRYAMENPASYVHSNVAGLVTLLEACKNADPQPAIVWASSSSVYXLNDXVPFSESHRTDQPASLYAATKKAGEEITHSYNHIYGLSITGLRFFTVYGPWGRPDMAYFSFTRNILQGKPITVYRGKNHVDLARDFTYIDDIVKGCLGSLDTAGRSTGTGGKKRGPAPYRIFNLGNTSPVTVPTLVAILEKHLRVKARKHVVEMPGNGDVPFTHANISLARQQLGYKPATNLDAGLKKFVKWYLSYYGYTRGSKNL

SEQ ID NO: 5575 - protein, 414 aa, Hordeum vulgare
MNRQLHRCFASTSTMFLWALFLVAMTASYLSFQSFVDTSSKYFAASWGGLHWERQIRASAAPRRPPGSAAGAGMSVLVTGASGFVGAHCSLALRKRGDGVVGIDNFNAYYDPSLKKARKALLSSHGVFVVEGDINDGRLLAKLFDVVPFTHVLHLAAQAGVRYAMENPASYVHSNVAGLVTLLEACKNADPQPAIVWASSSSVYGLNDKVPFSESHRTDQPASLYAATKKAGEEITHSYNHIYGLSITGLRFFTVYGPWGRPDMAYFSFTRNILQGKPITVYRGKNHVDLARDFTYIDDIVKGCLGSLDTAGRSTGTGGKKRGPAPYRIFNLGNTSPVTVPTLVSILEKHLRVKAKKHVVEMPGNGDVPFTHANISLARQQLGYKPTTNLDAGLKKFVKWYLSYYGYTRGSKNL

SEQ ID NO: 5576 - protein, 414 aa, Hordeum vulgare
MNRQLHRCFASTSTMFLWALFLVAMTASYLSFQSFVDTSSKYFAASWGGLHWERQIRASAAPRRPPGSAAGAGMSVLVTGASGFVGAHCSLALRKRGDGVVGIDNFNAYYDPSLKKARKALLSSHGVFVVEGDINDGRLLAKLFDVVPFTHVLHLAAQAGVRYAMEKPGSYVHSNVAGLVTLLEACKNADPQPAIVWASSSSVYGLNDKVPFSESHRTDQPASLYAATKKAGEEITHSYNHIYGLSITGLRFFTVYGPWGRPDMAYFSFTRNILQGKPITVYRGKNHVDLARDFTYIDDIVKGCLGSLDTAGRSTGTGGKKRGPAPYRIFNLGNTSPVTVPTLVSILEKHLRVKAKKHVVEMPGNGDVPFTHANISLARQQLGYKPTTNLDAGLKKFVKWYLSYYGYTRGSKNL

SEQ ID NO: 5577 - protein, 441 aa, Brachypodium distachyon
MRGVLEEDMLPSTPGKVKIERAGAMSRQLHRCFASTGTMFLWALFLVAMTATYLSFHSFVDTSSRYFAASWGGLHWERQIRASASPRRPPGSAEGAGLSVLVTGAAGFVGTHCSLALRKRGDGVVGIDNFNKYYDPSLKKARRALLASHGVFVVEGDINDGRLLAKLFDVVPFTHVLHLAAQAGVRYAMENPSSYVHSNIAGLVSLLEACKDADPQPAVVWASSSSVYGLNDLVPFSEAHRTDRPASLYAATKKAGEEITHTYNHIYGLSVTGLRFFTVYGPWGRPDMAYFSFTRNILQGKPITVYRGKDHVDLARDFTYIDDIVRGCLASLDTAGRSTGTGGKKRGPAPYRIFNLGNTAPVTVPTLVSILERYLRVEAKKNVVEMPGNGDVPFTHANISLAREQLGYKPTTTLEMGLKKFVRWYLSYYGYNRGTHTFSNL

SEQ ID NO: 5578 - protein, 440 aa, Zea mays
MRVLEEDLYPSTPGKVKVERAGAMSRYLHRCFASTGTMFLWALFLVAMTATYLSVHSIVDTSSRYFAASWGGLHWERQIRASASPRRPPGSAEGAGLSVLVTGAAGFVGTHCSLALRKRGDGVLGLDNFNSYYDPSLKKARRALLGSHGVFVVEGDINDGRLLAKLFDVVPFTHVLHLAAQAGVRYAMENPASYVHSNIAGLVSLLEACKDADPQPAVVWASSSSVYGLNDRVPFSEAHRTDRPASLYAATKKAGEEITHTYNHIYGLSVTGLRFFTVYGPWGRPDMAYFSFTRNILQGKPITVYRGRDRVDLARDFTYIDDIVRGCLASLDTAGRSTGTGGKKRGPAPYRIFNLGNTSPVTVPTLVSILERYLRVKAKKNVVEMPGNGDVPYTHANISLAREQLGYKPTTSLEMGLKKFVRWYLSYYGYNRGTHTFRNS

SEQ ID NO: 5579 - protein, 439 aa, Sorghum bicolor
MRVLEEDLYPSTPGKVKVERPGAMSRHLHRCFASTGTMFLWALFLVAMTATYLSVHSFVDTSSRYFAASWGGLHWERQIRASASPRRPPGSAEGAGLSVLVTGAAGFVGTHCSLALRKRGDGVVGIDNFNNYYDPSLKKARRALLGSHGVFVVEGDINDGRLLAKLFDVVPFTHVLHLAAQAGVRYAMENPASYVHSNIAGLVSLLEACKDADPQPAVVWASSSSVYGLNDRVPFSEAHRTDRPASLYAATKKAGEEITHTYNHIYGLSVTGLRFFTVYGPWGRPDMAYFSFTRNILQGKPITVYRGRDHVALARDFTYIDDIVRGCLASLDTAGRSTGTGGKKRGPAQYRIFNLGNTSPVTVPTLVAILERYLRVKAKKNVVEMPGNGDVPYTHANISLAREELGYKPTTSLEMGLKKFVRWYLSYYGYNRGTHTFRN

SEQ ID NO: 5580 - protein, 440 aa, Sorghum bicolor
MRVLEEDLYPSTPGKVKVERPGAMSRHLHRCFASTGTMFLWALFLVAMTATYLSVHSFVDTSSRYFAASWGGLHWERQIRASASPRRPPGSAEGAGLSVLVTGAAGFVGTHCSLALRKRGDGVVGIDNFNNYYDPSLKKARRALLGSHGVFVVEGDINDGRLLAKLFDVVPFTHVLHLAAQAGVRYAMENPASYVHSNIAGLVSLLEACKDADPQPAVVWASSSSVYGLNDRVPFSEAHRTDRPASLYAATKKAGEEITHTYNHIYGLSVTGLRFFTVYGPWGRPDMAYFSFTRNILQGKPITVYRGRDHVALARDFTYIDDIVRGCLASLDTAGRSTGTGGKKRGPAQYRIFNLGNTSPVTVPTLVAILERYLRVKAKKNVVEMPGNGDVPYTHANISLAREELGYKPTTSLEMGLKKFVRWYLSYYGYNRGTHTFRNS

SEQ ID NO: 5581 - protein, 416 aa, Brachypodium distachyon
MSRQLHRCFASTGTMFLWALFLVAMTATYLSFHSFVDTSSRYFAASWGGLHWERQIRASASPRRPPGSAEGAGLSVLVTGAAGFVGTHCSLALRKRGDGVVGIDNFNKYYDPSLKKARRALLASHGVFVVEGDINDGRLLAKLFDVVPFTHVLHLAAQAGVRYAMENPSSYVHSNIAGLVSLLEACKDADPQPAVVWASSSSVYGLNDLVPFSEAHRTDRPASLYAATKKAGEEITHTYNHIYGLSVTGLRFFTVYGPWGRPDMAYFSFTRNILQGKPITVYRGKDHVDLARDFTYIDDIVRGCLASLDTAGRSTGTGGKKRGPAPYRIFNLGNTAPVTVPTLVSILERYLRVEAKKNVVEMPGNGDVPFTHANISLAREQLGYKPTTTLEMGLKKFVRWYLSYYGYNRGTHTFSN

SEQ ID NO: 5582 - protein, 390 aa, Sorghum bicolor
MRVLEEDLFPSTPGKVKIERAGAMNRQLHRCFASTSTMFLWALFLVAMTASYLSFQSFVDTHCSLALRKRGDGVVGVDNFNAYYDPSLKKARKALLASHGVFVVEGDINDGRLLAKLFDVVPFTHVLHLAAQAGVRYAMENPASYVHSNIAGLVTLLEACKDADPQPAIVWASSSSVYGLNDKVPFSERDRTDQPASLYAATKKAGEEITHTYNHIYGLSITGLRFFTVYGPWGRPDMAYFSFTRNILQGKPITVYRGKDHVDLARDFTYIDDIVKGCLGSLDTAGKSTGTGGKKRGPAPYRIFNLGNTSPVTVPNLVSILEKHLRVKAKKHVVEMPGNGDVPFTHANISLAREQLGYKPSTNLDVGLKKFVKWYLSYYGYTRGSKNSRQ

SEQ ID NO: 5583 - protein, 432 aa, Malus domestica
MPSALEDELFPSTPGKFKIERSHAMNRQFHRCFASTSTMFLWALFLIALTASYLSFQSFVDSGSRYFSASWGGIQWEKQVRNSAQIHRSGGMSVLVTGAAGFVGTHVSLGLKKRGDGVVGIDNFNSYYDPSLKKARRSLLKTHGVFIVEGDINDNRLLDKLFDTVAFTHVMHLAAQAGVRYAMENPHSYVHSNIAGLVTLLEVCKSANPQPSIVWASSSSVYGLNDNVPFSESDRTDQPASLYAATKKAGEEITHTYNHIYGLSITGLRFFTVYGPWGRPDMAYFSFTRNILQGKPITIYRGKNRVDLARDFTYIDDIVKGCLGSLDTSGKSTGSGGKKRGAAPYRIFNLGNTSPVTVPTLVNILERHLRTKAKKNVVEMPGNGDVPFTHANISLARRELGYKPTTDLQTGLKKFVRWYLSYYGYNHGKPVN

SEQ ID NO: 5584 - protein, 433 aa, Ricinus communis
MPSLEEELFPSTPGKFKIDRGGHTMNRQFYRCFTSTSTMFLWALFLIALTASYLSFQSFIDSGSKYFSASWGGLQWEKQVRNSAQIHRPSGGVSVLVTGAAGFVGTHVSLALKKRGDGVVGLDNFNNYYDPSLKKARKSLLNSHGVFIVEGDVNDARLLAKLFDVVAFSHVMHLAAQAGVRYAMENPHSYVHSNIAGLVTLLEACKSANPQPAIVWASSSSVYGLNDKVPFSESDRTDQPASLYAATKKAGEEITHTYNHIYGLSITGLRFFTVYGPWGRPDMAYFSFTRNILQGKPITVYRGKNRVDLARDFTYIDDIVKGCVGSLDTAGKSTGSGGKKRGPAPYRIFNLGNTSPVTVPTLVSILEKHLKMKAKRNVVDMPGNGDVPFTHANISLARRELGYKPTTDLQTGLKKFVRWYLSYYGYNHGKAVN

SEQ ID NO: 5585 - protein, 433 aa, Ricinus communis
MPSLEEELFPSTPGKFKIDRGGHTMNRQFYRCFTSTSTMFLWALFLIALTASYLSFQSFIDSGSKYFSASWGGLQWEKQVRNSAQIHRPSGGVSVLVTGAAGFVGTHVSLALKKRGDGVVGLDNFNNYYDPSLKKARKSLLNSHGVFIVEGDVNDARLLAKLFDVVAFSHVMHLAAQAGVRYAMENPHSYVHSNIAGLVTLLEACKSANPQPAIVWASSSSVYGLNDKVPFSESDRTDQPASLYAATKKAGEEITHTYNHIYGLSITGLRFFTVYGPWGRPDMAYFSFTRNILQGKPITVYRGKNRVDLARDFTYIDDIVKGCVGSLDTAGKSTGSGGKKRGPAPYRIFNFGNTSPVTVPTLVSILEKHLKMKAKRNVVDMPGNGDVPFTHANISLARRELGYKPTTDLQTGLKKFVRWYLSYYGYNHGKAVN

SEQ ID NO: 5586 - protein, 431 aa, Castanea mollissima
MPSLEEELFPSTPGKFKIDRAHSMNRQFHRCFASTSTMFLWALFLIALTASYLSFQSFVDTGSKYFAASWGGLQWEKQVRVSSQIRRSGGMSVLVTGGAGFVGTHVSLALKRRGDGVVGLDNFNNYYDPSLKKARRALLESHGVFVVEGDINDSRLLEKLFDIVAFTHVMHLAAQAGVRYAMENPNSYVHSNIAGLVSLLEACKSANPQPSVVWASSSSVYGLNEKVPFSESDRTDQPASLYAATKKAGEEITHTYNHIYGLSITGLRFFTVYGPWGRPDMAYFSFTRNILQGKPIKIYRGKNRVDLARDFTYIDDIVKGCLGSLDTSGKSTGSGGKKRGPAPYRIFNLGNTSPVTVPTLVSILERYLKTKAKRNLVDMPGNGDVPFTHANISLARSELGYKPTTDLQTGLKKFVRWYLSYYGYNHGKPVN

SEQ ID NO: 5587 - protein, 431 aa, Cucumis melo
MPSLEDELFPSTPGKFKIDRNHPMNRQFHRCFASTSTMFLWALFLIALTASYLSFQSFVDSGSRYFSASWGGIQWEKQVRVSAQPHRTNGFSVLVTGAAGFVGSHVSLALKKRGDGVVGLDNFNSYYDPSLKKARKSLLSNHGIFVVDGDINDVRLLDKLFDVVVFTHVMHLAAQAGVRYAMENPNSYVHSNIAGLVTLLEACKSANPQPAVVWASSSSVYGLNEKVPFSESDRTDQPASLYAATKKAGEEITHTYNHIYGLSITGLRFFTVYGPWGRPDMAYFSFTRNILQGKPITVFRGKNRVDLARDFTYIDDIVKGCLGSLDTSGKSTGSGGKKTGPAPYRIFNLGNTSPVTVPTLVSILERHLKVKAKKNVAEMPGNGDVPFTHANISSARRELGYKPTTDLQTGLKKFVRWYLSYYVYNHGKPVN

SEQ ID NO: 5588 - protein, 431 aa, Cucumis sativus
MPSLEDELFPSTPGKFKIDRNHPMNRQFHRCFASTSTMFLWALFLIALTASYLSFQSFVDSGSRYFSASWGGIQWEKQVRISAQPHRTNGFSVVVTGAAGFVGSHVSLALKKRGDGVVGLDNFNSYYDPSLKKARKSLLSNHGIFIVDGDINDVRLLDKLFDVVVFTHVMHLAAQAGVRYAMENPNSYVHSNIAGLVTLLEACKSANPQPAVVWASSSSVYGLNEKVPFSESDRTDQPASLYAATKKAGEEITHTYNHIYGLSITGLRFFTVYGPWGRPDMAYFSFTRNILQGKPITVFRGKNRVDLARDFTYIDDIVKGCLGSLDTSGKSTGSGGKKTGAAPYRIFNLGNTSPVTVPTLVSILERHLKVKAKKNVVEMPGNGDVPFTHANISSARRELGYKPTTDLQTGLKKFVRWYLSYYGYNHGKPVN

SEQ ID NO: 5589 - protein, 431 aa, Phaseolus coccineus
MPPLEDETFPSTPGKFKIERSHTMNRQLYRCFASTSTMFLWALFLIALTASYLSFQGFVDSGSRYLSASWGGIQWEKQVRTSAQIHRQGGMSVLVTGAAGFVGSHVSLALKRRGDGVVGLDNFNDYYDPSLKKARKSLLNTHEVFIVEGDVNDAKLLAKLFDVVAFTHVMHLAAQAGVRYAMENPQSYVHSNIAGLVTLLETCKSANPQPAIVWASSSSVYGLNEKVPFSESDRTDQPASLYAATKKAGEEITHTYNHIYGLSITGLRFFTVYGPWGRPDMAYFSFTRNILQGKPITVYRGKNRVDLARDFTYIDDIVKGCVGSLDTAGKSTGSGGKKRGPAPYRIFNLGNTSPVTVPTLVSILERHLKVKAKRNIVDMPGNGDVPFTHANISSARAELGYKPTTDLQTGLKKFVKWYLSYYGYNHGKPVN

SEQ ID NO: 5590 - protein, 431 aa, Quercus alba
MPSLEEELFPSTPGKFKIDRAHSMNRQFHRCFASTSTMFLWALFLIALTASYLSFQSFVDSGSKYFTASWGGLQWEKQVRVSSQIRRSGGMSVLVTGAAGFVGTHVSLALKRRGDGVVGLDNFNNYYDPSLKKARRALLDSHGIFVVEGDINDSRMLEKLFDIVAFTHVMHLAAQAGVRYAMENPNSYVHSNIAGLVSLLEACKSANPQPSVVWASSSSVYGLNEKVPFSESDRTDQPASLYAATKKAGEEITHTYNHIYGLSITGLRFFTVYGPWGRPDMAYFSFTRNILQGKPIKIYRGKNRVDLARDFTYIDDIVKGCLGSLDTSGKSTGSGGKKRGPAPYRIFNLGNTSPVTVPTLVSILERYLKTKAKRNLVDMPGNGDVPFTHANISLARSELGYKPTTDLQTGLKKFVRWYLSYYGYNHGKPVN

SEQ ID NO: 5591 - protein, 431 aa, Manihot esculenta
MPLLEEELFPSTPGKFKIDRAHTMGRHFHRCFASTSTMFLWALFLIALTASYLSFQSFIDSGSKYLSASWGGIQWEKQVRNSAQIQRAGGMSVLVTGAAGFVGTHVSLALKKRGDGVVGLDNFNNYYDPSLKKARKSLLAKHGIFIVEGDVNDARLLTKLFDVVAFTHVMHLAAQAGVRYAMENPHSYVHSNIAGLVTLLEVCKSADPQPAIVWASSSSVYGLNEKVPFSESDRTDQPASLYAATKKAGEEITHTYNHIYGLSITGLRFFTVYGPWGRPDMAYFTFTRSILQGKPITIYRGKNRVDLARDFTFIDDIVKGCVGSLDTAGKSTGSGGKKRGPAQYRIFNLGNTSPVTVPTLVSILEKHLKMKAKRKIVDMPGNGDVPFTHANISLARRELGYKPTTDLQTGLKKFVKWYLTYYGYNHGKVVN

SEQ ID NO: 5592 - protein, 431 aa, Citrus sinensis
MPSLEEELFPSTPGKFKIERSNTMNRQFHRCFTSTSTMFLWALFLVALTASYLSFQSFVDSGSRYFSASWGGIQWEKHVRSSAQIHRSGGMSVLVTGAAGFVGTHVSLALKKRGDGVVGLDNFNNYYDPSLKKARKALLNNHGIFVIEGDINDAKLLAKLFDAVAFTHVMHLAAQAGVRYAMQNPHSYVHSNIAGLVTLLEACKSANPQPSIVWASSSSVYGLNENVPFSEADRTDQPASLYAATKKAGEEIAHTYNHIYGLSITGLRFFTVYGPWGRPDMAYFSFTRNILQGKPITVYRGKNHVDLARDFTYIDDIVKGCLGSLDTSGKSTGSGGKKRGPAPYRIFNLGNTSPVTVPKLVNILERHLKVKAKKNVIEMPGNGDVPFTHANISSAQKEFGYRPTTDLQTGLKKFVRWYLSYYGYNRGKRVN

SEQ ID NO: 5593 - protein, 431 aa, Lotus japonicus
MPSLEEELFPSTPGKFKVERAHGMNRQLYRCFASTSTMFLWALFLIALTASYLSFQGFVDSGSRYLSASWGGIQWEKQVRTSAQIHRQGGMSVLVTGAAGFVGSHVSLALKRRGDGVVGLDNFNDYYDPSLKKARKTLLTTHGVFIVEGDVNDAKLLAKLFDVVAFTHVMHLAAQAGVRYAMENPHSYVHSNIAALVTLMEACKSANPQPAIVWASSSSVYGLNEKVPFSESDRTDQPASLYAATKKAGEEITHTYNHIYGLSITGLRFFTVYGPWGRPDMAYFSFTRNILQGKPITVYRGKNRVDLARDFTYIDDIVKGCVGSLDTAGKSTGSGGKKKGAAPYRIFNLGNTSPVTVPTLVSILEGHLKVKAKRNVVDMPGNGDVPFTHANISSARRELGYKPTTDLQTGLKKFVKWYLSYYGYNHGKPVN

SEQ ID NO: 5594 - protein, 413 aa, Zea mays
MSRHLHRCFASTGTMFLWALFLVAMTATYLSVHSFVDSTSPRYFAASWGGLHWERQIRASASPRRRSAPGAPAGLSVLVTGAAGFVGAHCSLALRKRGDGVVGIDSFNSYYDPSLKKARRALLGSHGVFVVEGDINDGRLLAKLFDVVPFTHVLHLAAQAGVRYAMENPASYVHSNVAGLVSLLEACKDADPQPAVVWASSSSVYGLNDRVPFSEAHRTDHPASLYAATKKAGEEIAHTYNHIYGLSVTGLRFFTVYGPWGRPDMAYFSFTRNILQGKPITVYRGRDHVDLARDFTYIDDIVLGCLASLDTAGRSTGTGGKKRGPAPYRIFNLGNTSPVTVPTMVSILERYLRVKAKKSVVEMPGNGDVPYTHANISLAREQLGYKPTTSLEVGLKKFVRWYLNYYGYKYTTG

SEQ ID NO: 5595 - protein, 431 aa, Populus trichocarpa
MPSLEEELFPSTPGKFKIDRAHNMNRQFNRCFASTSTMFLWALFLIALTASYLSFQSFVDSGSRYFTASWGGIQWEKQIRNSAQIHRSKGMSVLVTGAAGFVGSHVSLALKKRGDGVVGIDNFNNYYDPSLKKARKSLLNNQGIFIVEGDINDARLIAKLFDIVAFTHVMHLAAQAGVRYAMENPHSYVHSNIAGLVTLLEACKLANPQPSVVWASSSSVYGLNEKVPFSESDRTDQPASLYAATKKAGEEITHTYNHIYGLSVTGLRFFTVYGPFGRPDMAYFSFTRNILQGKPITVYRGKNRVDLARDFTYIDDIVKGCVGSLDTSGKSTGSGGKKRGPAPYRIFNLGNTSPVTVPTLVNILERHLKVKAKRNIVDMPGNGDVPFTHANISLAQRELGYKPTTDLETGLKKFVKWYLTYYGYNRGKAVH

SEQ ID NO: 5596 - protein, 431 aa, Glycine max
MPSLEEELFPSTPGKFKIERSHHMNRQLYRCFASTSTMFLWALFLIALTASYLSFQGFVDSGSRYLTASWGGIQWEKQVRTSAQIHRQGGMSVLVTGAAGFVGSHVSLALKRRGDGVVGLDNFNDYYDPSLKKARKSLLATHDVFIVEGDVNDAKLLAKLFDVVAFTHVMHLAAQAGVRYAMENPHSYVHSNIAGLVTLLEACKTANPQPAIVWASSSSVYGLNEKVPFSESDQTDQPASLYAATKKAGEEITHTYNHIYGLSITGLRFFTVYGPWGRPDMAYFSFTRNILQGKPITVYRGKNHVDLARDFTYIDDIVKGCVGSLDTSAKSTGSGGKKRGPAPYRIFNLGNTSPVTVPTLVSILERHLKVKAKRNIVDMPGNGDVPFTHANISSARRELGYKPTTDLQTGLKKFVKWYLSYYGYNHGKPVN

SEQ ID NO: 5597 - protein, 431 aa, Glycine max
MPSLEEELFPSTPGKFKIERAHHMNRQLYRCFASTSTMFLWALFLIALTASYLSFQGFVDSGSRYLSASWGGIQWEKQVRTSAQIHRQGGMSVLVTGAAGFVGSHVSLALKRRGDGVVGLDNFNDYYDPSLKKARKSLLAKHDVFIVDGDLNDAKLLAKLFDVVAFTHVMHLAAQAGVRYAMENPHSYVHSNIAGLVTLLEACKSANPQPAVVWASSSSVYGLNEKVPFSESDQTDRPASLYAATKKAGEEITHTYNHIYGLSITGLRFFTVYGPWGRPDMAYFSFTRNILQGKPITVYRGKNHVDLARDFTYIDDIVKGCVGSLDTSAKSTGSGGKKRGPAPYRIFNLGNTSPVTVPTLVSILERHLKVKAKRNIVDMPGNGDVPFTHANISSARRELGYKPTTDLQTGLKKFVKWYLSYYGYNHGKPVN

SEQ ID NO: 5598 - protein, 431 aa, Manihot esculenta
  misc_feature (283)..(283): Xaa can be any naturally occurring amino acid
  misc_feature (289)..(291): Xaa can be any naturally occurring amino acid
  misc_feature (297)..(297): Xaa can be any naturally occurring amino acid
MPLLEEELFPSTPGKFKIDRAHTMGRHFHRCFASTSTMFLWALFLIALTASYLSFQSFIDSGSKYLSASWGGIQWEKQVRNSAQIQRAGGMSVLVTGAAGFVGTHVSLALKKRGDGVVGLDNFNNYYDPSLKKARKSLLAKHGIFIVEGDVNDARLLTKLFDVVAFTHVMHLAAQAGVRYAMENPHSYVHSNIAGLVTLLEVCKSADPQPAIVWASSSSVYGLNEKVPFSESDRTDQPASLYAATKKAGEEITHTYNHIYGLSITGLRFFTVYGPWGRPDMAXFTFTRXXXQGKPIXIYRGKNRVDLARDFTFIDDIVKGCVGSLDTAGKSTGSGGKKRGPAQYRIFNLGNTSPVTVPTLVSILEKHLKMKAKRKIVDMPGNGDVPFTHANISLARRELGYKPTTDLQTGLKKFVKWYLTYYGYNHGKVVN

SEQ ID NO: 5599 - protein, 431 aa, Gossypium hirsutum
MPSLEDELFPSTPGKFKVDRAHNMNRQFHRCFASTSTMFLWALFLIALTASYLRFQSFVDSGSRYFSASWGGIQWEKQVRNSAQIHRSGGMSVLVTGAAGFVGTHVSLALKKRGDGVVGLDNFNNYYDPSLKKARKSLLNSHGILVVEGDLNDAKLLAKLFDVVAFTHVMHLAAQAGVRYAMENPNSYVHSNIAGLVTLLEICKSANPQPAVVWASSSSVYGLNEKVPFSEADRTDQPASLYAATKKAGEEITHTYNHIYGLSITGLRFFTVYGPWGRPDMAYFSFTRNILQGKPITIYRGKNRVDLARDFTYIDDIVKGCLGSLDTSGKSTGSGGKKKGNAPYRIFNLGNTSPVKVPELVNILERHLKVKAKRNIVDMPGNGDVPFTHANISLAQREFGYKPSTDLQTGLKKFVRWYLSYYGYNNRKGLQ

SEQ ID NO: 5600 - protein, 431 aa, Populus trichocarpa
MPALEDELFPSTPGKFKIDRAHTMNRHFHRCFGSTSTMFLWALFLVALTASYLSFQSFVYTGSRYLTASWGGIQWEKQIRHSAQIHRSNGMSVLVTGAAGFVGSHVSLALKKRGDGVVGIDNFNNYYDPSLKRARKSLLNNQGIFIVEGDINDARLIAKLFDTVAFTHVMHLAAQAGVRYAMENPHSYVHSNIAGLVTLLEACKSAYPQPSVVWASSSSVYGLNENVPFSESDRTDQPASLYAATKKAGEEITHTYNHIYGLSITGLRFFTVYGPWGRPDMAYFSFTRNILQGKPITVYRGKDRADLARDFTFIDDIVKGCVGSLDTSGKSTGSGGKKRGPAPYRIFNLGNTSPVTVPTLVSLLERHLKVKAKRNFVDMPGNGDVPFTHANISLAHRELGYKPTTDLATGLKKFVKWYLSYYGYNHGKAVN

SEQ ID NO: 5601 - protein, 406 aa, Cicer arietinum
MNRQVYRCFASTSTMFLWALFLIALTASYLSFQSFVDSGSRYLSASWGGIQWEKQVRTSAQIHRQGGMSVLVTGSAGFVGSHVSLALKRRGDGVVGLDNFNDYYDPSLKKARKTLLSSHGVFIVEGDINDAKLLAKLFDVVAFTHVMHLAAQAGVRYAMENPHSYVHSNIAGLVTLLEACKMANPQPSIVWASSSSVYGLNEKVPFSESDQTDQPASLYAATKKAGEEITHTYNHIYGLSITGLRFFTVYGPWGRPDMAYFSFTRNILQGKPITVYRGKNHVDLARDFTYIDDIVKGCVGSLDTSGKSTGSGGKKRGFAPYRIFNLGNNSPVTVPTLVSILERHLKVKAKRNIVDMAGNGDVPFTHANISLARRELGYKPTTDLQTGLKKFVKWYLSYYGYGKPVN

SEQ ID NO: 5602 - protein, 429 aa, Unknown
  Sequence found in Organisms: Arabidopsis thaliana, Arabidopsis lyrata
MPSIEDELFPSTPGKFKIDRSNRQLHRCFASTSTMFLWALFLIALTASYLSFQSFVDSGSRYLTASWGGIQWEKQVRTSAQIHRSGGISVLVTGATGFVGSHVSLALRKRGDGVVGLDNFNNYYDPSLKRARRSLLSSRGIFVVEGDLNDAKLLAKLFDVVAFTHVMHLAAQAGVRYALENPQSYVHSNIAGLVNLLEICKAANPQPAIVWASSSSVYGLNEKVPFSESDRTDQPASLYAATKKAGEEITHTYNHIYGLAITGLRFFTVYGPWGRPDMAYFSFTRNILQGKPITIYRGKNRVDLARDFTYIDDIVKGCLGSLDSSGKSTGSGGKKRGAAPYRIFNLGNTSPVTVPILVDILEKHLKVKAKRNFVEMPGNGDVPFTHANISSARNEFGYKPTTDLETGLKKFVRWYLSYYGYNTKAKLVH

SEQ ID NO: 5603 - protein, 426 aa, Aquilegia formosa
MRSLEDELFPSTPGKVKIERTNMLNRQFYRCFASTSTMFLWALFLIALTASYLSFQSFVDSGHRYLNASWGGIQWEKQVRNSAQTQKQRGGGSGGFSVLVTGSAGFVGSHVSIALKKRGDGVVGLDNFNNYYDPSLKKARKSLLNKNGIFVVEGDLNDARLLSKLFDIVAFTHVMHLAAQAGVRYAMENPGSYVHSNIAGLVTLLEACKSANPQPSIVWASSSSVYGLNDKVPFSELDQTDQPASLYAATKKAGEEITHTYNHIYGLSITGLRFFTVYGPWGRPDMAYFSFTRNILQGKPITVYRGKNRVDLARDFTYIDDIVKGCLGSLDTSGKSTGSGGKKRGPAPYRIFNLGNTSPVTVPTLVSILERHLKVKAKKNIVDMPGNGDVPFTHANISLASREFGYKPTTDLQTGLKKFVKWYLSY

SEQ ID NO: 5604 - protein, 453 aa, Oryza sativa
MRVVVEEEEAEVMYPSTPGKVKVEQRSSAAMSRQVHRCFASTGTMFLWALFLVAMTATYLSFRSLAGDAAASSSRYFPAASWGGLHWERQIRASASPRRPPGSAEGAGLSVLVTGAAGFVGAHCSLALRKRGDGVVGIDNYNSYYDPSLKKARRALLGSHGVFVVDGDINDGRLLAKLFDVVPFTHVLHLAAQAGVRYAMENPSSYVRSNVAGLVSLLESCKDADPQPAVVWASSSSVYGLNDAVPFSEAHRTDKPASLYAATKKAGEAITHTYNHIYGLSITGLRFFTVYGPWGRPDMAYFFFTRNILQGKPVTVYRGRDHVDIARDFTYIDDIVRGCLAALDTAGRSTGGGGRKRGAAPYRIFNLGNTSPVTVPALVAMLERCLMVKARRHVVEMPGNGDVPFTHANISLAREQLGYKPTTSLEMGLKKFVRWYLSYYGYNRGTHAFRSRL

SEQ ID NO: 5605 - protein, 434 aa, Fragaria vesca
  misc_feature (383)..(383): Xaa can be any naturally occurring amino acid
MPSPSQLEDELFPSTPGKFKIDRSHTMNRQFHRCFASTSTMFLWALFLIALTASYLSFQSFVDSGSRYFSASWGGIQWEKQVRNSAQIHRSGGMSILVTGAAGFVGTHVSVALKKRGDGVVGLDNFNNYYDPSLKKARRNLLKGHGIFIVEGDLNDNKLLDKLFDTVAFTHVMHLAAQAGVRYAMENPGSYVHSNIAGLVTLLEVCKSANPQPSIVWASSSSVYGLNDMVPFSESDRTDQPASLYAATKKAGEEITHTYNHIYGLSITGLRFFTVYGPWGRPDMAYFSFTRNILQGKSITVYRGKNHVDLARDFTYIDDIVKGCLGSLDTSGKSTGSGGKKRGPAPYRIFNLGNTSPVTVPTLVNILERHLKMKAKRNVVEMXGNGDVPFTHANISLARTQLGYKPTTDLQTGLKKFVRWYLSYYGYNNDKPVH

SEQ ID NO: 5606 - protein, 431 aa, Solanum phureja
MRGLEEEFIPSTPGKFKDKTYYSGNRQFHRCFASTSTMFLWALFLLALTASYLSFQSFMDSGTRYLSSTWGSLHWEKQVRDSAQIHRVNGMSVLVTGAAGFVGSHVSIALKKRGDGVVGIDNFNNYYDPSLKKARKNLLNLQNVFVIEGDINDVHLLAKLFDIVAFTHVMHLAAQAGVRYAMENPKSYVHSNIAGLVTLLEACKNANPQPAIVWASSSSVYGLNEKVPFSESDRTDQPASLYAATKKAGEEITHTYNHIYGLSITGLRFFTVYGPWGRPDMAYFSFTRNILQGKPITVYRGKNRVDLARDFTYIDDIVKGCVGSLDTAGKSTGSGGKKRGPAMFRIFNLGNTSPVTVPMMVAMLEKHLKVKAKKHVLDMPGNGDVPFTHANISLAQKELGYKPTTNLQTGLGKFVRWYLSYYGYRQEKSVK

SEQ ID NO: 5607 - protein, 428 aa, Euphorbia esula
  misc_feature (252)..(252): Xaa can be any naturally occurring amino acid
  misc_feature (372)..(372): Xaa can be any naturally occurring amino acid
MPSLHEELFPSTPGKFKIDRGNRQFHRCFASTSTLFLWALFLIALTASYLSFQSFIDSGSKYFSASWGGIQWEKQVRNSAQIHRNGGMSVLVTGAAGFVGSHVSLALKKRGDGVVGLDNFNNYYDPSLKKARKSLLSSHGIFIVEGDLNDALLLAKLFDVVAFTHVMHLAAQAGVRYAMENPNSYVHSNIAGLVNLLEVIKSANPQPAMVWASSSSVYGLNDKVPFSESDRTDQPASLYAATKKAGEEITHXYNHIYGLSITGLRFFTVYGPWGRPDMAYFSFTRNILQGKPITVYRGKNRVDLARDFTYIDDIVKGCVGSLDTAGKSTGSGGKKRGPAPYRIFNLGNTSPVTVPTLVNILERHLKKKAKRXMVDMPGNGDVPFTHANISLAQREFGYQPTTDLQTGLKKFVKWYLAYYGYNNGKAVN

SEQ ID NO: 5608 - protein, 389 aa, Tropaeolum majus
MFLWTLFLIAPTVSYLSFQSFVHTGSRYLSASWGGIQWEKQVRNSAQIHRPGGMAVLVTGAAGFVGSHVSLALKKRGDGVVGVDNFNNYYDPSLKKARKSLLKNHGIFVVEGDLNDGKLLAKLFDVVAFTHVMHLAAQAGVRYAMENPSSYVNSNIAGLVTLLEVCKSANPQPSIVWASSSSVYGLNTKVPFSESDQTDQPASLYAATKKAGKEITHTYNHIYGLSITGLRFFTVYGPWGRPDMAYFSFTRNILQGKPITIYRGKNQVDLARDFTFIDDIVKGCLGSLDTSGKSTGSGGKKRGPALYRIFNLGNTSPVTVPILVDILEKHLKVKAKRKYVDMPGNGDVPFTHANTTLARQSFGYKPTTDLQTGLKKFVRWYLSYYGYKN

SEQ ID NO: 5609 - protein, 293 aa, Solanum tuberosum
MRGLEEEFIPSTPGKFKDKTYYSGNRQLHRCFASTSTMFLWALFLLALTASYLSFQSFMDSGTRYLSSTWGSLHWEKQVRDSAQIHRVNGMSVLVTGAAGFVGSHVSIALKKRGDGVVGIDNFNNYYDPSLKKARKNLLNLQNVYLIEGDINDVHLLAKLFDIVAFTHVMHLAAQAGVRYAMENPKSYVHSNIAGLVTLLEACKNANPQPAIVWASSSSVYGLNEKVPFSESDRTDQPASLYAATKKAGEEITHTYNHIYGLSITGLRFFYCLRTVGKTRHGLFLIYPEYLTR

SEQ ID NO: 5610 - protein, 430 aa, Brassica napus
MPSIEDELMFPSTPGKFKIDRSNRQLNRCFASTSTMFLWALFLIALTASYLSFQSFVDSGSRYLTASWGGIQWEKQVRTSAQIHRSGGISVLVTGATGFVGSHVSLALRKRGDGVVGLDNFNNYYDPSLKRARMSLLSSRGIFVVEGDLNDGKLLSKLFDVVAFTHVMHLAAQAGVRYALENPQSYVHSNIAGLVNLLETCKAANPQPAVVWASSSSVYGLNEKVPFSESDRTDQPASLYAATKKAGEEITHTYNHIYGLAITGLRFFTVYGPWGRPDMAYFSFTRNILQGKPITIYRGKNRVDLARDFTFIDDIVKGCLGSLDSSGKSTGSGGKKRGSAPYRIFNLGNTSPVTVPILVDILEKHLKVKAKRNFVEMPGNGDVPFTHANISSARREFGYKPTTDLETGLKKFVRWYLSYYGYNTKAKLVQ

SEQ ID NO: 5611 - protein, 430 aa, Brassica napus
MPSIEDELMFPSTPGKFKIDRSNRQLNRCFASTSTMFLWALFLIALTASYLSFQSFVDSGSRYLTASWGGIQWEKQVRTSAQIHRSGGISVLVTGATGFVGSHVSLALRKRGDGVVGLDNFNNYYDPSLKRARMSLLSSRGIFVVEGDLNDGKLMSKLFDVVAFTHVMHLAAQAGVRYALENPQSYVHSNIAGLVNLLETCKAANPQPAVVWASSSSVYGLNEKVPFSESDRTDQPASLYAATKKAGEEITHTYNHIYGLAITGLRFFTVYGPWGRPDMAYFSFTRNILQGKPITIYRGKNRVDLARDFTFIDDIVKGCLGSLDSSGKSTGSGGKKRGAAPYRIFNLGNTSPVTVPILVDILEKHLKVKAKRNFVEMPGNGDVPFTHANISSARREFGYKPTTDLETGLKKFVRWYLSYYGYNTKAKLVQ

SEQ ID NO: 5612 - protein, 430 aa, Brassica napus
  misc_feature (396)..(396): Xaa can be any naturally occurring amino acid
  misc_feature (402)..(402): Xaa can be any naturally occurring amino acid
MPSIEDELMFPSTPGKFKIDRSNRQLNRCFASTSTMFLWALFLIALTASYLSFQSFVDSGSRYLTASWGGIQWEKQVRTSAQIHRSGGISVLVTGATGFVGSHVSLALRKRGDGVVGLDNFNNYYDPSLKRARMSLLSSRGIFVVEGDLNDGKLLSKLFDVVAFTHVMHLAAQAGVRYALENPQSYVHSNIAGLVNLLETCKAANPQPAVVWASSSSVYGLNEKVPFSESDRTDQPASLYAATKKAGEEITHTYNHIYGLAITGLRFFTVYGPWGRPDMAYFSFTRNILQGKPITIYRGKNRVDLARDFTFIDDIVKGCLGSLDSSGKSTGSGGKKRGSAPYRIFNLGNTSPVTVPILVDILEKHLKVKAKRNFVEMPGNGDVPFTHANISSARRXFGYKPXTDLETGLKKFVRWYLSYYGYNTKAKLVQ

SEQ ID NO: 5613 - protein, 322 aa, Oryza sativa
MAAALSFPIIDMSLLDGAERPAAMGLLRDACESWGFFEILNHGISTELMDEVEKMTKDHYKRVREQRFLEFASKTLKEGCDDVNKAEKLDWESTFFVRHLPESNIADIPDLDDDYRRLMKRFAAELETLAERLLDLLCENLGLEKGYLTKAFRGPAGAPTFGTKVSSYPPCPRPDLVKGLRAHTDAGGIILLFQDDRVGGLQLLKDGEWVDVPPMRHSIVVNLGDQLEVITNGRYKSVMHRVVAQIDGNRMSIASFYNPGSDAVISPAPALVKEEEAGETYPKFVFEDYMKLYVRHKFEAKEPRFEAFKAMENETPNRIAIA

SEQ ID NO: 5614 - protein, 323 aa, Saccharum officinarum
MAPALSFPIIDMGLLGGEERPAAMELLRDACENWGFFEILNHGISTELMDEVEKLTKDHYKRVREQRFLEFASKTLKDAQDVKAAENLDWESTFFVRHLPESNIAEIPDLDDDYRRAMRRFAGELEALAERLLDLLCENLGLDRGYLARAFRGPRTGAPTFGTKVSSYPPCPRPDLVSGLRAHTDAGGIILLFQDDRVGGLQLLKDGAWVDVPPLRHSIVVNLGDQLEVITNGRYKSVMHRVVAQPDGNRMSIASFYNPGSDAVIFPAPALVKAEEAAAGAYPRFVFEDYMKLYVRHKFEAKEPRFEAFKSVETDSSNCIAIA

SEQ ID NO: 5615 - protein, 326 aa, Zea mays
MAPALSFPIIDMGLLAGEERPAAMELLQDACENWGFFEILNHGISTELMDEVEKLTKEHYKRVREQRFLEFASKTLGDGRDIAQGVKAENLDWESTFFVRHLPEPNIAEIPDLDDEYRRVMKRFAGELEALAERLLDLLCENLGLDRGYLARAFRGPSKGAPTFGTKVSSYPPCPRPDLVSGLRAHTDAGGIILLFQDDRVGGLQLLKDGEWVDVPPMRHAVVVNLGDQLEVITNGRYKSVMHRVVAQPSGNRMSIASFYNPGSDAVIFPAPALVKAEEAAAGAYPSFVFEDYMKLYVRHKFEAKEPRFEAFKSMETDSSNRIAIA

SEQ ID NO: 5616 - protein, 323 aa, Saccharum officinarum
MAPALSFPIIDMGLLGGEERPAAMELLRDACENWGFFEILNHGISTELMDEVEKLTKDHYKRVREQRFLEFASKTLKDAQDVKAAENLDWESTFFVRHLPESNIAEIPDLDEDYRRAMRQFAGELEALAERLLDLLCENLGLDRGYLARAFRGPRTGAPTFGTKVSSYPPCPRPDLVSGLRAHTDAGGIILLFQDDRVGGLQLLKDGAWVDVPPLRHSIVVNLGDQLEVITNGRYKSVMHRVVAQPDGNRMSIASFYNPGSDAVIFPAPALVKAEEAAAGAYPRFVFEDYMKLYVRHKFEAKEPRFEAFKSVETDSSNCIAIA

SEQ ID NO: 5617 - protein, 329 aa, Cenchrus ciliaris
  misc_feature (126)..(126): Xaa can be any naturally occurring amino acid
  misc_feature (160)..(160): Xaa can be any naturally occurring amino acid
  misc_feature (167)..(167): Xaa can be any naturally occurring amino acid
MAPALSFPIIDMGLLAGEERPAAMELLRDACENWGFFQILNHGISTELMDEVERLTKDHYKRVREQRFLEFASKALKDDDGGDAQRAKAAENLDWESTFFVRHLPESNLADIPDLDDAYRRAMKRXAGELEALAERLLDLLCENLGLEKGYLARAFRGPXRGAPTFXTKVSSYPPCPRPDLVKGLRAHTDAGGIILLFQDDRVGGLQLLKDGEWVDVPPTRHSIVVNLGDQLEVITNGRYKSVVHRVVAQTDGNRMSIASFYNPGGDAVIFPAPALVRADEAAGAAAYPKFVFEDYMKLYVRHKFEAKEPRFEAFKSMETETSNRIAIA

SEQ ID NO: 5618 - protein, 325 aa, Panicum virgatum
MAPALSFPVIDMGLLGGEERPAAMELLRDACENWGFFEILNHGISTELMDEVEKLTKDHYKRVREQRFLEFAGKALQDGGDDARGVKAENLDWESTFFVRHLPESNLAELPDLDDGYRRVMKRFAGELEALAERLLDLLCQNLGLEKGYLARAFRGPSGVPTFGTKVSSYPPCPRPDLVSGLRAHTDAGGIILLFQDDRVAGLQLLKDGEWVDVPPMRHSIVVNLGDQLEVITNGRYKSVMHRVVAQPDGNRMSIASFYNPGGDAVIFPAPALVKAEEAAEAYPRFVFEDYMKLYMRHKFEAKEPRFEAFRSVETESSNRSIAIA

SEQ ID NO: 5619 - protein, 318 aa, Panicum virgatum
  misc_feature (28)..(28): Xaa can be any naturally occurring amino acid
MAPALSFPVINMGLLGGEERPAAMELLXDACENWGFFEILNHGISTELMDEVEKLTKDHYKRVREQRFLEFASKALQDGGDDDARGVKAGNLDWESTFFVRHLPESNLAELPDLDDGYRRVMKRFAGELEALAERLLDLLCENLGLEKGYLARAFRGPRGAPTFGTKVSSYPPCPRPDLVSGLRAHTDAGGIILLFQDDRVGGLQLLKDGEWVDVPPMRHSIVVNLGDQLEVITNGRYKSVVHRVVAQPDGNRMSIASFYNPGGDAVIFPAPGAGEDRGGRGGVPQVRVRGLHEAVHAAQVRGQGATLRGLQVHGDRE

SEQ ID NO: 5620 - protein, 320 aa, Hordeum vulgare
MAPASSFPIIDMGLLAGGGEERPAAMDLLHDACENWGFFQVLDHGISTELMDEVERMTKGHYKRVREQRFLEFASKTLEDGGGRAAENLDWESTFFVRHLPEPNIAEIPDLDDEYRRVMKRFASELETLAERLLDLLCENLGLEKGYLTRAFRGSKGVPTFGTKVSSYPPCPRPDLVKGLRAHTDAGGIILLFQDDRVGGLQLLKDGEWVDVPPTRHSIVVNLGDQLEVITNGRYKSVLHRVVAQTDGNRMSIASFYNPASDAVIFPAPALAEAAGGAYPKFVFEDYMKLYVRHKFEDKEPRFEAFKSVERQSSNLIATA

SEQ ID NO: 5621 - protein, 321 aa, Brachypodium distachyon
MAPASSFPIIDMGLLGGEERPAAMELLHDACENWGFFQVLDHGISTELLDEVEKMTKAHYKRVREQRFLEFASKTLEGGKADTENLDWESTFFVRHLPEPNIGDIPDLDDDYRRVMKQFAAELEKLAERLLDLLCENLGLEKGYLTRAFRAGSKAGVPTFGTKVSSYPPCPRPDLVKGLRAHTDAGGIILLFQDDQVGGLQLLKDGAWVDVPPTRHSIVVNLGDQLEVITSGRYKSVLHRVVAQTDGNRMSIASFYNPASDAVIFPAPALVKKEAGAGTYPKFVFEDYMKLYVRHKFEDKEPRFEAFMSMETDTSKLIATA

SEQ ID NO: 5622 - protein, 319 aa, Triticum aestivum
  misc_feature (236)..(236): Xaa can be any naturally occurring amino acid
  misc_feature (243)..(243): Xaa can be any naturally occurring amino acid
  misc_feature (258)..(258): Xaa can be any naturally occurring amino acid
MASTLSFPIIDMGLLRGEERPAAMNLLHDACQNWGFFQVLDHGISTELMDEVEKMTKEHYKRVREQRFLEFASKTLQDGDKAAENLDWESTFFVRHLPEPNIAEIPDLDDEYRRVMKQFAAELERLAERLLDLLCENLGLEKGYLTRAFRGSKGVPTFGTKVSSYPPCPRPDLVKGLRAHTDAGGIILLFQDDRVGGLQLLRDGEWVDVPPTRHSIVVNLGDQLEVITNGRYKSVXHRVVAQXDGNRMSIASFYNPAXDAVIFPAPALVEAEAAGGAYPRFVFEDYMKLYVRHKFEDKEPRFEAFKSMDSHSSNLIATA

SEQ ID NO: 5623 - protein, 316 aa, Leymus cinereus x Leymus triticoides
MAPASSFPIIDMGLLGGEERPAAMHLLHDACENWGFFQVLEHGISTELMEEVEKMTKGHYKRVREQRFLEFASKTLESGGKAVDWESTFFVRHLPEPNIADIPDLDDEYRRVMKQFATELEKLAERLLDLLCENLGLEKEYLTRAFRGSKGVPTFGTKVSSYPPCPCPDLVKGLRAHTDAGGIILLFQDDRVGGLQLLKDGEWVDVPPTRHSIVVNLGDQLEVITDGRYKSVLHRVVAQTDGNRMSIASFYNPASDAVIFPAPALVEAAGGTYPKFVFEDYMKLYVRHKFEDKEPRFEAFKSMESQSSNSKLIAIA

SEQ ID NO: 5624 - protein, 345 aa, Panicum virgatum
MAPALSFPIIDMGRLAGEERPAAMDMLRDACEKWGFFQILNHGISTELMDEVERLTKDHYKRVREQRFLEFASRALQDGGGGGARGVKAENLDWESTFFVRHLPESNLAELPDLDDGYRRAMRRFAGELEALAERLLDLLCENLGLEKGYLARAFRGPSKGLPDLRHQGQQLPAVPAPGPRERPARAHRRRRHHPAVPGRPRRRAAAAQGRRVGGRAAHAPLHRGEPGRPAGGDHKRQVQERGAPGGGAARREPDVHRVLLQPRRRRRHLPGAGAGEGRGGRGGVPQVRVRGLHEAVRAEQVRGQGAAVRGLQVHGDGELQLHHRHRVTTRQGMPESGVLYVSLA

SEQ ID NO: 5625 - protein, 319 aa, Triticum aestivum
  misc_feature (117)..(117): Xaa can be any naturally occurring amino acid
  misc_feature (141)..(141): Xaa can be any naturally occurring amino acid
  misc_feature (153)..(153): Xaa can be any naturally occurring amino acid
  misc_feature (155)..(155): Xaa can be any naturally occurring amino acid
MAPASSFPIIDMGLLAGEERPAAMDLLHDACENWGFFQVLDHGISTELMDEVEKMTKGHYKRVREQRFLEFASKTLQDGGRAAENLDWESTFFVRHLPEPNIAEIPDLDDDYRRVMXQFASELERLAERLLDLLCENLGLXKGYLTRAFRGSXGXPTFGTKVSSYPPCPRPDLVKGLRAHTDAGGIILLFQDDRVGGLQLLRDGEWVDVPPTRHSIVVNLGDQLEVITNGRYKSVLHRVVAQADGNRMSIASFYNPASDAVIFPAPALAEAEAAGGAYPRFVFEDYMKLYVRHKFEDKEPRFEAFKSMESQSTKLIATA

SEQ ID NO: 5626 - protein, 317 aa, Triticum aestivum
MAPASSFPIIDMGLLAGEERPVAMDLLHDACVNWGFFQVLDHGISTELMDEVEKMTKEHYKRVREQRFLEFASKTLEGGGRAAENLDWESTFFVRHLPEANIAEIPDLDDDYRRVMKQFAAELERLAERLLDLLCENLGLEKGYLTRAFRGSKGVPTFGTKVSSYPPCPRPDLVKGLRAHTDAGGIILLFQDDCVGGLQLLKDGEWVDVPPTRHSIVVNLGDQLEVITNGRYKSVLHRVVAQADGNRMSIASFYNPASDAVIFPAPALAEAAGGAYPRFVFEDYMKLYVRHKFDDKEPRFEAFKSMESQSTKLIATA

SEQ ID NO: 5627 - protein, 327 aa, Brachypodium distachyon
MAPASSFPIIDMGLLGGEERPAAMELLHDACENWGFFQVLDHGISTELLDEVEKMTKAHYKRVREQRFLEFASKTLEGGKADTENLDWESTFFVRHLPEPNIGDIPDLDDDYRRVMKQFAASWRSWRSAPGPALREPRPGERLPHARLRAGLQGRRPDLRHQGQQLPAVPSPGPRQGPPRPHRRRRHHPALPGRPSRRPPAAQGRRLGRRAAHAPLHRRQPRRPAGGHHQWEVQERAPPRGRADRRQPHVHRVLLQPGQRRRHLPGAGAGEEGSRRRDVPQVRVRGLHEAVRAPQVRGQGAQVRGLHVHGDRHLQAHRHRLIYLALL

SEQ ID NO: 5628 - protein, 329 aa, Sorghum bicolor
MAPALSFPIIDMGLLAGEERPAAMELLRDACENWGFFEILNHGISTELMDEVEKLTKDHYKRVREQRFLDFASKTLADAKAAENLDWESTFFVRHLPESNLAEIPDLDDGYRRVMRRFAGELEALAERLLDLLCENLGLEGGYLARAFRGRSTGAPTFGTKVSSYPPCPRPDLVSGLRAHTDAGGIILLFQDDRVGGLQLLKGGEWVDVPPLRHAIVVNLGDQLEVVTNGAYKSVMHRVVAQPDGNRMSIASFYNPGSDAVIFPAPALVNKAQDQEAAAGNGDGVGVYPRFVFEDYMKLYVRHKFEAKEPRFEAFRSMETDSSNCIAIA

SEQ ID NO: 5629 - protein, 335 aa, Sorghum bicolor
MAAARYDVEKGGRNGEGKQRYSPQAEHLYPPQRDGEREWVPWFVPLVAAVNIVLFAVAMYVNNCPAHASRRGGGGAGACVARGFLHRFSFQPLSENPLLGPSSATLQKLGALVWDKVVQEHQGWRLVTCIWLHAGVAHLLANMVSLVLIGLRLEQQFGYVRIGIIYLVSGVGGSVLSSLFVRNTISVGASGALFGLLGAMLSELFTNWTIYSNKAAALVTLLIVIAINLAIGILPHVDNFAHIGGFLTGFLLGFVFLMRPHYGWMQRYVLPSDVKYTSKKYLAYQWALLAVASVLAVVGFAVGLGMLFRGVNANDHCGWCHYLSCVPTSRWSCGK

SEQ ID NO: 5630 - protein, 334 aa, Zea mays
MAAARYDVEKGGRNNGDGKPSPPPPGHLYPQRDGEREWVPWLVPLVVAVNIVLFAVAMYVNNCPAHAASSRRGGAGSCVARGFLHRFSFQPLSENPLLGPSSATLQKLGALVWDKVVREHQGWRLVTCIWLHAGVAHLLANMISLVLIGLRLEQQFGYVRVGIIYLVSGVGGSVLSSLFIRNNISVGASGALFGLLGAMLSELFTNWTIYANKAAALVTLLVVIAINLAIGILPHVDNFAHIGGFLTGFLLGFVLLMRPHYGWMQRYALPSDVKYTTKKYLAYQWALLAVASVLAVIGFAVGLGMLFRGVNANDHCGWCHYLSCVPTSRWSCGK

SEQ ID NO: 5631 - protein, 330 aa, Panicum virgatum
  misc_feature (10)..(10): Xaa can be any naturally occurring amino acid
  misc_feature (144)..(144): Xaa can be any naturally occurring amino acid
  misc_feature (147)..(147): Xaa can be any naturally occurring amino acid
  misc_feature (274)..(274): Xaa can be any naturally occurring amino acid
  misc_feature (324)..(324): Xaa can be any naturally occurring amino acid
MAAARYDVEXGGRGGEGKYPPPPEQMYPQREGEREWVPWFVPVVVAANIALFAVVMYVNNCPAHAASTRGGGACVARGFLHRFAFQPLSENPLLGPSSAALQKLGALVWDKVVHEHQGWRLLTCIWLHAGVVHLLANMLSLVLXGLXLEQQFGYLRIGVIYIVSGVGGSVLSSLFIRNNISVGASGALFGLLGAMLSELFTNWTIYSNKAAALVTLLVVIAINLAIGILPHVDNFAHIGGFLTGFLLGFIFLMRPHYGWMQRYVRPSDIKYTTXKYLPYQWVLLAVASVLAVLGFAVGMGMLFKGVNANDHCQWCHYLSCVPTXRWSCGK

SEQ ID NO: 5632 - protein, 378 aa, Zea mays
MMMMGEGVSVPPWSHHVPVSGVDVGVGGDEMTPYLLAALRQYLPCNDAGAAEADDEEAAAMAAGVDGYGCDEFRMYEFKVRRCARARSHDWTECPFAHPGEKARRRDPRRYHYSGAACPDFRKGGCRRGDACDFAHGVFECWLHPARYRTQPCKDGTACRRRVCFFAHTPDQLRVLPPTPQQSSASPRGAGALPESYDGSPLRRQAFETYLTKSIVSSSPTSTLLSPPKTPPSESPPLSPDGAAAAFRRGSWPGAGSPVNDVLASLRQLRLGTASSSPSGGWGGYPASAAAYGSPTAGGLYSLPSTPTALATASGYMPNLEPLDVSFGGDEEPVERVESGRALRAKVFERLSREGAVSCYPAAGTGGPDVGWVSDLIN

SEQ ID NO: 5633 - protein, 346 aa, Zea mays
MMMMGEGVSMPPWSHHVPVSGVDEGDEMTPYLLAALRQYLPCNDAGAEAEEDEAAARRRHGGGRGRLRLRRVPHVRVQGPAVRARAQPRLDRVPLRAPGGEGAAPRPAQVPLLRRRLPGLPQGRVQARRRLRHGARRLRVLAPPGALPHPALQGRHGLPPPGLLLRAHRGPAARAPAHASAAVQPQGRRLLFPARRVLRRLPAPAPGVRELPHQEHHVLVADQHPPVAAQVAPVGVPAIVARLPPWVLAGRRVPRQRRARLAPPAPPQQGQLVPVGRLVRLPCIRGRVRIAYGGRALRPVLHPEGHRRILLHGQPGPSRRQLRRRRRARGEGGVRPRPPREGVRAA

SEQ ID NO: 5634 - protein, 387 aa, Cenchrus ciliaris
  misc_feature (321)..(321): Xaa can be any naturally occurring amino acid
MMMMGEGVSVPPWSHHHLPVSGVDVGGGAGNGDEMTPYLLAALRQYLPYNDAGGAADDEEAAAAAAMAAGVDGYGSDDFRMYEFKVRRCTRARSHDWTECPFAHPGEKARRRDPRKYHYSGTACPDFRKGGCKRGDACEYAHGVFECWLHPARYRTQPCKDGTACRRRVCFFAHTPDQLRVLPPQQSSPRGAVAGAAAAASPLTESYDGSPLRRQAFESYLTKSIMSSSPTSTLMSPPKSPPSDSPPLSPDGAAAYRRGSWPGVGSPVNEVLASLRQLRLSKANSSPSGGWAGYPSSTVAYGSPTAAGLYSLPSTPTTMGXGFMTNLEPLDVSFGGGEDEPVRRVESGRALRAKVFERLSREGAVSAEPATGGFGGPDVGWVSDLIN

SEQ ID NO: 5635 - protein, 324 aa, Saccharum officinarum
MATRADVEKGGVRKEPGKVPSPLYPQHEGEREWVPWIVPVFFVANITVFVIAMYVNNCPAHTTPRDGKCVARFLGRFSFQPLRQNPLLGPSSATLTKMGALVWEKVVHHHQGWRLLSSMWLHAGVLHLVANMLCLLFVGMRLEQQFGYVRIGAIYVLSGLGGAVLSSLFIRNHISVGASGALFGLLGAMLSELLTNWTIYTNKAAAVATLLFVAAVNLVLGILPHVNNFAHVGGFLAGFLLGFVVLMRPHFGWMERYSLPAGAPCTARKYLAYQWILLAVALLLLVVGFAVGMAMVFRGANAKDSCHWCHYLSCVPTARWNCTN

SEQ ID NO: 5636 - protein, 325 aa, Saccharum officinarum
MATRADVEKGGGVRKEPGKVPSPLYPQHEGEREWVPWIVPVFFVANITVFVIAMYVNNCPAHTTPRDGKCVARFLDRFSFQPLRQNPLLGPSSATLTKMGALVWEKVVHHHQGWRLLSSMWLHAGVLHLVANMLCLLFVGMRLEQQFGYVRIGAIYVLSGLGGAVLSSLFIRNHISVGASGALFGLLGAMLSELLTNWTIYTNKAAAVATLLFVAAVNLVLGILPHVNNFAHVGGFLAGFLLGFVVLMRPHFGWMERYSLPAGAPCTARKYLAYQWILLAVALLLLVVGFAVGMAMVFRGANAKDSCHWCHYLSCVPTARWNCTN

SEQ ID NO: 5637 - protein, 324 aa, Panicum virgatum
MATRGDVEKGGVKKEAGKVPSPLYPQHEGEREWVPWIVPVFFVANITVFVVTMYVNNCPAHTTARDGKCIGRFLGRFAFQPLRQNPLLGPSSATLTKLGALVWQKVVHEHQGWRLLSSMWLHAGVVHLVANMMSLLFIGMRLEQQFGYVRIGAVYLLSGLGGSVLSSLFIRNHISVGASGALFGLLGAMLSELLTNWTIYTNKVAAVLTLLFVVAVNLVLGILPHVNNFAHIGGFLTGFLLGFVVLMRPHFGWMERYGMPAGSACTSRKYLLYQWILMAIALLLLVIGFAVGMAMLFRGSNANDSCSWCHYLSCVPTARWTCTN

SEQ ID NO: 5638 - protein, 322 aa, Zea mays
MATRADVEKGGPARKEPGKVPSPLYPQHEGEREWVPWLVPVIFVASITVFVVTMYANNCPARDTNKCVARFLGRFSFQPLRQNPLFGPSSATLTKMGALVWEKVVHRHQGWRLLSSMWLHAGVIHLVANMLCLLFIGMRLEQQFGYVRIGAIYVLSGVGGAVLSSLVVRNRVTVGASGALLGLLGAMLSELLTNWTIYTNKAAAVATLLSVAAVNLVLGVLPHVDNLAHLGGFLAGFLLGFVVLMRPHLGWMERYGLPAGAPCTARKYLAYQWTLLAVAIIILLVGFAAGMAMLFRGANANDSCHWCHYLSCVPTARWNCTN

SEQ ID NO: 5639 - protein, 325 aa, Oryza sativa
MATSHADVEKGARRKEVGKVPSPLYPQHEGEREWVPWIVPSFLVANIVVFVLTMYANNCPLHTPPRSGKCIARFLGRFSFQPLHENPLLGPSSATLQKMGALVWDKVVHEHQGYRLITSIWLHAGVLHLVANMLSLIFIGLRLEQQFGYVRIGAIYLLSGLGGSVLSSLFIRNHISVGASGALFGLLGAMLSELLTNWTIYTNKVAAVITLLFVIAVNLALGILPHVNNFAHIGGFLTGFLLGFVLLMRPHFGWMERYSLPSGSPCSSKKYLVYQWILLAIATALVIVGFAVGMTMLFRGENANDSCHWCHYLSCVPTSRWTCSN

SEQ ID NO: 5640 - protein, 331 aa, Brachypodium distachyon
MASRADVEKGGKQGGKVVPAPLYPQHEGEREWTPWLVPSILVANIVVFAITMYYNNCPAHNANTGTRGGSKQQQQCVAGFLGRFSFQPLRQNPLLGPSSATLEKMGALVWDKVVHSHQGWRLLSCMWLHAGILHLLANMLSLLFIGLRLEQQFGYVRIGAIYLLSGIGGSVLSSLFIRTSISVGASGALFGLLGAMLSELLTNWTIYTNKVAAVMTLLFVITVNLVLGILPHVNNFAHIGGFLAGFLLGFVVLMRPHYGWMERYSLPAGTPCTSRKYLLYQWVLMAVALLLGVIGFAAGLAMVFRGVNANSSCHWCHYLSCVPTARWTCAN

SEQ ID NO: 5641 - protein, 281 aa, Saccharum officinarum
MEFEDRCHKVQEPKFDCLLFDLDDTLYPLSSGIAGHVKKNIEDYMVEKLGIDESKIENLGNLLYKNYGTTMAGLRAIGYSFDYDEYHAFVHGRLPYDNIKPDPVLKHILKNLRVRKLIFTNGDMVHAVRALERLGLEDCFEGIICFETLNPPCPPQGDQEPEIFDIAGHFARSGTADELPKTPVLCKPNVDAMEEALRIANVNPHKAIFFDDSVRNIQAGKQIGLHTVLVGKSQRVKGADHALESIHNIREALPELWEEAEKAKEDVLYAERVAMETSVTA

SEQ ID NO: 5642 - protein, 281 aa, Saccharum officinarum
MEFEDRCHKVQEPKFDCLLFDLDDTLYPLSSGIAGHVKTNIEDYMVEKLGIDESKIENLGNLLYKNYGTTMAGLRAIGYSFDYDEYHAFVHGRLPYDNIKPDPVLKHILKNLRVRKLIFTNGDMVHAVRALERLGLEDCFEGIICFETLNPPCPPQGDQEPEIFDIAGHFARSGTADELPKTPVLCKPNVDAMEEALRIANVNPHKAIFFDDSVRNIQAGKQIGLHTVLVGKSQRVKGADHALESIHNIREALPELWEEAEKAKEDVLYAERVAMETSVTA

SEQ ID NO: 5643 - protein, 280 aa, Zea mays
MEFEDRCHKVQEPKFDCLLFDLDDTLYPLSAGIAGHVKKNIEDYMVEKLGIDETKIENLGNLLYKNYGTTMAGLRAIGYSFDYDEYHAFVHGRLPYDNIKPDPILKHILKNLRIRKLIFTNGDMVHAVRALKRLGLEDCFEGIICFETLNPPCPPQGDQEPEIFDIAGHFARSGTADELPKTPVLCKPNVDAMEEALRIANVNPHKAIFFDDSVRNIQAGKQIGLHTVLVGKSQRVKGADHALESIHNIREALPELWEEAEKAEDVLYPERVAMETSVTA

SEQ ID NO: 5644 - protein, 280 aa, Panicum virgatum
MEFEDRCHKVQEPKFDCLLFDLDDTLYPLSSGIAGHVKKNIEDYMVEKLGIDESKIENLGNLLYKNYGTTMAGLRAIGYSFDYDEYHAFVHGRLPYDNIKPDPVLKHILKNLRIRKLIFTNGDKVHAVRALKRLGLEDCFEGIICFETLNPPCPPQGDQEPEIFDIAGHFARSGTADELPKTPVLCKPNVDAMEEALRIANVNPHKAIFFDDSVRNILAGKQIGLHTVLVGKSQRVKGADHALESIHNIREALPELWEEAEKAEDVLYADRVAIETSVTA

SEQ ID NO: 5645 - protein, 280 aa, Zea mays
MEFEDRCHKVQEPKFDCLLFDLDDTLYPLSSGIADHVKKNIEDYMVEKLGIDESKIENLGNLLYKNYGTTMAGLRAIGYSFDYDEYHAFVHGRLPYDNIKPDPVLKHILKNLPIRKLIFTNGDKVHAVRALERLGLEDCFEGIICFETLNPPCPPQGDREAEIFDIAGHFARSGAAAELPKTPVLCKPNVDAMEEALRIANVNPHKAIFFDDSVRNIQAGKQIGLHTVLVGKSQRVKGADHALESIHNVREALPGLWEEAEKAEDVLYAERVAMETSVTA

SEQ ID NO: 5646 - protein, 148 aa, Panicum virgatum
MEFEDHCHKVQEPKFDCLLFDLDDTLYPLSSGIAGHVKKNIEDYMVEKLGIDESKIENLGNLLYKNYGTTMAGLRAIGYSFDYDEYHAFVHGRLPYDNIKPDPVLKHILKNLRIRKLIFTNGDRSTPCAPSRGWAWRTASRGSSASRP

SEQ ID NO: 5647 - protein, 280 aa, Cenchrus ciliaris
  misc_feature (50)..(50): Xaa can be any naturally occurring amino acid
MEFENGCHKVQEPKFDCLLFDLDDTLYPLSAGIAGHVKKNIEDYMVEKLXIDESKIENLGNLLYKNYGTTMAGLRAIGYSFDYDEYHAFVHGRLPYDNIKPDPVLKHILKNLRIRKLIFTNGDKVHALRSLKRLGLEDCFEGIICFETLNPPCPPKGDEEPEIFDIAGHFARSGTTDELPKTPVLCKPNVDAMEEALRIANVNPHKAIFFDDSVRNIQAGKEIGLHTVLVGKSQRVKGADHALESIHNIREALPELWEEAEKAEDVLYADRVAIETSVTA

SEQ ID NO: 5648 - protein, 283 aa, Oryza sativa
MEFEDRCHKVQEPKFDCLLFDLDDTLYPLSSGIASHVKKNIGDYMVEKLGIEESKIENLGNLLYKNYGTTMAGLRAIGYSFDYDEYHSFVHGRLPYENIKPDPVLKHILKNLRIRKLIFTNGDKDHAVRALKRLGLEDCFEGIICFETLNPPCPSPPCDGEASIFDIAGHFSMPGAAADELPRTPVLCKPNVDAMEEALRIANVNPHKAIFFDDSVRNIQAGKRIGLHTVLVGTPQRVKGADHALESIHNIREALPELWEEAEKAEDVLIYSDRVAIETSVTA

SEQ ID NO: 5649 - protein, 280 aa, Brachypodium distachyon
MEYEERCLMVQEPKFDCLLFDLDDTLYPMSSGISSHVKTNIEDYMVEKLGIEESKIENLGNLLYKNYGTTMAGLRAIGYNFDYDEYHSFVHGRLPYDNIKPDPVLKHILKNMRIRKLIFTNGDMVHAVRALKRLGLEDCFEGIICFETLNPPCLLPGDQALEIFDIAGHFAGSGSTDELPRTPVLCKPNVDAMEAALRIANVNPYKAIFFDDSVRNIQAGKRIGLHTVLVGTSHRVKGADHALESIHNIREALPELWEEAEKTEDVLYSDRVAIETAVTA

SEQ ID NO: 5650 - protein, 281 aa, Hordeum vulgare
MEFDERCLKVQDPKFDCLLFDLDDTLYPLSSGISSHVKTNIEAYMVEKLGIEESKIENLGNLLYKNYGTTMAGLRAIGYNFDYDEYHSFVHGRLPYDNIKPDPVLKHILKNMRIRKLIFTNGDMIHAVRALKRLGLEDCFEGIICFETLNPPCLLPQCDQAPKIFDIAGHFAGLGSADDLPRTPVLCKPNVGAMEAALRIANVNPYKAIFFDDSVRNIQAGKRIGLHTVLVGTSHRVKGADHALESIHNIREALPELWEEAEKTEDVLYADRVAIETSVTA

SEQ ID NO: 5651 - protein, 282 aa, Avena sativa
MEFEERCLMVQEPKFDCLLFDLDDTLYPMSSGISSHVKTNIEAYMVEKLGIEESKIENLGNLLYKNYGTTMAGLRAIGYNFDYDEYHSFVHGRLPYDNIKPDPVLKHILKNMRIRKLIFTNGDMIHAVKALKRLGLEDCFEGIICFETLNPPCLPPSCDQAPPEIFDIAGHFARSGSVAELPRTPVLCKPNVGAMEAALRIANVNPYKAIFFDDSVRNIQAGKIIGLHTVLVGTSHRVKGADHALESIHNIREALPELWEEAEKTEDVLYTDRVAIETSVTA

SEQ ID NO: 5652 - protein, 281 aa, Triticum aestivum
MEFDERCLKVQEPKFDCLLFDLDDTLYPLSSGISSHVKTNIEAYMIEKLGIDESKIENLGNLLYKNYGTTMAGLRAIGYNFDYDEYHSFVHGRLPYDNIKPDPVLKQILKNMRIRKLIFTNGDMIHAVRALKRLGLEDCFEGIICFETLNPPCLLTPCDQAPEIFDIAGHFAGLGSADDLPRTPVLCKPNVGAMEAALRIANVNPYKAIFFDDSVRNIQAGKRIGLHTVLVGTSQRVKGADHALESIHNIREALPELWEEAEKTEDVLYSDRVAIETSVTA

SEQ ID NO: 5653 - protein, 281 aa, Triticum aestivum
MEFDERCLKVQDPKFDCLLFDLDDTLYPLSSGISSHVKTNIEAYMVEKLGIEESKIENLGNLLYKNYGTTMAGLRAIGYNFDYDEYHSFVHGRLPYDNIKPDPVLKQILKNMRMRKLIFTNGDMIHAVRALKRLGLEDCFEGIICFETLNPPCLLTPCDQAPEIFDIAGHFAGLGSADDLPRTPVLCKPNVGAMEAALRIANVNPYKAIFFDDSVRNIQAGKRIGLHTVLVGTSQRVKGADHALESIHNIREALPELWEEAEKAEDVLYADRVAIETSVTA

SEQ ID NO: 5654 - protein, 281 aa, Leymus cinereus x Leymus triticoides
  misc_feature (81)..(81): Xaa can be any naturally occurring amino acid
  misc_feature (125)..(125): Xaa can be any naturally occurring amino acid
  misc_feature (132)..(132): Xaa can be any naturally occurring amino acid
MEFDERCLKVQEPKFDCLLFDLDDTLYPLSSGISSHVKTNIEGYMVEKLGIEESKIENLGNLLYKNYGTTMAGLRAIGYNXDYDEYHSFVHGRLPYDNIKPDPVLKHILKNMRIRKLIFTNGDMXHAVRALXRLGLEDCFEGIICFETLNQPCLLPQCDQAPKIFDIAGHLAGSGSADDLPRTPVLCKPNVGAMEAALRIANVNPYKAIFFDDSVRNIQAGKRIGLHTVLVGTSHRVKGADHALESIHNIREALPELWEEAEKAEDVLYSDRVAIETSVTA

SEQ ID NO: 5655 - protein, 281 aa, Triticum aestivum
MEFDERCLKVQDPKFDCLLFDLDDTLYPLSSGISSHVKTNIEAYMVEKLGIEEIKIENLGNLLYKNYGTTMAGLRAIGYNFDYDEYHSFVHGRLPYDNIKPDPVLKQILKNMRMRKLIFTNGDMIHAVRALKRLGLEDCFEGIICFETLNPPCLLTPCDQAPEIFDIAGHFAGLGSADDLPRTPVLCKPNVGAMEAALRIANVNPYKAIFFDDSVRNIQAGKRIGLHTVLVGTSQRVKGADHALESIHNIREALPELWEEAEKAEDVLYADRVAIETSVTA

SEQ ID NO: 5656 - protein, 281 aa, Pseudoroegneria spicata
MEFDERCLKVQDPKFDCLLFDLDDTLYPLSSGISSHVKTNIEAYMVEKLGIEESKIENLGNLLYKNYGTTMAGLRAIGYNFDYDEYHSFVHGRLPYDNIKPDPVLKQILKNMRIRKLIFTNGDMIHAVRALKRLGLEDCFEGIICFETLNPPCLLMPCDQAPEIFDIAGHFAGLGSADDLPRTPVLCKPNVGAMEAALRIANVNPYKAIFFDDSVRNIQAGKRIGLHTVLVGTSHRVKGADHALESIHNIREALPELWEEAEKTEDVLYSDRVAIETSVTA

SEQ ID NO: 5657 - protein, 122 aa, Zea mays
MSYSRGSSERYGSRSPYSRSTRYRSRSRSVDSSDAENPGNNLYVTGLSARVTDRDLEKHFSTEGEVIDASVVYDPWTRESRGFGFVTMAAVKDADRCIKYLDRSVLQGRVITVEKILLTATG

SEQ ID NO: 5658 - protein, 122 aa, Panicum virgatum
MSYSRGSRYESRSPYRRSSYSRYRSRSRSVDSSDAENPGNNLYVTGLSARVTDQDLEKHFSTEGEVIDASVVQDPWTKESRGFGFVTMATVKEADRCIKYLDRSVLEGRVITVEKILLTATG

SEQ ID NO: 5659 - protein, 118 aa, Pennisetum glaucum
MSYSRGSRYESRSPYRRSSYSRYRSRSRSVDSCDAENPGNNLYVTGLSARVTDRDLEKHFSTEGEVIDASVVHDPWTRESRGFGFVTMATVKEADRCIKYLDRSVLEGRVITVEKVKS

SEQ ID NO: 5660 - protein, 120 aa, Saccharum officinarum
MSYSRGSSERYGSRSPYSRSSYSRYGSRSRSVDSSDAENPGNNLYVTGLSARGTDRDLEKHFSTEGEVIDASIVHDPWTRESRGFGFVTMATVKEADRCIKYLDPSVLEGRIITVEKVKS

SEQ ID NO: 5661 - protein, 128 aa, Panicum virgatum
MSYSRGSRYESRSPYRRSSYSRYRSRSRSVDSSDAENPGNNLYVTGLSARVTDQDLEKHFSTEGEVIDASVVQDPWTRESRGFGFVTMATVKEADRCIKYLDRSVLEGRVITVEKVNSEYCLLVNFNI

SEQ ID NO: 5662 - protein, 106 aa, Panicum virgatum
RSSYSRYRSRSRSVDSSDAENPGNNLYVTGLSARVTDRDLEKHFSTEGELIDASVVQDPWTRESRGFGFVTMATVKEADRCIKYLDRSVLEGRVITVEKILLTATG

SEQ ID NO: 5663 - protein, 129 aa, Avena sativa
MSYSRGPRQSSYSRYRSRSRSVDSSDVENPGNNLYVTGLSSRITDRDLEKHFSTEGEVIDASIVLDPWTRESRGFGFVTMATLKEAERCIKYLDHSVLEGRVITVEKLLLTAAGRCPQLLPIKCKRHTT

SEQ ID NO: 5664 - protein, 134 aa, Panicum virgatum
MSYSRGSRYESRSPYRRSSYSRYRSRSRSVDSSDAENPGNNLYVTGLSARVTDRDLEKHFSTEGELIDASVVQDPWTRESRGFGFVTMATVKEADRCIKYLDRSVLEGRVITVEKVNSEYCLRVNFNIFKFSTD

SEQ ID NO: 5665 - protein, 164 aa, Saccharum officinarum
MAVVSGSGGGRLNPWAEPFVPSGVRYRGLQTAEAAPEQEVEDFSPEWWRLVSASPAFRDRWLREYGALGLLDAEEDLDDDAEVDGFLPDDFFSPPAPRQESEREDAAPGAGKKASGGLEVAAWGIDKWWRAHGGPPEAPRYAEKAPRRVTAGARVSPRPIQQPR

SEQ ID NO: 5666 - protein, 159 aa, Saccharum officinarum
MAVVSGSGGGRLNPWAEPFVPSGVRYRGLQTAEAAPEQEVEDFCPEWWRLVSASPAFRDRWLREYGALGLLDTEEDLDDDAEVDDFFSPPAPRQESERENAAPGAGKKASGGLEVAAWGIDKWWRAHGGPPEAPRYAEKAPRRVTAGARVSPRPIQQPR

SEQ ID NO: 5667 - protein, 159 aa, Saccharum officinarum
MAVVSGSGGGRLNPWAEPFVPSGVRYRGLQTAEAAPEQEVEDFCPEWWRLVSASPAFRDRWLREYGALGLLDTEEDLDDDAEVDDFFSPPAPRQESEREDAAPGAGKKASGGLEVAAWGIDKWWRAHGGPPEAPRYAEKAPRRVTAGARVSPRPIQQPR

SEQ ID NO: 5668 - protein, 199 aa, Saccharum officinarum
  misc_feature (37)..(37): Xaa can be any naturally occurring amino acid
  misc_feature (39)..(39): Xaa can be any naturally occurring amino acid
  misc_feature (43)..(43): Xaa can be any naturally occurring amino acid
  misc_feature (45)..(45): Xaa can be any naturally occurring amino acid
  misc_feature (164)..(164): Xaa can be any naturally occurring amino acid
  misc_feature (179)..(179): Xaa can be any naturally occurring amino acid
  misc_feature (182)..(182): Xaa can be any naturally occurring amino acid
  misc_feature (198)..(198): Xaa can be any naturally occurring amino acid
RTVTIVPKPQRDTEDSRSAAASARASDRVKQEDEKPXAXVSGXGXGRLNPWAEPFVPSGVRYRGLQTAEAAPEQEVEDFCPEWWRLVSASPAFRDRWLREYGALGLLDAEEDLDDDAEVDGFLPDDFSPPAPRQESEREDAAPGAGKKASGGLEVAAWGIDKWXRAHGGPPEAPRYAEXAPXRVTAGARVSPRPIQQXR

SEQ ID NO: 5669 - protein, 158 aa, Zea mays
MAVVSGSGGRLNPWAEPFVPSGARYRGLRTVEATPEQEVEDFSPEWWRLVSASPAFRDRWLREYGALGLLDAEDDLDDDVDSFLPDDFFSPPAPRYESEREDAAGRRAGRGLEVAAWGIDRWWRAHGGPPETPRYAEKAPRRVAAAARVSPRPIQQPR

SEQ ID NO: 5670 - protein, 164 aa, Saccharum officinarum
MAVVSGSGGGRLNPWAEPFVPSGARYRGLQTAEAAPEQEVEDFSPEWWRLVSASPAFRDRWLREYGALGLLDAEEDLDDDAEVDGFLPDDFFSPPDPRQESERDDAAPGAGKKASGGLEMAAWGIDKWWRAHGGPPEAPMYSEKAPRKVTGRAQVKPRPNQEPR

SEQ ID NO: 5671 - protein, 134 aa, Zea mays
MAVVSGSGGRLNPWAEPFVPSGARYRGLRTVEATPEQEVEDFSPEWWRLVSASPAFRDRWLREYGALGLLDAEDDLDDDVDSLLPDDFFSPPAQRHESEREDAAGRRAGRGLEVAAWGIDRWWRAHGGPPETTR

SEQ ID NO: 5672 - protein, 274 aa, Saccharum officinarum
  misc_feature (194)..(194): Xaa can be any naturally occurring amino acid
  misc_feature (203)..(203): Xaa can be any naturally occurring amino acid
  misc_feature (229)..(229): Xaa can be any naturally occurring amino acid
MAAAAASTKTANIPATMRAVQYDACGGGAAGLKHVEVPVPSAKKNELLLKLEAASINPVDWKIQKGMLRPFLPRKLPFIPVTDVAGVVADVGPGINGFQAGDQVVAMLNSFNGGGLAEYAVASENLTVKRPPEVSAAEGAGLPIAAGTALQALRTIGAKFDGTGQPLNVLITAASGGVGLYAVQLAKLAGLHIXATCGARNVXLVKSLGADEVLDYKTPEGASLQSPSXKKYDGVVHCTVGISWSTFEPVLATTGRVIDLTPNFTAILNQRCIR

SEQ ID NO: 5673 - protein, 339 aa, Zea mays
MAAASTKTANIPATMRAVQYDSCGGGAAGLKHVEVPVPSAKKNELLLKLEAASINPVDWKVQKGMLRPFLPRKLPFIPVTDVAGVVADVGPGINGFQAGDQVVAMLNSFNGGGLAEYAVASENLTVKRPPEVSAAEGAGLPIAAGTALQALRTIGAKFDGTGKPMNVLVTAASGGVGLYAVQLAKRAGLHVTATCGARNVELVKSLGADEVLDYRTPEGATLQSPSGKKYDGVVHCTVGTSWSTFEPVLAATGKVIDITPNLTAILKSALHSVTFARKRLVPLLLSPNKADLEFLVGLLKDGKLETLIDSRFPLSEVSKAWEKSIEGHATGKIIVEMGD

SEQ ID NO: 5674 - protein, 330 aa, Panicum virgatum
MAAATMRAVQYDAFGGGAADLKLVEVPVPAARKNELLLKLEAASINPLDWKLQKGMLRPFLPRKLPFIPVTDVAGVVIDVGPGVNGFLAGDQVVAMLNISYGGGLAEYAVASENLTVKRPPEVSAAEGAGLPIAAVTALQALRTIGAKFDGTGEPLNVLITAASGGVGLYAVQLAKLAGLHITATCGARNVELVKSLGADEVLDYRTPEGASLQSPSGKKYNGVVHCTVGISWSTFEPVLANTGRVIDITPNFTAILKSALHKVTFARKRLVPLLLSPNKADLEFLVGLLKGGKMKTLIDSRFSLSEASKAWEKSIEGHATGKIIVEMEG

SEQ ID NO: 5675 - protein, 290 aa, Saccharum officinarum
MRAVQYDACGGGAAGLKHVEVPVPSAKKNELLLKLEAASINPVDWKIQKGMLRPFLPRKLPFIPVTDVAGVVADVGPGINGFQAGDQVVAMLNSFNGGGLAEYAVASENLTVKRPPEVSAAEGAGLPIAAGTALQALRTIGAKFDGTGQPLNVLITAASGGVGLYAVQLAKLAGLHITATCGARNVKLVKSLGADEVLDYKTPEGASLQSPSSKKYDGVVHCTVGISWSTFEPVLATTGRVIDLTPNFTAIPKSALIKVTFAKNAVVPLVLVANKADLEFLGRPGEGRYP

SEQ ID NO: 5676 - protein, 325 aa, Sorghum bicolor
MRAVQYDAWGGGATGLKHVEVPIPSAQKNELLLKLEVASINPVDWKIQKGLLRPFLPRKFPFIPVTDVAGVVADVGPGVQGFQPGDQVVAKLYSLKGGGLAEYAVASETLTVKRPAEVFAAEGAGLPVAAGTALQALRTIGAKFDGTGKPLNVLITAASGGVGHYAVQLAKMAGLHITATCGARNVELLKSLGADEVLDYKTPEGASLQSPSGKKYDVVIHCAARISWSTFEPVLATTGRVIDITPNFSSILKWALHMVTFARKRLVPLHLSPNKADLEFLVGLLKDGKLKTLIDSRFPLSEVSKAWQKSVDGHATGKIIVEIGG

SEQ ID NO: 5677 - protein, 273 aa, Saccharum officinarum
MAANSPFDCILLDLDDTLYPGNTGIGPALKRNIDEFLQAKLGVSADKAAAMRVELFRTHGSSLAGLIALGYDVHPDEYHSYVHGRLPYDRIPADPQLARLLQSIPQRKVLFTNSDRAHMRRALERLGVDEAIFDAVVCFETMNPHLFGGEDREERVDGGDHPVVILKPAVDAIVAGLRVAGTSPRRTLFLDDSERNIAAGKALGLRTALVGKRVRSKEADYALENIGALRRAIPEIWGVVAGGSESERSDHSMDKLPMRSDLDSIIQPTSIQA

SEQ ID NO: 5678 - protein, 163 aa, Saccharum officinarum
MAANSPFDCILLDLDDTLYPGNTGIGPALKRNIDEFLQAKLGVSADKAAAMRVELFRTHGSSLAGLIALGYEVHPDEYHSYVHGRLPYDRIPADPQLARLLQSIPQRKVLFTNSDRAHMRRALERLGVDEAIFDAVVCFETMNPHLFGGEAREERVDGAITRS

SEQ ID NO: 5679 - protein, 270 aa, Saccharum officinarum
  misc_feature (180)..(180): Xaa can be any naturally occurring amino acid
MAANSPFDCILLDLDDTLYPGNTGIGPALKRNIDEFLQAKLGVSADKAAAMRVELFRTHGSSLAGLIALGYEVHPDEYHSYVHGRLPYDRIPADPQLARLLQSIPQRKVLFTNSDRAHMRRALERLGVDEAIFDAVVCFETMNPHLFGGEAREERVDHPVVILKPAVDAIVAGLRVAGTXPRRTLFLDDSERNIAAGKALGLRTALVGKRVRSKEADYALENISALRRAIPEIWGVVAGGSESERSDHSMDKLPMRSDLDSIIQPTSIQA

SEQ ID NO: 5680 - protein, 275 aa, Panicum virgatum
MAANSPFDCVLLDLDDTLYPGNTGLGPALKRNIDEFLQAKLGVSAERAAAMRVELFRTHGSSLAGLIALGYDVHPDEYHSYVHGRLPYDRIAADPQLARLLQSIPQRKVLFTNSDRAHMKRALERLGVDEAVFDAVVCFETMNPHLFGEEGRRAAAAGTAPPAVVLKPAVDAIVAGLRAAGTNPRRTLFLDDSERNIAAGKALGLRTALVGKRVRSKGADYALESIGALRRVIPEIWGAAAAAAGDGSERSDHGIDKMPMRSDLDSIIQPTSIQA

SEQ ID NO: 5681 - protein, 269 aa, Zea mays
MAATSPFDCVLLDLDDTLYPGDTGIGAALRRNIDEFLQAKLGVSADEAAATRAELFRAHGSSLAGLIALGYDVHPDEYHSYVHGRLPYDRIARDPQLARLLQSIPQRKVLFTNSDRAHMERALERLGVDEAAFDAVVCFETMNPHLFGDDGGDRRPAVVLKPAVDAIVAGLRAAGSNPRRTLFLDDSERNIAAGKALGLRTALVGKRARSKEADYAVESIGALRRAIPEIWGEAAERSSDKLPVPAVSVVRSTTSDLDSIIIQPTSIHA

SEQ ID NO: 5682 - protein, 348 aa, Zea mays
MAQVCCDSAVTAAPVAGPEAEARARARAERRRRAAEAGRWKHAAAAGTAAADATRKRSLEAGELLVARKHGAASVAGRRREMEDAVSVRESFAAEGDADGGGRRDFYGVFDGHGCSHVAEACRDRMHDLLAEELAAADGSGSAATWTAAMERSFARMDAEAMSAGGSAACRCDPHKCDHVGSTAVVAVVEERRVVVANCGDSRALLCRGGGAPPLPLSSDHKPDRPDELERIEAAGGRVIFWEGARVLGVLAMSRAIGDGYLKPYVSSVPEVTVTDRSDADECLILASDGLWDVVSNEAACEVARACLRRGRARWCAEAAALLTKLALARRSSDNVSVVVVDLRKRDR

SEQ ID NO: 5683 - protein, 356 aa, Zea mays
MAQVCCDSAVAATAAPVVGAEAEARARARAERRSRAGESGAWKHAVAAGTADATRKRSLGAGELLVARKHGAASVAGRRREMEDAVSVRDAFCAEGTADGGRRDFYGVFDGHGCSHVAEACRDRMHELVAEELAATAADSSVSAAAAWTVAMERSFARMDAEVTSAGGRAAAARSSTCRCDAHRCDHVGSTAVVAVVEEHSVIVANCGDSRAVLCRGDGAPPLPLSSDHKPDRPDELERIESAGGRVIFWEGARVLGVLAMSRAVGDGYLKPYVSSVPEVTVTDRSDGDECLILGSDGLWDVVSNEAACEVARACLRRGRAKWCAEAAALLTKLALARRSSDNVSVVVIDLRRRNH

SEQ ID NO: 5684 - protein, 348 aa, Panicum virgatum
MAQVCCDSAAAAAAAVVGPEAEARARARAERRRRAGEAGRWKHAPAAAGTATMKRRVEAGELLVARKHGAASVAGLRREMEDAVSVREAFAAGGAGRCDFYGVFDGHSCSHVAEACRDRMHELLAEELADEDGPAARREPAAWTAAMERCFARMDAEVASAGGRAAASCRCDAHKCDHVGSTAVVAVVEERRVVVAHCGDSRAVLCRGGDGAAPVALSSDHKPDRPDEQERIEAAGGRVIFWEGARVLGVLAMSRAIGDGYLKPYVCSVPEVTVADLADGDECLILASDGLWDVVSNEAACEVARACLRRGREKWCAEAAALLTKLALARRSADNVSVVVVDLRRKNH

SEQ ID NO: 5685 - protein, 362 aa, Zea mays
MSTATATLAAARSPAVALLSLRRRAPAAAPIRFPGLRVGSGCRHIAMASAAHSRAPTDPLPKGADLFFRAVISNMEKVYLSRNPTAKTILELVRSYDGDHICYDHFAFRTFGVNGYGINSLSDFFTDFGYLPREELRFPAKKLRALWFSPPTNDGYSGTGTYGPLPRIFISELLVDELTTQSQEIIHKYIKTSGNGNNHAAIASTSGELTWEKPIYSDFQILSRESEYAAWTLVNGYALNHATIATHRLESDIRSINKFNKFVEDNGFKLNSEGGILKVSPDGLLQQSSTVADSSLFTFADGITESIPRSYIEFAERLLLPQFKDLQDEEVKEYHRRDGFEVGNADKIFESTSKDQLTRRSA

SEQ ID NO: 5686 - protein, 288 aa, Saccharum officinarum
  misc_feature (4)..(4): Xaa can be any naturally occurring amino acid
  misc_feature (19)..(19): Xaa can be any naturally occurring amino acid
  misc_feature (23)..(23): Xaa can be any naturally occurring amino acid
  misc_feature (28)..(28): Xaa can be any naturally occurring amino acid
  misc_feature (32)..(32): Xaa can be any naturally occurring amino acid
  misc_feature (35)..(35): Xaa can be any naturally occurring amino acid
MEKXYLSRNPTAKTILELXRSYXGDHIXYDHXAFXTFGVNGYGINSLSQFFTDFGYLPREELRFPAKKLRALWFSPLTNGGYSGTGTYGPLPRIFISELLVDELTTQSQEIIHKYLKTSVNGNNHAALASTSGELTWEKPIYSDFQILSRESEYAAWTLVNGYALNHATIATHRLESDIRNINKFNKFVEDNSFKLNSEGGILKVSPDGLLQQSSTVADSSLFTFADGITESIPRSYIEFAERLLLPQFKDLQDEEVKEYHRRDGFEVGNADKIFESTSKDQLTRTSA

SEQ ID NO: 5687 - protein, 364 aa, Panicum virgatum
MSAGSAILAAARCPGAALLRLRRGVPAAAPLRIPALGAGPGYRRIAMAAAADSGAPAPADPLPKGADSFFRTVISNMEKVYLNRNPTAKTILELIHSYDGDHICYDHLAFRTFGVNGYGINSLADFFIDFGYLPREELRFPAKKLRAIWFSPPTNDGYTGTGVYGPLPRIFISELLVDQLSAQSQEIIHKYIKTSGKGNKHAVVASISGELTWEKPIYSDFQVLSRESEYAAWTLVNGYALNHATIATHCLESDIRSINRFNKFVEDNGFKLNSEGGILKVSPDGLLQQSSTVADSSLFTFADGIIESVPRSYIEFAERLLLPQFKDLQDEEVKEHHRRDGFEVGNADKIFESTSKDQLTRRSA

SEQ ID NO: 5688 - protein, 316 aa, Saccharum officinarum
MASAAHARAPADPLPKGADLFFRAVISNMEKVYLSRNPTAKTILELVRSYDGDHICYDHLAFRTFGVNGYGINSLSQFFTDFGYLPREELRFPAKKLRALWFSPLTNGGYSGTGTYGPLPRIFISELLVDELTTQSQEIIHKYLKTSVNGNNHAALASTSGELTWEKPIYSDFQILSRESEYAAWTLVNGYALNHATIATHRLESDIRNINKFNKFVEDNSFKLNSEGGILKVSPDGLLQQSSTVADSSLFTFADGITESIPRSYIEFAERLLLPQFKDLQDEEVKEYHRRDGFEVGNADKIFESTSKDQLTRTSA

SEQ ID NO: 5689 - protein, 317 aa, Oryza sativa
MAAAASAPPAPADALPKGADSFFRTVISNMEKVYLSRNPTAKTILELVRSYDGDHICYDHFAFRTFGVDGYGIKSLAEFFTDFGYVPREELRFPAKKLRALWFSPPTNDGYTGTGVYGPLPRIFISELLVDELSPQSQDIIQKYIRTSGKGNKHATLASTSGELTWEKPIYSDFQVLSRESEYAAWTLVNGYALNHTTISTHRLISDIRSINKFNKFVEDNGFKLNSEGGILKVSPDGLLQQSSTVADSALFTFADGITESIPRSYIEFAERLVLPQFKDLPNDEVNEHHRRDGFEVGNADKIFESTSNDQLTRRSA

SEQ ID NO: 5690 - protein, 491 aa, Zea mays
MASAANTMPGKSVVLLSLVTLLVVLISAAESYDGRYAVSHSAMARRSRLGTRHAHHRRTTVPHRYVLAEKSSAPSGGGPKNHSSPAKANASSPAPAPPAAEQTGRHHRSHKNRVRNWIIGFVVGSLAGVISGMVLSVLFRLALNCIRGRYRTRSGVMIFTPKLIRRPEHLAFLEKEDGLASLAVIGRGGCGEVYKAQLPVEREGEQPRFIAIKKVKKHGGDAPSNNLSDEESRQLDKRSRQIQSEIRTVGYIRHRNLLSLAAHVPRPDCHYLVYEYMKNGSLHQALKAENAEAEDGSSGSGTGAGGLSWPARLRVAVGVAAGLEYLHVSHQPQIIHRDLKPANILLDDDLEARIADFGLAKAMPDSHTHVTASNVAGTLGYIAPEYYQTVKFTAKCDVYSFGVILAVLATGKEPSDQFFTQTEEVVGLVKWLRRVMEAGEHAQAIDPAIAGAGYDEQILLLLRIALFCTKDDPKERPTAKDVRCMLSQIKT

SEQ ID NO: 5691 - protein, 207 aa, Solanum tuberosum
MAKGRKLATSRSEMLLGNYPSYRNGTATLNGSSELGEDDIWSTVDDMDDHDSRGEWSPRAADESNNGYVNRKLPVQQSDHHHSRRGRQVGGLSLAFDDSGKTASPRILHQFRGQDVPSTRVAHMATSAPVNVPDWSKIYRVNSVESLHDSDDGVDDHDSEMVPPHEYIARSRNLNARSVFEGVGRTLKGRDLSRVRDAVWSQTGFDG

SEQ ID NO: 5692 - protein, 204 aa, Solanum melongena
MAKGRKLTTSRSDMLLGNYPSYRNGSVTINGSSELGEDDVWSTVDDMVNGDDHGSRGEWSPRAAAESNSGYVNRKQPSDRHGRQVGGLSLAFDDSGKTASPRILHQFRGQDAPSPRVAHMATSAPVNVPDWSKIYRVNSVESLHDSDDGGVDDHDSEMVPPHEYIARSRNSNAHSVFEGVGRTLKGRDLSRVRDAVWSQTGFDG

SEQ ID NO: 5693 - protein, 256 aa, Solanum phureja
MDSSSPFDSIIFDLDDTLYSSKTGIGQSLKKNIDDFLVEKCGFPVSKASALRVELFKTYGSSLAGLRAIGYDVDADDYHSYVHGRLPYDLIKPDPQLRSILRRINQRKIIFTNSDRIHAMKALDRLGITDCFEQIICFETMNFNLSKATRPEEIPVILKPSMEAMNIAIEAAQVDPYRTLFLDDNVKNIAAGKAVGLQTVLVGRSTKTKEADYALEIVTDLVQVVPAIWFKEEEKDQKITRTRSEMDFVTTTAVGA

SEQ ID NO: 5694 - protein, 149 aa, Solanum tuberosum
MKALDRLGITDCFEQIICFETMNFNLSKATRPEEIPVILKPSMEAMNIAIEAAQVDPYRTLFLDDNVKNIAAGKAVGLQTVLVGRSTKTKEADYALEIVTDLVQVVPAIWFKEEEKDQKINTYKEVKWTFVGQPQAVRCLNLMSRKELK

SEQ ID NO: 5695 - protein, 257 aa, Solanum melongena
MDSSSPFDSIIFDLDDTLYSSKTGIGQSLKKNIDDFLVEKCGFPVSKASALRVELFKTYGSSLAGLRAIGYDVDPDDYHSYVHGRLPYDLIKPDPQLRSILRSINQRKIIFTNSDRVHAMKALDRLGIADCFEQIICFETMNFNLSKATRPEEIPVILKPSMEAMKIAIEVAQVDPCRTLFLDDNVKNIAAGKAVGLGTVLVGRSSKTKEADYALEMVSDLVQVVPSIWFKEEEEKDEKITRTRSEMDFLATTAVGA

SEQ ID NO: 5696 - protein, 256 aa, Capsicum annuum
MDSCSPFDSIIFDLDDTLYSSKTGIGQSLKQNIDDFLVEKCGFPVSKASALRVELFKTYGSSLAGLRAIGYDVDADDYHSYVHGRLPYDLIKPDAQLRSILRSINQRKIIFTNSDRVHAMKALDRLGITDCFEQIICFETMNFNLSKATRPEEIPVILKPSIEAMNIAIEAAKVDPRRTLFLDDNVKNIAAGKAVGLRTVLVGRTTKTNEADYALEMVTDLVQVVPAIWYTKVEEDQKITRTRSEMDFLATTAVGA

SEQ ID NO: 5697 - protein, 263 aa, Petunia hybrida
MDFSKSSRDSSSPIDSIIFDLDDTLYSSETGIGQALKKNIDDYLVEKCGFPESKASALRVELFKTYGSSLAGLRALGYDIDADDYHSYVHGRLPYDLIKPDAQLRNILRSINQRKIIFTNSDRIHAIKALDRLGIRDCFEQIVCFETMNQNLSKATRPEEIPVILKPSMEAMNIGIEAAQVDPCRTLFLDDNVKNIAAGKAVGLRTVLVGRATKTKEADYALEMVTELAQVVPAIWFNEEKDQKITRTRSELDSLLATTAVGA

SEQ ID NO: 5698 - protein, 264 aa, Nicotiana tabacum
MDSYSNSSRDSSSPFDSIVFDLDDTLYSPRTGIGQALKKNIDDFLVEKCGFPESKASVLRVELFKTYGSSLAGLRALGYDIDADDYHSYVHGRLPYELIKPDAQLRSILCSINQRRIIFTNSDRIHAIKALDRLGIKDCFEQIICFETMNCNLSRATRPNEIPVILKPSMEAMNIAIEAAQVDPCRTLFLDDNVRNIAAGKAVGLRTVLVGRASKTKEADYALEMVTDLFQVVPAIWFKQEEDQKIRRTGSELDSLLAATAVGA

SEQ ID NO: 5699 - protein, 385 aa, Unknown
  Sequence found in Organisms: Solanum tuberosum, Solanum phureja
MSYSRRSRYTRSPSYDRYSKSVSRSRYVSRSRSRSCDSSDVENPGNNLYVTGLSTRVKERDVEKHFSAEGKVEDVRLVFDPWTRESRGFGFVTMSSVEEADRCIKSLNRSVLEGRVITVEKARRRRGRTPTPGKYLGLRTVRVRRESRNYPHHSRSRSPCYSSESYRSRSRSYSPYYRQEHRSYSYYRGRQRSHSSYYNRHHCYSESPYSPYYSRVRSYSRSLSPYSRRDRSYSPDDRYYRRSRYHDYSPDNHRRDRSYSPDDRYYRRSRYRDYSPESRDLSDSPDVRDNRMSRYRDYSPNSYYYRRNRYRSISRSISPRYRRSYSCSASPRWSKRSYSRSVSRSSCSRSSYSPNPKKSSKKSRSVSASSRFVSRSVTPRSSPSS

SEQ ID NO: 5700 - protein, 625 aa, Solanum phureja
MASNFHFFLLYLVTLFLFAQARLNLYPQDHAALLLVQKDLGIIALNNPCTLAGISCERRPGNRTQVLRVTRIVFRSNGLKGTLSSAIGKLSELKELSLSDNQLSEQIPIQILDCRKLEILELQRNRFSGKIPYELSSLNRLRVVDFSSNEFSGNLDFLKYFPNLEKLSLADNMFTGKIPFSLKSFRNLRFLNISGNSFLEGPVPVMSQIEHLSADLNRNNAVPKRYILAENSTRSNQISAMVPAPAPAPVNRVVPVVHKRNKKKRKLRSWFLGFLAGTFAGGISAVIFSLLFKLVMFFVRRGKNDSSSLTIFSPLIKKAEDLAFLEMEDGVASLEMIGKGGCGEVYRAELPGSNGKIIAIKKIIQSPMDAAEITEEDTKALNKKMRQVKSEIQIVGQIRHRNLLPLLAHMPRPDCHYLVYEYMKNGSLQDILQQVTEGTRELDWLGRHRIAAGVAAGLEYLHINHTQRIIHRDLKPANILLDDDMEARIADFGLAKAVPDAHTHITTSNVAGTMGYIAPEYYQTLKFTDKCDIYSFGVVLAVLVIGKGPSDEYFQHTSEMSLVKWLRNVMTSDDPKIAIDPKLRGNGYEEQMLLVLKIACFCTLDNPKERPNSKDVRCMLTQIKH

SEQ ID NO: 5701 - protein, 633 aa, Nicotiana tabacum
MAFTASQIHFFFISLFALLLIVQAKLNLYPPDHAALLLVQKDLGIQGQRIALCNSVAVSCERRKANRTQLLRVTRIDFRSNGLSGTLSPAIGKLSELKELSLPNNRLFDQIPVQILDCRKLEILDLGNNLFSGKVTSELSSLVRLRILDLSSNELSGNLNFLKYFPNLEKLSLADNMFTGKIPPSLKSFRNLRFLNISGNSFLEGPVPVMSQVEHLSADLDRNNFVPKRYILAENSTRSNQISALAPNSNSGNAPAPAPSHNVAPVHKRNKKKRKVRAWFLGFFAGSFAGAISAVLLSVLFKLVMFFVRKGKTDGSLTIYSPLIKKAEDLAFLEKEDGVASLEMIGKGGCGEVYRAELPGSNGKIIAIKKILQPPMDAAELAEEDTKALNKKMRQVKSEIQILGQIRHRNLLPLLAHMPRPDCHYLVYEYMKNGSLQDILQQVTEGTRELDWLGRHRIAVGIATGLEYLHINHSQCIIHRDLKPANVLLDDDMEARIADFGLAKAVPDAHTHVTTSNVAGTVGYIAPEYHQTLKFTDKCDIYSFGVVLAVLVIGKLPSDEFFQHTPEMSLVKWLRNVMTSEDPKRAIDPKLIGTGFEEQMLLVLKIACFCTLENPKERPNSKDVRCMLTQIKH

SEQ ID NO: 5702 - protein, 179 aa, Solanum tuberosum
MGLRAIPFSPSQNYYLSGSEYFPKCSILRSSRICSSKLVAISAKAKKEDTQEEEPKNKRKQSLFSSVTEALDFSQVRSSKDAELLDEAREKTQSGERMSREQYGALRRKIGGTYKDFFKSYVEVDGQYVEEGWVDKTCKVCKKDTSGEARQVDKLGRYAHVACLEKSNSGNFFTKLFSR

SEQ ID NO: 5703 - protein, 179 aa, Solanum phureja
MGLRAIPFSPSQNYYLSGSEYFPKCSILRSSRICSSKLVAISAKAKKEDTQEEEPKNKRKQSLFSSVTEALDFSQVRSSKDAELLDEAREKTQSGERMSREQYGALRRKIGGTYKDFFKSYVEVDGQYVEEGWVDKTCKVCKKDTSGEARQVDKLGRYAHVACLEKSHSGNFFTKLFSR

SEQ ID NO: 5704 - protein, 179 aa, Solanum tuberosum
  misc_feature (168)..(168): Xaa can be any naturally occurring amino acid
MGLRAIPFSPSQNYYLSGSEYFPKCSILRSSRICSSKLVAISAKAKKEDTQEEEPKNKRKQSLFSSVTEALDFSQVRSSKDAELLDEAREKTQSGERMSREQYGALRRKIGGTYKDFFKSYVEVDGQYVEEGWVDKTCKVCKKDTSGEARQVDKLGRYAHVACLEKSXSGNFFTKLFSR

SEQ ID NO: 5705 - protein, 185 aa, Capsicum annuum
MGLRAIPFSASQNGLMPNYYLGGSEYFAKCCVLPSSRMSSSKLVVVSAKAKKEHTQEEEEPKNKKKQSLFSSVTDALDFSQVRSAKDAELLDEARQKTQSGERMSKEQYGALRRKIGGTYKDFFKSYVEVDGQYVEEGWIDKTCKVCKKDTRGEARQVDKLGRYAHVACLEKSNSGNFFAKLFSR

SEQ ID NO: 5706 - protein, 521 aa, Solanum phureja
MGSLPEPIMEETYSKPPGIRVMERAKKSNLSFKTYQGIVLIVTFLAYTSYHATRKTTSIVKSALDPQSPDVGLKFPWQRRNTTYDQNQSSKLSWMLKDGWVPFNGVDGTAMLGELDVSFLFVYAMGMYFSGHVGDRMDLRIFLTVGMVGTGVFTALFGVGYWANVHIFYYYLIVQMMAGLFQSTGWPSVVAVVGNWFGKKKRGLIMGIWNAHTSIGNITGSLVASLLLKYGWGWSMVVPGTLIAVVGVVVFLFLPVNPESVGANKDEDEVFSPRKVGDEVTEPFLRSDREEESAVGFIEAWKIPGVAPFAFCLFFAKLVAYTFLYWLPFYISHTAIEGRYLSNEEAGNLSTLFDVGGVVGGILAGYISDRLDARAITAASFMYCAIPVLYFYRSYGHVSMTINIILMLITGVFVNGPYALITTAVSADLGTHSSLKGNSRALATVTAIIDGTGSIGAAIGPLLTGYISTNSWSGVFTMLMGSAFIAGLFLTRLVVAEVGEKIQQLGPQGSSPRSRSPDLLV

SEQ ID NO: 5707 - protein, 154 aa, Solanum phureja
MSLIPRIFGDRRSTSVFDPFSIDVFDPFKELGFPVSNSGETSAFANTRIDWKETPEAHVFKADLPGLKKEEVKVEIEEDRVLQISGERNVEKEDKNDTWHRVERSSGKFMRRFRLPENAKMDQVKASMENGVLTVTVPKEEVKKPDVKSIEISG

SEQ ID NO: 5708 - protein, 154 aa, Solanum tuberosum
MSLIPRIFCDRRSTSVFDPFSIDVFDPFKELGFPVSNSGETSAFANTRIDWKETPEAHVFKADLPGLKKEEVKVEIEEDRVLQISGERNVEKEDKNDTWHRVERSSGKFMRRFRLPENAKMDQVKASMENGVLTVTVPKEEVKKPDVKSIEISG

SEQ ID NO: 5709 - protein, 154 aa, Solanum tuberosum
MSLIPRIFGDRRSTSVFDPFSIDVFDPFKELGFPVSNSGETSAFANTRIDWKETPEAHVFKADLPGLKKEEVKVEIEEDRVLQISGERNVEKEDKNDTWHRVERSSGKFMRRFKLPENAKMDQVKASMENGVLTVTVPKEEVKKSDVKSIDISG

SEQ ID NO: 5710 - protein, 154 aa, Solanum tuberosum
MSLIPRIFCDRRSTSVFDPFSIDVFDPFKELGFPVSNSGETSAFANTRIDWKETPEAHVFKADLPGLKKEEVKVEIEEDRVLQISGERNVEKEDKNDTWHRVERSSGKFMRRFRLPENAKMDQVKASMEFGELTVTVPKEEVKKPDVKSIEISV

SEQ ID NO: 5711 - protein, 154 aa, Solanum lycopersicum
MSLIPRIFGDRRSSSMFDPFSIDVFDQFRGLGFPGTNSGETSAFANTRIDWKETPEAHVFKADLPGLKKEEVKVEIEEDRVLQISGERNVEKEDKNDTWHRVERSSGKFMRRFRLPENAKMDQVKASMENGVLTVTVPKEEVKKPDVKSIEISG

SEQ ID NO: 5712 - protein, 84 aa, Solanum melongena
MSLIPRILGDRRSSSVFDPFSIDVFDPFKELGFPVLSSGETSAFANTRIDWRETPEAHVFKADLPGLKKEEVKVEIEEDKSSSD

SEQ ID NO: 5713 - protein, 154 aa, Solanum tuberosum
MSLIPRRIGDRRSSSMFDPFSIDVFDPFRELGFPGTNSGETSAFANTRIDWKETPEAHVFKADLPGLKKEEVKVEIEEDRVLQISGERNVEKEDKNDTWHRVERSSGKFMRRFRLPENAKMDQVKASMENGVLTVTVPKEQVKKPDVKSIEISG

SEQ ID NO: 5714 - protein, 154 aa, Solanum phureja
MSLIPRIFGDRRSSSMFDPFSIDVFDPFRELGFPGTNSGETSAFANTRIDWKETPEGHVFKADLPGLKKEEVKVEIEEDRVLQISGERNVEKEDKNDTWHRVERSSGKFMRRFRLPENAKMDQVKASMENEVLTVTVPKEQVKKPDVKSIEISG

SEQ ID NO: 5715 - protein, 154 aa, Solanum phureja
MSLIPRIFGDRRSSSMFDPFSMDVFDSFKELGFPVSNSGETSAFANTRVDWKETPEAHVFKADLPGLKKEEVKVEIEEDRVLQISGERNVEKEDKNDKWHRVERSSGKFMRRFRLPENAKMDQVKASMENEVLTVTVPKEQVKKPDVKSIEISG

SEQ ID NO: 5716 - protein, 154 aa, Solanum tuberosum
MSLIPRIFGDRRSSSMFDPFSIDVFDPFRELGFPGTNSGETSAFANTRIDWKETPEAHVFKADLPGLKKEEVKVEVEEDRVLQISGERNVEKEDKNDKWHRVERSSGKFMRRFRLPENAKMDQVKASMENGVLTVTVPKEEVKKPEVKSIDISG

SEQ ID NO: 5717 - protein, 153 aa, Nicotiana tabacum
MSLIPRVFGDRRSSVFDPFSIDVFDSFRELGFPGSNSGETSAFANTRVDWKETPEAHVFKADLPGLKKEEVKVEIEDDRVLQISGERNVEKEDKNDTWHRVERSSGKFMRRFRLPENAKMDQVKAAMENGVLTVTVPKEEVKKPDVKSIDISG

SEQ ID NO: 5718 - protein, 154 aa, Solanum lycopersicum
MSLIPRIFGDRRSSSMFDPFSIDVFDPFRELGFPGTNSGESSAFANTRIDWKETPEAHVFKADLPGLKKEEVKVEVEEDRVLQISGERNVEKEDKNDKWHRVERSSGKFMRRFRLPENAKMDQVKASMENGVLTVTVPKEEVKKPEVKSIEISG

SEQ ID NO: 5719 - protein, 154 aa, Unknown
  Sequence found in Organisms: Solanum tuberosum, Solanum phureja
MSLIPRIFGDRRSSSMFDPFSIDVFDSFRELGFPGTNSGETSAFANTRIDWKETPEAHVFKADLPGLKKEEVKVEVEEDRVLQISGERNVEKEDKNDKWHRVERSSGKFMRRFRLPENAKMDQVKASMENGVLTVTVPKEEVKKPEVKSIDISG

SEQ ID NO: 5720 - protein, 153 aa, Nicotiana tabacum
MSLIPRMFGDRRSSVFDPFSIDVFDSFRELGFPGSNSGETSAFANTRVDWKETPEAHVFKADLPGLKKEEVKVEIEDDRVLQISGDRNVEKEDKNDTWHRVERSSGKFMRRFRLPENAKMDQVKAAMENGVLTVTVPKEEVKKPDVKSIEITG

SEQ ID NO: 5721 - protein, 154 aa, Solanum phureja
MSLIPRIFGDRRSSSKFDPFSMDMFDSFKELGFPGSNSGEISAFANTRVDWKETPEAHVFKADLPGLKKEEVKVEIVEDRVLQISGERNVEKEDKNDKWHRVERSSGKFMRRFRLPENAKMDQVKASMENGVLTVTVPKEQVKKPDVKSIEISG

SEQ ID NO: 5722 - protein, 154 aa, Solanum lycopersicum
MSLIPRIFGDRRSSSMFDPFSIDVFDPFRELGFPSTNSGESSAFANTRIDWKETPEAHVFKVDLPGLKKEEVKVEVEEDRVLQISGERNVEKEDKNDKWHRMERSSGKFMRRFRLPENAKMDQVKASMENGVLTVTVPKEEVKKPEVKSIEISG

SEQ ID NO: 5723 - protein, 154 aa, Capsicum annuum
MSLIPRIFGDRRSSSMFDPFSIDMFDPFRELGFPGSNSREASAFANTRIDWKETPEAHVFKADLPGLKKEEVKVEIEEHRVLQISGERNEEKEDKSDTWHRMERSSGKFMRRFRLPENAKMDQVKASMENGVLTVTVPKEEVKKPDVKSIEISG

SEQ ID NO: 5724 - protein, 154 aa, Capsicum annuum
MSLIPRIFGDRRSNSMFDPFAMDVFDPFRELGFPGSSSRETSAFANTRIDWRETPEAHVFKADLPGLKKEEVKVEIEEDRVLQISGERNVEKEDKNDTWHRMERSSGKFMRRFRLPENAKMDQVKASMDNGVLTVTVPKEEVKKPDVKSIEISG

SEQ ID NO: 5725 - protein, 154 aa, Solanum melongena
MSLIPRMFGDRRSSSMFDPFSIDVFDPFRELGFPSSNSRETSQFANTRIDWKETPEAHVFKADLPGLKKEEVKVEIEDDRVLQISGERNVEKEDKNDTWHRMERSSGKFMRRFRLPENAKMDQVKASMENGVLTVMVPKEEVKKSDIKSIEISG

SEQ ID NO: 5726 - protein, 154 aa, Solanum tuberosum
MSLIPRIFGDRRISSKFDPFSMDVFYSFKELGFPVSNSGEISAFANTRVDWKETPEAHVFKADLPGIKKEEVKVEIEEDRVLQISGERNVEKEDNNDKWHRVERSSGKFMRRFRLPENAKMDQVKASMENGVLTVTVPKEQVKKPDVKSIEISG

SEQ ID NO: 5727 - protein, 133 aa, Solanum phureja
MDVFNSFKELGFPISNSGETSAFANTRVDWKETPEAHVFKADLPGLKKEEVKVEIEEDRVLQISGERNLEKEDKNDKWHRVERSSGKFMKRFRLPENAKMDQVKASMENRVLTVIVPKEEVKKPDVKSIEISG

SEQ ID NO: 5728 - protein, 149 aa, Solanum tuberosum
RIFGDRRSSSKFDPFSMDVFFSFKELGFPVSNSGEISAFANTRVDWKETPEAHVFKADLPGLKKEEVKVEIEEDRVLQISGERNVEKEDKNDKWHRVERSSGKFMRRFRLPENAKMDQVKASMENGVLTVTVPKEQVKKPDVKSIEISG

SEQ ID NO: 5729 - protein, 149 aa, Solanum tuberosum
RIFGDRRSSSKFDPFSMDVSDSFKELGFPVSNSGEISAFANTRVDWKETPEAHVFKADLPGLKKEEVKVEIEEDRVLQISGERNVEKEDKNDKWHRVERSSGKFMRRFRLPENAKMDQVKASMENGVLTVTVPKEQVKKPDVKSIEISG

SEQ ID NO: 5730 - protein, 154 aa, Capsicum annuum
MSLIPRIFGDRRSSSMMDPFSMDLFDPFRELGLPGFNSGETSTFANARVDWKETPEAHVFKADLPGLKKEEVKVEIEEDRVLQISGERNVEKEDKNDTWHRVERSSGKFMRRFRLPENAKMEQVKASMENGVLTVTVPKAEVKKPDVKSIEISG

SEQ ID NO: 5731 - protein, 146 aa, Solanum phureja
GDRRSSSMFDPFSMDVFDSFKELGFPVSNSGETSAFANTRVDWKETPEAHVFKADLPGLKKEEVKVEIEEDRVLQISGERNVEKEDKNDKWHRVERSSGKFMRRFRLPENAKMDQVKASMENEVLTVTVPKEQVKKPDVKSIEISG

SEQ ID NO: 5732 - protein, 153 aa, Glycine max
MSLIPSIFGGRRSNVFDPFSLDVWDPFKDFHFPTSLSAENSASVNTRVDWKETPEAHVFKADIPGLKKEEVKVEIEDDRVLQISGERNLEKEDKNDTWHRLERSSGKFMRRFRLPENAKVEQVKASMENGVLTVTVPKEEVKKPDVKAIEISG

SEQ ID NO: 5733 - protein, 159 aa, Medicago truncatula
MSLIPSFFGGRRSNVFDPFSLDVWDPFKDFPLTNSALSASSFPQENSAFVSTRIDWKETPEAHVFKADLPGLKKEEVKVEIEGDRVLQISGERNVEKEDKNDQWHRVERSSGKFMRRFRLPENAKMDQVKAAMENGVLTVTVPKEEVKKPDVKSIEISG

SEQ ID NO: 5734 - protein, 153 aa, Glycine max
MSLIPSIFGGRRSNVFDPFSLDVWDPFKDFHFPTSLSAENSAFVNTRVDWKETPEAHVFEADIPGLKKEEVKVQIEDDRVLQISGERNLEKEDKNDTWHRVERSSGNFMRRFRLPENAKVEQVKASMENGVLTVTVPKEEVKKPDVKAIEISG

SEQ ID NO: 5735 - protein, 154 aa, Carica papaya
MSLIPSFFGNRGSSVFDPFSLDVWDPFKDFPFPSSSISRENSALVNTRVDWKETPEAHVFKADLPGLKKEEVKVEVEDDRVLQISGERHVEKEDKNDTWHRVERSSGKFSRRFRLPENVKMDQVKASMENGVLTVTVPKAEVKKPDVKAIEISG

SEQ ID NO: 5736 - protein, 154 aa, Arachis hypogaea
MSLIPSFFGGRRSNVFDPFSLDVWDPFKDFQFPSSLTSSDNSAFVNTRVDWKETPEAHVFKADLPGLKKEEVKVEIEDNSVLQISGERNVEKEDKNDTWHRVERSSGKFMRRFRLPENAKMDQVKASMENGVLTVTVPKAEVKKPDVKPIQITG

SEQ ID NO: 5737 - protein, 159 aa, Medicago truncatula
MSLIPSFFGGRRSNVFDPFSLDVWDPFKDFSFPNSALSASSFPQENSAFVSTRIDWKETPEAHVFKADLPGLKKEEVKVEIEDDRVLQISGERNVEKEDKNNQWHRVERSSGKFMRRFRLPENAKMDQVKAAMENGVLTVTVPKEEVKKPDVKSIEISG

SEQ ID NO: 5738 - protein, 159 aa, Medicago truncatula
MSLIPSFFGGRRSNTFDPFSLDVWDPFKDFPFTNSSLSASSFPQENSAFVSTRIDWKETPEAHVFKADLPGLKKEEVKVEIEDDRVLQISGERNFEKEDKNDQWHRVERSSGKFMRRFRLPENAKMDQVKAAMENGVLTVTVPKEEVKKPDVKSIEISG

SEQ ID NO: 5739 - protein, 140 aa, Nicotiana tabacum
SVFDPFSIDLWDPFRELGFPGSNSRETSAFAHTRVDWKETPEAHVFKADLPGLKKEEVKVEIEDDRVLQISGERNVEKEDKNDTWHRVERSSGKFMRRFRLPENAKMDQVKAAMENGVLTVTVPKEEVKKPDVKSIDITG

SEQ ID NO: 5740 - protein, 158 aa, Gossypium hirsutum
MSLIPSFFGNRRSSAFDPFSLDVWDPFKDFPFSSPSSPSTGSSETSAFVNTRIDWKETPESHVFKADVPGLKKEEVKVEVENDRVLQISGERNVEKEDKKDTWHRVERSSGKFMRRFRLPENAKMDQIKASMENGVLTVTIPKLEVKKPDVKSIEISG

SEQ ID NO: 5741 - protein, 156 aa, Theobroma cacao
MSLIPSFFGSRRSNIFDPFSLDVWDPFKDFPFPSSLTTHTPETSAFVNTRMDWKETPEAHVFKADVPGLKKEEVKVEVEDDRVLQISGERNIEKEDKNDTWHRVERSSGKFMRRFRLPENAKMDQINASMENGVLTVTVPKQEVKKPDVKAIEISG

SEQ ID NO: 5742 - protein, 159 aa, Gossypium hirsutum
MSLIPSFFGNRRSSIFDPFSLDVWDPFKDFPFSSPSSSLSTRSSETSAFVNTRIDWKETPEAHVFKADVPGLKKEEVKVEVEDDRVLQISGERNVEKEDKNDTWHRVERNSGKFMRRFRLPENAKMDQIKASMENGVLTVTIPKLEVKKPDVKSIEVSG

SEQ ID NO: 5743 - protein, 159 aa, Gossypium hirsutum
MSLIPSFFGSRRSSIFDPFSLDVWDPFKDFPFSSPSSSLSTRSSETSAFVNTRIDWKETPEAHVFKADVPGLKKEEVKVEVEDDRVLQISGERNVEKEDKNDTWHRVERSSGKFMRRFRLPENAKMDQIKASMENGVLTVTIPKLEVKKPDVKSVEISS

SEQ ID NO: 5744 - protein, 154 aa, Carica papaya
MSIIPSIFGSRRSNVFDPFSLDVWDPFKDFPFSSSSMSRDNSAFVNTRVDWKETPEAHVFKADLPGMKKEEVKVEIEDDRVLQISGERHVEKEDKNDTWHRVERSSGKFSRRFRLPENVKMDQVMASMENGVLTVTVPKAEVKKPDVKAIEISG

SEQ ID NO: 5745 - protein, 154 aa, Arachis hypogaea
MSLIPSFFGGRRSNVFDPFSLDVWDPFKDFQFPSSLTSSENSAFVNTRVDWKETPEAHVFKADLPGLKKEEVKVEIEDNSVLQISGERNVEKEDKNDTWHRVERSSGKFMRRFRLPENAKMDEVKAAMENGVLTVTVPKAEVKKPDVKPIQITG

SEQ ID NO: 5746 - protein, 154 aa, Glycine max
MSLIPSFFGGRRSNVFDPFSLDVWDPFKDFSFPNSALSAENSAFVSTRVDWKETPEAHVFKADIPGLKKEEVKLEIQDDRVLQISGERNVEKEDKNDTWHRVERSSGKFMRRFRLPENAKVDQVKASMENGVLTVTVPKEEIKKPDVKAIDISG

SEQ ID NO: 5747 - protein, 157 aa, Jatropha curcas
MALIPSFFGNSRSNIFDPFSALDVWDPFRDFSFPSSSSLVSRENSAFINTRIDWRETPEAHIFKADLPGLKKEEVKVEIEDDRVLQISGERNVEKEDKNDTWHRVERSSGKFMRRFRLPENAKMDQVKASMENGVLTVTVPKEEVKKPDVKAIEISG

SEQ ID NO: 5748 - protein, 154 aa, Carica papaya
MSLIPSFFGNRGSSIFDPFSLDVWDPFKDFPFPSSSISRENSAFVNTRVDWKETPEAHVFRADLPGLKKEEVKVELEDDRVLQISGERHVEKEDKNDTWHRVERSSGKFSRRFRLPENVKMDQVKASMENGVLTVTVPKAEAKKPDVKAIEISG

SEQ ID NO: 5749 - protein, 154 aa, Arachis hypogaea
MSLIPSFFGGRRSNVFDPFSLDVWDPFKDFQFPSSLTSSDNSAFVNTRVDWKETPEAHVFKADLPGLKKEEVKVEIEDNSVLQISGERNVEKEDKNDTWHRVERSSGKFMRRFRLPENAKMDEVKAAMENGVLTVTVPKAEVKKPDVKPIQITG

SEQ ID NO: 5750 - protein, 151 aa, Arachis hypogaea
MSLIPSFFGGRRSDPFSLDVWDPFRDFQFPSSLASSENSAFVNTRVDWKETPEAHVFKADLPGLKKEEVKVEIEDNSVLQISGERNVEKEDKNDTWHRVERSSGKFMRRFRLPENAKMDQVKASMENGVLTVTVPKAEVKKPDVKPIQITG

SEQ ID NO: 5751 - protein, 154 aa, Glycine max
MSLIPGFFGARRSNVFDPFSLDIWDPFKDFHVPTSSVSAENSAFVSTRVDWKETPEAHVFKADIPGLKKEEVKVQIEDDRVLQISGERNVEKEDKNDTWHRVERSSGKFVRRFRLPENAKVNEVKASMENGVLTVTVPKEEVKKPDVKAIEISG

SEQ ID NO: 5752 - protein, 141 aa, Solanum lycopersicum
MSLIPRIFGDRRSSSMFDPFSIDVFDPFRELGFPGTNSGESSAFANTRIDWKETPEAHVFKADLPGLKKEEVKVEVEEDRVLQISGERNVEKEDKNDKWHRVERSSGKFMRRFRLPENAKMDQVKASMENGVLTVMFRRRR

SEQ ID NO: 5753 - protein, 153 aa, Glycine max
MSLIPSFFGGRRSSVFDPFSLDVWDPFKDFPFPSSLSAENSAFVSTRVDWKETPEAHVFKADIPGLKKEEVKLEIQDGRVLQISGERNVEKEDKNDTWHRVERSSGKLVRRFRLPENAKVDQVKASMENGVLTVTVPKEEIKKPDVKAIDISG

SEQ ID NO: 5754 - protein, 158 aa, Euphorbia esula
MALNPFFGNRRSNIFDPFSLDIWDPFKDFPFPASSSSSSLISPENSAFVGTRIDWKETPEAHVFKADLPGLKKEEVKVEIEDDRVLQISGERNVEKEDKNDTWHRVERSSGKFMRRFRLPENAKMDQVKAAMENGVLTVTVPKEEVKKPDVKSIEISG

SEQ ID NO: 5755 - protein, 158 aa, Euphorbia esula
MALNPFFGNRRSNIFDPFSLDIWDPFKDFPFPSSSSSSPLISPENSAFVGTRIDWKETPEAHVFKADLPGLKKEEVKVEIEDDRVLQISGERNVEKEDKNDTWHRVERSSGKFMRRFRLPENAKMDQVKAAMENGVLTVTVPKEEVKKPDVKSIEISG

SEQ ID NO: 5756 - protein, 158 aa, Medicago truncatula
MSLIPSFFGGRRSNTFDPFSLDVWDPFKDFPFSNSSLSASFPRENSAFASTQVDWKETPEAHVFEADLPGLKKEEVKVEIEGDRVLQISGERNVEKEDKNDQWHRVERSSGKFMRRFRLPENAKMDQVKAAMENGVLTVTVPKEEIKKPDVKSIEISG

SEQ ID NO: 5757 - protein, 157 aa, Manihot esculenta
MALVPSFFGNTRSSIFDPFNSFELWDPFKDFQFPSSSSIISGENSAFVNARIDWKETPEAHVFKADLPGLKKEEVKVEIEDDRVLQISGERNVEKEDKNDTWHRVERSSGKFLRRFRLPENAKMDQVKASMENGVLTVTVPKEEVKRPDVKAIEISG

SEQ ID NO: 5758 - protein, 156 aa, Gossypium hirsutum
MAMIPSFYGSRRSNVFDPFSLDVWDPFKDFPLSSSLTSQTPETSAFVNTRIDWKETPEAHVFKADVPGLKKEEVKVEVEDDRVLQISGERNMEKEDKNDTWHRVERSSGKFMRRFRLPENAKMDQIKASMENGVLTVTVPKLEVKKPDVKAIDISG

SEQ ID NO: 5759 - protein, 156 aa, Gossypium hirsutum
MAMIPSFFGNRRSNVFDPFSLDVWDPFKDFPLSSSLTSQTPETSAFVNIRIDWKETPEAHVFKADVPGLKKEEVKVEVEDDRVLQISGERNIEKEDKNDTWHRVERSSGKFMRRFRLPENAKMDQIKASMENGVLTVTVPKLEVKKPDVKAIDISG

SEQ ID NO: 5760 - protein, 155 aa, Cichorium intybus
MSIIPSFFGGRRSSIFDPFSLDIWDPFKDFPISSSSDVSRETSALVNTRVDWKETPEAHVFKADLPGIKKEEVKVEVEDDRILQISGERNVEKEDKNDTWHRVERSSGKFTRRFRLPENAKMDQVKAAMENGVLTITVPKEEVKKPDVKSIEISG

SEQ ID NO: 5761 - protein, 48 aa, Solanum tuberosum
IKIENQASRHRNFSKSSLKMSLIPRRIFGDRRSSSMFDPFSIDVFDPI

SEQ ID NO: 5762 - protein, 153 aa, Gossypium hirsutum
MSLIPSFFGNRRSNNVFDPFSLDVWDALKDFPVSTRSPETSAFVDARIDWRETPEAHVFKADVPGLKKEEVKVEVEDDRVLQISGERNVEKEDKNDTWHRLERSSGKFMRRFRLLENVKMDQVKASMENGVLTVTVPKMEVKKPDVKAIDISG

SEQ ID NO: 5763 - protein, 154 aa, Carica papaya
MSLIPSFFGNRGSSVFDPFSLDVWDPFKDFPFPSSSISRETSALVNTRVDWKETPEAHVFKADLPGLKKEEVKVEVEDDRVLQISGERHTEKEDKNDTWHRVERSSGKFSRRFRLPENVKMDQVKASVENGVLTVTVPKAEVKKPEVKAIEVSG

SEQ ID NO: 5764 - protein, 154 aa, Arachis hypogaea
MSLIPSFFGGRRSNVFDPFSLDVWDPFKDFQFPSSLTSSDNSAFVNTRVDWRETPEAHVFKADLPGLKKEEVKVEIEDNSVLQISGERNVEKEDKNDTWHRVERSSGKFMRRFRLPENAKMDEVKAAMENGVLTVTVPKAEVKKPDVKPIQITG

SEQ ID NO: 5765 - protein, 153 aa, Glycine max
MSLIPSFFGGRRSNVLDPFSLDVWDPFKDFPFPTSLSAENSAFVSTRVDWKETPEAHVFKADIPGLKKEEVKLEIQDDRILQISGERNVEKEDKNDTWHRVERSSGKFMRSFRLPDNAKVDQVKASMENGVLTVTVPKEEIKKPDVKAIEISG

SEQ ID NO: 5766 - protein, 157 aa, Manihot esculenta
MAMIPSFFGNRRSSIFDPFNSFDLWDPFKDFPFPSSSSIVSHENTAFVNTRIDWKETPEAHIFKADLPGLKKEEVKVEVEDDRVLQISGERNVEKEEKNDTWHRVERSSGKFLRRFRLPENAKMDQVKASMENGVLTVTVPKEEVKKPDVKAIEISG

SEQ ID NO: 5767 - protein, 157 aa, Manihot esculenta
  misc_feature (18)..(18): Xaa can be any naturally occurring amino acid
MALVPSFFGNTRSSIFDXFNSFELWDPFKDFQFPSSSSIISGENSAFVNARIDWKETPEAHVFKADLPGLKKEEVKVEIEDDRVLQISGERNVEKEDKNDTWHRVERSSGKFLRRFRLPENAKMDQVKASMENGVLTVTVPKEEVKRPDVKAIEISG

SEQ ID NO: 5768 - protein, 156 aa, Populus trichocarpa
MSMIPSFFGNRRSSIFDPFSLDVWDPLKDFPFPSPSFPRDENSAFVNTRIDWKETPEAHVFKADLPGLRKEEVKVQIEDDRVLQISGERNVEKEDKNDTWHRVERSSGKFSRRFRLPENTKMNQVKASMENGVLTVTVPKEEAVKKPEVKSIEISG

SEQ ID NO: 5769 - protein, 156 aa, Theobroma cacao
MAMIPSFFGNRSSSVFDPFSLDVWDPFKDFPFPSSLTRHAPETSAVANTRIDWKETPEAHVFKADLPGLKKEEVKVEIEDDRVLQISGERKIEKEDKNDTWHRVERSSGMFSRRFRLPENVKMDQVKASMENGVLTVTVPKVEVKKPDVKAIDISG

SEQ ID NO: 5770 - protein, 156 aa, Gossypium hirsutum
MAMIPSLFGNRRSSVFDPFALDVWDPFKDFPFPSSLTTGSPETSAFVNARMDWKETPEAHVFKADLPGLKKEEVKVEVEDDRVLQISGERKIEKEDKNDTWHRVERSSGKFSRRFRLPENVKMDQVKASMENGVLTVTVPKVEVKKPDVKAIEISG

SEQ ID NO: 5771 - protein, 156 aa, Lactuca sativa
MSIIPSFFGGRRSSIFDPFSLDIWDPFKDFPISSSSDHVSSETSALVNTRVDWKETPEAHVFKADLPGIKKEEVKVEVEDDRILQISGERNVEKEDKNDTWHRVERSSGKFTRRFRLPENAKMDQVKAAMENGVLTITVPKEEVKKPDVKSIEISG

SEQ ID NO: 5772 - protein, 155 aa, Taraxacum officinale
MSIIPSFFGGRRSSILDPFSLDVWDPFKDFSVPSPSDVSRETSALVNTRVDWKETPEAHVFKADLPGIKKEEVKVEVEDDRILQISGERNVEKEDKNDTWHRVERSSGKFTRRFRLPENAKMDQVKAAMENGVLTITVPKEEVKKPDVKSIDISG

SEQ ID NO: 5773 - protein, 154 aa, Glycine max
MSLIPSIFGGPRSNVFDPFSLDMWDPFKDFHVPTSSVSAENSAFVNTRVDWKETQEAHVLKADIPGLKKEEVKVQIEDDRVLQISGERNVEKEDKNDTWHRVERSSGKFMRRFRLPENAKVEQVKACMENGVLTVTIPKEEVKKSDVKPIEISG

SEQ ID NO: 5774 - protein, 153 aa, Gossypium hirsutum
MSLIPSFFGNRRSNNVFDPFSLDLWDPLKDFPVSTRSPETSAFVDARIDWRETPEAHVFKADVPGLKKEEVKVQVEDDRVLQISGERNVEKEDKNDTWHRLERSSGKFMRRFRLPENVKMGQVKASMENGVLTVTVPKMEVKKPDVKAIDISG

SEQ ID NO: 5775 - protein, 286 aa, Unknown
  Sequence found in Organisms: Solanum tuberosum, Solanum phureja
MAAYRWKSFNDDGDRPEKPRRYGVTEMKGPNYSLFSRGLLEDVFESMGQFVDGLKLCDGSHTVMPKNYIKEVTDMAHKHNVYVNSGDWADQMLRRGPSSLKEYIEECKQLGFDSIELDVASLGLPEETLLRYVRLIKSSGLRAKPQFSVKFNKSDIAFAGDRAFGAYVIPAPQTSEMVEDVDLLVRRAERCLEAGADMIMINADDLCRQAGLLRSDIVAKIVGRLGLEKTMFEASNPKISEWFVKRYGPKVNLIVDHSQVMDLECLRGRNLGQNHSSVLGRSYFLL

SEQ ID NO: 5776 - protein, 282 aa, Solanum tuberosum
MAAYRWKSFNDDGDRPEKPRRYGVTEMKGPNYSLFSRGLLEDVFESMGQFVDGLKLCDGSHTVMPKNYIKEVTDMAHKHNVYVNSGDWADQMLRRGPSSLKEYIEECKQLGFDSIELDVASLGLPEETLLRYVRLIKSSGLRAKPQFSVKFNKSDIAFAGDRAFGAYVIPAPQTSEMVEDVDLLVRRAERCLEAGADMIMINADDLCRQAGLLRSDIVAKIVGRLGLEKTMFEASNPKISEWFVKRYGPKVNLIVDHSQVMDLECLRGRNLGQNHSSVLGRS

SEQ ID NO: 5777 - protein, 286 aa, Solanum melongena
MAAYRWKSFNDDGDRPEKPRSYGVTEMKGPHYSLFSRGLIEDVFESMSQFVDGLKLCDGSHTSVPKTYIKEVTDMAHKHNVYVSSGDWAGQMLRQGPSALKEYIEECKQLGFDTIELDVASLGLPEETLLRYVRLIKSSGLRAKPQFSVKFNKSDIAFSGDRAFGAYVIPAPQTSEMVEDVDLLVRRAERCLEAGADMIMINADDLCRQADLLRSDMVAKIVGRLGLEKTMFEASNPKILEWFVKRYGPKVNLFVDHSQVMDLECLRGRNLGQNHSSVLGRSYFYV

SEQ ID NO: 5778 - protein, 287 aa, Nicotiana tabacum
  misc_feature (176)..(176): Xaa can be any naturally occurring amino acid
MAAYRWKSFNDEEEDRPEKPRRYGVTEMRGPHYSLFSRGVLEDVFESVGQFVDGLKFCGGSHTLMPKTYIKEVTDMAHKHNVYVSSGDWADQMLRQDPSAIKEYIEECKRLGFDTIELDVASLGLPEETLLRYVRLIKSGGLRAKPQFSVKFNKSDIAFTGDRAFGAYVIPAPQTXEMVEDVDLLVRRAERCLEAGADMIMINADDLCRQADSLRSDMVAKIVGRLGLEKTMFEASSPKISEWFIKRYGPKVNLFVDHSQVMDLECLRGRNLGQNHSSLLGRSYFLL

SEQ ID NO: 5779 - protein, 252 aa, Solanum phureja
MFDAGEFSPSSSTAALSAECFSSSSCFSSLSSSKKKKINNNNARRFSDEQIKSLETMFETETKLEPRKKLQLARELGLQPRQVAIWFQNKRARWKSKQLERDYSILKSNYDNLASQYESLKKEKQSLLIQLQKLNDVMQKERGKYCCKQEIELDNRCAAIKKNEMEGMPSLSFDLSSQHGTNGVISDDDIDSSIKADYLGLDDDAVHHLLKIVEAGDSSLTSPENWGSLNDDGILNHQPNSSSYDHWWDFWS

SEQ ID NO: 5780 - protein, 252 aa, Solanum tuberosum
MFDAGEFSPSSSTAALSAECFSSSSCFSSLSSSKKKKINNNNAKRFSDEQIKSLETMFETETKLEPRKKLQLARELGLQPRQVAIWFQNKRARWKSKQLERDYSILKSNYDNLASQYESLKKEKQSLLIQLQKLNDVMQKERGKYCCKQEIEVDNRCAAIKKNEMEGMPSLSFDLSSQHGTNGVISDDDIDSSIKADYLGLDDDAVHHLLKIVEAGDSSLTSPENWGSLNDDGILNHQPNSSSYDHWWDFWS

SEQ ID NO: 5781 - protein, 252 aa, Solanum tuberosum
MFDAGEFSPSSSTAALSAECFSSSSCFSSLSSSKKKKINNNNAKRFSDEQIKSLETMFETETKLEPRKKLQLARELGLQPRQVAIWFQNKRARWKSKQLERDYSILKSNYDNLASQYESLKKEKQSLLIQLQKLNDVMQKEREKYCCKQEIEVDNRCAAIKKNEMEGMPSLSFDLSSQHGTNGVISDDDIDSSIKADYLGLDDDAVHHLLKIVEAGDSSLTSPENWGSLNDDGILNHQPNSSSYDHWWDFWS

SEQ ID NO: 5782 - protein, 289 aa, Solanum tuberosum
MTRRKRRHAPYTTDDSRRRFPPPEAQPQPRIHPSDLIDDREAAQQREIEKLLQENRSLAGAHVSLNQELSAVQHELRLLSSTAATVKTERDAEVREVYDEARKKESDVRILDELRVELARVRSDIQNLVDDRKELTAKLQNMEKDLVKVGSELQQFPVIKAEIESMHKEVQRGRAAIDYEKKMHTSNLEYSQAMEKHKITLASEIEKLHAELANAEKRARAAAAAAAPSNLNRQISAATPNFTYSANYGNPETGYRENLYPAPYAVHQVQVSADAKTQYVGGAMPYVHH

SEQ ID NO: 5783 - protein, 275 aa, Solanum phureja
MTRRKRRHAPYTTDDSRRRFPPPEAQPQPRIHPSDLIDDREAAQQREIEKLLQENRSLAGAHVSLNQELSAVQHELRLLSSTAATVKTERDAEVREVYDEARKKESDVRILDELRVELARVRSDIQNLVDDRKELTAKLQNMEKDLVKVGSELQQFPVIKAEIESMHKEVQRGRAAIDYEKKMHTSNLEYSQAMEKHKITLASEIEKLHAELANAEKRARAAAAAAAPSNLNRQISAATPNFTYSANYGNPETGYRENLYPAPYAVHQVCNYISL

SEQ ID NO: 5784 - protein, 289 aa, Unknown
  Sequence found in Organisms: Solanum tuberosum, Solanum phureja
MGSSFSVLIPQFSSTVTKQNHSSLGDLPESCVASVLVYMDPPQICKLSMLNRAFRGASSADFVWESKLPMNYSSIIQRVFAGRNFPANLCKRDIYAMLCRPNSFDGGSKKVWLDKRTGRVCMSISSSGLAITGIDDRRYWSRIETDESRFKSVAYLQQIWWFEVDGEVDFPFPVGSYSIFFRLQVGRASRRFGRRVCNSEHVHGWDKKPVRFQLSTSDGQQATTQCYLNEPGIWKYHHVGDFVATGSVEPMKVKYSLTQIDCTHTKGGLCVDSVLICPVEFTERLKQSF

SEQ ID NO: 5785 - protein, 289 aa, Solanum tuberosum
MGSSFSVLIPQFSSTVTKQNHSSLGDLPESCVASVLVYMDPPQICKLSMLNRAFRGASSADFVWESKLPMNYSSIIQRVFAGRNFPANLCKRDIYAMLCRPNSFDGGSKKVWLDKRTGRVCMSISSSGLAITGIDDRRYWSRIETDESRFKSVAYLQQIWWFEVDGEVDFPFPVGSYSMFFRLQVGRASRRFGRRVCNSEHVHGWDKKPVRFQLSTSDGQQATTQCYLNEPGIWKYHHVGDFVATGSVEPMKVKYSLTQIDCTHTKGGLCVDSVLICPVEFTERLKQSF

SEQ ID NO: 5786 - protein, 288 aa, Solanum melongena
MGSSFSFLIPQFSSAVTQQKPSLGDLPESCVASVLVYMDPPQICKLSVLNRAFRGASSADFVWESKLPMNYSSIIQRVFDGRNFPANLCKRDIYAKLCRPNSFDGGTKRVWLDKRTGRVCMSISSSGLAITGIDDRRYWSRIETDESRFKSVAYLQQIWWFEVDGEVDFPFPAGSYSIFYRLQVGRSSRRFGRRVCNSEHVHGWDRKPVRFQLSTSDSQEATTQCYLNEPGIWKYHHVGDFVATGSFEPMKVKYSMTQIDCTHTKGGLCVDSVLICPVEFTERLKQSF

SEQ ID NO: 5787 - protein, 311 aa, Solanum tuberosum
MGDIVIEHSGTPHYEALNLQNVTTSENDADLVQSFCGDYLPEDITHEEKSTCTEALDRGYLEYGCPHYRRRCRIIAPCCNEMFDCRHCHNEYKNNINVDQKLRHEIPRHKVERVICSLCDTEQEVRQVCINCGVCMGRYFCETCKLFDDDTSKRQYHCNGCGICRIGGMENFFHCPKCRCCYSVLLRNSHPCVEGAMHHDCPVCFEYLFESINDVTVMPCGHTIHKNCLKEMQEHYQYACPLCSKSVCDMSKVWEKFDMEIAATPMPEPYQDKKVWILCNDCGITSEVQFHFVAQKCPCCKSYNTRQTRGR

SEQ ID NO: 5788 - protein, 311 aa, Solanum tuberosum
MGDIVIDHSGTPHYEALNLQNVTTSENDADLVQSFSGGYLPEDSTHEEKSTCTEALDRGYLEYGCSHYRRRCRIIAPCCNEMFDCRHCHNEYKNNINVDQKLRHEIPRHKVERVICSLCDTEQEVQQVCINCGVCMGRYFCETCKLFDDDISKRQYHCNGCGICRIGGMENFFHCPKCRCCYSVLLRNSHPCVEGAMHHDCPVCFEYLFESINDVTVMPCGHTIHKNCLKEMQEHYQYACPLCSKSVCDMSKVWEKFDMEIAATPMPEPYQDKQVWILCNDCGITSEVQFHFVAQKCPCCKSYNTRQIRGR

SEQ ID NO: 5789 - protein, 230 aa, Solanum tuberosum
MFDCRHCHNEYKNNINVDQKLRHEIPRHKVERVICSLCDTEQEVQQVCINCGVCMGRYFCETCKLFDDDISKRQYHCNGCGICRIGGMENFFHCPKCRCCYSVLLRNSHPCVEGAMHHDCPVCFEYLFESINDVTVMPCGHTIHKNCLKEMQEHYQYACPLCSKSVCDMSKVWEKFDMEIAATPMPEPYQDKQVWILCNDCGITSEVQFHFVAQKCPCCKSYNTRQIRGR

SEQ ID NO: 5790 - protein, 311 aa, Solanum phureja
MGDIVIEHSGTTHYEALNLQNVTTSENDADLVQSFCGDYLPEDITHEEKSTCTEALDRGYLEYGCPHYRRRCRIIAPCCNEMFDCRHCHNEYKNNINVDQKLRHEIPRHKVERVICSLCDKEQEVRQVCINCGVCMGRYFCETCKLFDDDTSKRQYHCNGCGICRIGGMENFFHCPKCRCCYSVLLRNSHPCVEGAMHHDCPVCFEYLFESINDVTVMPCGHTIHKNCLKEMQEHYQYACPLCSKSVCDMSKVWEKFDMEIAATPMPEPYQDKKVWILCNDCGITSEVQFHFVAQKCPCCKSYNTRQTRGR

SEQ ID NO: 5791 - protein, 307 aa, Solanum melongena
VIEHPGVPHYEALNLQNITASENDADLVQSFCGDCLPEHGTCEEKSSCNEALDRGYLEYGCSHYQRRCRIRAPCCNEIFDCRHCHNEAKNNINIDPRLRHEISRHKVERVICSLCDTEQEVRQVCINCGVCMGRYFCGTCKLFDDDVSKRQYHCNGCGICRIGGMENFFHCPKCRCCYSVLLRDSHPCIEGAMHHDCPVCFEYLFESINDVTVMPCGHTIHKNCLKEMQEHYQYACPLCSKSVCDMSKVWEKFDMEIAATPMPEPYQDKKVWILCNDCGITSEVQFHFLAQKCPCCKSYNTRQTRGR

SEQ ID NO: 5792 - protein, 310 aa, Petunia hybrida
MGDVVIEHPGTPRSETINLHNLISKNHADVLENFHGGYFPEDETREEKSTGTEALDRGYLDYGCSHYRRRCRIRAPCCNEIFDCRHCHNEAKNNINIDQKLRHEIPRHKVERVICSLCDTEQEVRQVCVNCGVCMGRYFCETCKLFDDDISKRQYHCNGCGICRIGGKENFFHCPKCRCCYSVLLKNSHPCVEGAMHHDCPVCFEYLFESVNDVTVMPCGHTIHKNCLKEMQEHYQYACPLCSKSVCDMSKVWETFDVEIAATPMPESYQDKKVWILCNDCGTTSEVQLHFVAQKCPCCKSYNTRQTRGR

SEQ ID NO: 5793 - protein, 310 aa, Nicotiana tabacum
MGGIVIEHSGTPCSETINMHNVIFMSDADVVQNFHEGYLPEDGTREEKSYSTEALDRGYLEYGCSHYRRRCRIRAPCCNEIFVCRHCHNEAKNNINIDQKLRHEIPRHKVERVICSLCDTEQEVRQVCISCGVCMGKYFCETCKLFDDDISKRQYHCNGCGICRIGGMENFFHCSKCRCCYSVLLKKSHPCVEGAMHHDCPVCFEYLFESVNDVTVMPCGHTIHQNCLKEMQEHYQYACPLCSKSVCNMSKVWEKFDMEIAAAPMPESYQDKKVWILCNDCGITSEVQFHFVAQKCPCCKSYNTRQTRGR

SEQ ID NO: 5794 - protein, 99 aa, Solanum phureja
MGGKRFALTGSSSSSKNDGVLARISQSSIVTKGKQAACGATYVGKKLAKSTGKAAWLVATTFLVLGLPLIIVMDREQQLNDLDLQQASLLGASPATTQN

SEQ ID NO: 5795 - protein, 101 aa, Capsicum annuum
MAASTSGKRFSLSKNDGVLAKISNSTIVTKGKQAACGATYVGKKLAKSTGKAAWHVATTFLVLGLPLIIVMDREQQLNDLDLQQASLLGVVPPASAVAPQK

SEQ ID NO: 5796 - protein, 116 aa, Solanum phureja
LVMKKIEDPTSRQQFYSKRKDTILKKSNELAVLCDVDVGLLMFSPAGEVTSYSSKESLEDVMLLAMNKAGELNKRSPENPNEQPLTEILTQSKHEGKMVEKIAIAMRRSLISLKKG

SEQ ID NO: 5797 - protein, 329 aa, Solanum tuberosum
MAGKIMHAVQYDSYGGGAAGLKHVEVPVPTPKKDEILLKLEATSINPVDWKIQKGMLRPLLPTKFPFIPTTDVGGEVVEVGSNVKSFKAGDKVVAMLNTLNGGGLAEYAVANESLTVPRPAEVSAAEGAGLVIAGLTALQALVNPAEVKLDGTGPRKNILVTAASGGVGHYAVQLAKLGNTHVTATCGARNIDFVKSLGADEVLDYKTPEGAALKSPSGQKYDAVIHCTTGIPWSTFEPNLSSSGKVIDITPGVSAMWTFAVKKLTFSKKQLVPLLLIPKKENLELIVGLVKEGKLKTVIDSKFPLSNAEDAWSRSIDGHATGKIVVEP

SEQ ID NO: 5798 - protein, 328 aa, Solanum phureja
MAGKIMHAVQYDSYGGGAALKHVEVPVPTPKKDEILLKLEATSINPVDWKIQKGMLRPLLPTKFPFIPTTDVGGEVVEVGSNVKSLKAGDKVVAMLNTLNGGGLAEYAVANESLTVPRPAEVSAAEGAGLVIAGLTALQALVNPAEVKLDGTGPRKNILVTAASGGVGHYAVQLAKLGNTHVTATCGARNIDFVKSLGADEVLDYKTPEGAALKSPSGQKYDAVIHCTTGIPWSTFEPNLSSSGKVIDITPGVSAMWTFAVKKLTFSKKQLVPLLLIPKKENLELIVGLVREGKLKTVIDSKFPLSNAEDAWSRSIDGHATGKIVVEP

SEQ ID NO: 5799 - protein, 329 aa, Nicotiana tabacum
MAGKVMHAIQYNSYGGGAAGLKHVEVPVPTPKKDEVLLKLEATSLNPVDWKIQKGVLRPLLPPKFPFIPTTDVGGEVVEVGSSVKDFKVGDKVVAMLNTLNGGGLAEYAVAKESLTVPRPAEVSAAEGAGLPVAGVTALQALVNPAEVKLDGTGPRKNILVTAASGGVGHYAVQLAKLGNTHVTATCGARNFDFVKSLGADEVLDYKTPEGAALKSPSGQIYDAVIHCTTGIPWSTFEPNLSAKGKVIDLTPGPSAMWTYAVKKLTFSKKQLVPLLLIPKKENLDLVVSLVKEGKLKTVIDSKHPLSKAEDAWSRSIDGHATGKIIVEP

SEQ ID NO: 5800 - protein, 329 aa, Solanum tuberosum
MAGKIMQAVQYDSYGGGAAALKHVEVPVPTPKKDEVLVKVEATSINPLDCKIQKGMFRPLLPPKFPFIPATDVAGEVVEVGSNVKSFKAGDKVVAMLSTKSGGGLAEYAVPKESLTVSRPAEVSAAEGAGLLIAGLTALQALVNPAEVKLDGTGPRKNILVTAASGGVGHYAVQLAKLGNAHVTATCGARNFDFVKSLGADEILDYKTPEGAALKSPSGQKYDAVINCTTGIPWSTFEPNLSSSGKVIDLTPGASSMWTFAVKKLTFSKKQLVPFLLNAKKENLELLVRLVKEGKLKTVIDSKFPLSKAEDAWSRSIDGHATGKIFVEP

SEQ ID NO: 5801 - protein, 329 aa, Solanum phureja
MAGKIMQAVQYDSYGGGAAALKHVEVPVPTPKKDEVLVKVEATSINPLDCKIQKGMFRPLLPPKFPFIPATDVAGEVVEVGSNVKSFKAGDKVVAMLSTKSGGGLAEYAVPKESLTVSRPAEVSAAEGAGLLIAGLTALQALVNPAEVKLDGTGPRKNILVTAASGGVGHYAVQLAKLGNAHVTATCGARNFDFVKSLGADEILDYKTPEGAALKSPSGQKYDAVINCTTGIPWSTFEPNLSSSGKVIDLTPGASSMWTFAVKKLTFSKKQLVPFLVNAKKENLELLVRLVKEGKLKTVIDSKFPLSKAEDAWSRSIDGHATGKIFVEP

SEQ ID NO: 5802 - protein, 329 aa, Capsicum annuum
MAGKVMHAVQYNSYGRGAAGLKHVEVPVPTPKTDEVLLKLEAASINPIDWKIQNGMLRPLLPPKFPFIPTTDVGGEVVEVGSNVKSFKAGDKVVAMLGTRNGGGLAEYAVAKESMTVTRPTEVSAAEGAGLLVAGLTALQALVNPAGVKLDGTGPRKNILVTAASGGVGHYAVQLAKLGNTHVTATCGARNFDFVKSLGADEVLDYKTPEGAALKSPSGQKYDAVVHCTTGIPWSTFEPNLSASAKVIDLTPGAGAMWTFAVKKLTFSKKQLVPFLYTPNKENLELLVRLVKEGKLKTVIDSKHPLSKAEDAWSRSIDGHATGKIFVEP

SEQ ID NO: 5803 - protein, 329 aa, Solanum tuberosum
MTGKIMQAVQYDSYGGGAAALKHVEVPVPTPKKDEVLVKVEATSINPLDCKIQKGMFRPLLPPKFPFIPATDVAGEVVEVGSNVKSFKAGDKVVAMLSTKSGGGLAEYAVPKESLTVSRPAEVSAAEGAGLLIAGLTALQALVNPAEVKLDGTGPRKNILVTAASGGVGHYAVQLAKLGNAHVTATCGARNFDFVKSLGADEILDYKTPEGAALKSPSGQKYDAVINCTTGIPWSTFEPNLSSSGKVIDLTPGASSMWTFAVKKLTFSKKQLVPFLINAKKENLELLVRLVKEGKLKTVIDSKFPLSKAEDAWSRSIDGHATGKIFVEP

SEQ ID NO: 5804 - protein, 329 aa, Solanum lycopersicum
MSGKIMHAVQYHSYGGGAAALKHVEVPVPTPNKDEVLVKMEATSINPLDSKIQKGMLRPFLPSKFPFIPTTDVAGEVVEVGSNVKSFKAGDKVVAMLSTKSGGGLAEYAVPKESLTVSRPAEVSAAEGAGLVIAGLTALQALVNPAEVKLDGTGPRKNILVTAASGGVGHYAVQLAKLGNAHVTATCGARNIDFVKSLGADEILDYKTPEGATLKSPSGQKYDAVINCTTGIPWSTFEPNLSSSGKVIDLTPGASSMLTFAVKKLTFSKKQLVPFLVNANKENLELLVKLVKEGKLKTVIDSKFPLSKAEDAWSRSIDGHATGKILVEP

SEQ ID NO: 5805 - protein, 329 aa, Solanum lycopersicum
MSGKIMHAVQYHSYGGGAAALKHVEVPVPTPNKDEVLVKVEATSINPLDSKIQKGMLRPFLPSKFPFIPTTDVAGEVVEVGSNVKSFKAGDKVVAMLSTKSGGGLAEYAVPKDSLTVSRPAEVSAAEGAGLVIAGLTALQALVNPAEVKLDGTGPRKNILVTAASGGVGHYAVQLAKLGNAHVTATCGARNIDFVKSLGADEILDYKTPEGATLKSPSGQKYDAVINCTTGIPWSTFEPNLSSSGKVIDLTPGASSMLTFAVKKLTFSKKQLVPFLVNANKENLELLVKLVKEGKLKTVIDSKFPLSKAEDAWSRSIDGHATGKILVEP

SEQ ID NO: 5806 - protein, 329 aa, Solanum melongena
MAGKIMHAVQYDSYGRGAAGLKHVEVPVPTPKMDEVLIKVEATSINPIDWKIQKGMLRPLLPPKFPFIPTTDVAGEVVEVGSNVRSFKVGDKVVAMLNTKSGGGLAEYAVPKENLTVSRPTEVSAAEGAGLLIAGLTAHQALVDHAGVKLDGTGPRKNILVTAASGGVGHYAVQLAKLGNAHVTATCGARNIDFVKSLGADEVLDYKTPEGAALKSPSGQKYDAVVHCTTGIPWSTFEPNLSSSGKVIDLTPGAGAMLTFAIKKLTFSKKQLVPLLVNAKKENLELLVRLVKEGKLRTVIDSKFPLSKAEDGWSKSIDGHATGKIFVEP

SEQ ID NO: 5807 - protein, 302 aa, Solanum lycopersicum
MAMHAVQYDSYGSGSAGLKHVEVPVPTPKKDEVLIKVEATSINPFDWKIQKGMLRPLLPTKFPFIPSIDVGGEVVEVGSNVKRFKAGDKVVAMLNALNGGGLAEYAVANESLTVPRLAEVSAAEGAGLIVAGLTALQALVNHSEVKLNGTGPRKNILVTAASGGVGHYAVQLAKLGNTHVTATCGVRNIDLVKSLGADEVLDYNTPEGAALKSPSGQKYDAVIHCTTGIPWSTFEPNLSSSGKVIDITPGVSAMWTFAVKKLTFSKKQLVPLLLIPKKENLELIVGLVKEGKLKTVIDSNFL

SEQ ID NO: 5808 - protein, 296 aa, Solanum tuberosum
MAGKIMHAVQYDSYGGGAAGLKHVEVPVPTPKKDEILLKLEATSINPVDWKIQKGMLRPLLPTKFPFIPTTDVGGEVVEVGSNVKSFKAGDKVVAMLNTLNGGGLAEYAVANESLTVPRPAEVSAAEGAGLVIAGLTALQALVNPAEVKLDGTGPRKNILVTAASGGVGHYAVQLAKLGNTHVTATCGARNIDFVKSLGADEVLDYKTPEGAALKSPSGQKYDAVIHCTTGIPWSTFEPNLSSSGKVIDITPGVSAMWTFAVKKLTFSKKAVGATAFNSQEGEPGIDCWACEGRET

SEQ ID NO: 5809 - protein, 332 aa, Citrus sinensis
MAGKPLMHAVQYNSYGGGAADLKHVELPVPTPSKDEVLLKLEATALNPVDWKIQKGQLRPFLPRKFPCIPATDVAGEVVGVGSEVKIFKAGDKVVAFLNYLVTNGGGLAEFAVAKESSTVTRPPEVSAAEGSGLPVAGLTAHQALTQSAGVKLDGSGQQKNILVTAASGGVGHYAVQLAKLGNTHVTASCGARNIEFVKSLGADEVLDYKTPDGAALKSPSGRKYDAVIHCATGIPWSTFEPNLGTNGKVIDITPGPSAMLTFALKKLTFSKKQLVPLLLIPKRENLDFLVKLVKEGKLKTVINSKHPLSKAEDAWAESIDGHATGKIIVEP

SEQ ID NO: 5810 - protein, 329 aa, Ipomoea nil
MAGKLMRALQYDGYGGGAAGLKHIEVPVPTPNKNEVLLKLEATSINPVDWKIQKGMIRPLLPGKFPYIPATDVAGEVVEVGAGVKNFKVGDKVVAMLSHLTGGGFAEYAVAKESLTAIRPPEVSPAEAAGLPVAGLTALQALVGAAGVKLDGSGPQKNILVTAASGGVGHYAVQLAKLGNAHVTATCGARNLGFVKSLGADEVIDYKTPDGAALKSPSLQTYDAVIHCATGIPWSTFEPNLSKKGKVIDLTPGASAMWTFAVKKLTMSKKQLVPLLLIPKSENLEYLVGLVKEGKLKSVIDSKHPLSKAEEAWAMSIDGHATGKIIVQP

SEQ ID NO: 5811 - protein, 329 aa, Arabidopsis lyrata
MAGKLMHALQYDSYGGGAAALKHVQVPVPTPKSNEVCLKLEATSLNPVDWKIQKGMIRPFLPRKFPCIPATDVAGEVVEVGSGVKNFKAGDKVVAVLSHLGGGGLAEFAVASEKLTVKRPQEVGAAEAAALPVAGLTALQALTNPAGLKLDGTGKKANILVTAASGGVGHYAVQLAKLANAHVTATCGARNIDFVKSLGADEVLDYKTPEGATLKSPSGKKYDAVVHCANGIPFSTFEPNLSENGKVIDITPGPSAMWTYAVKKVTMSKKQLVPLLLIPKAENLEFMVNLLKEGKVKTVIDSKHPLSKAEDAWAKSIDGHATGKIIVEP

SEQ ID NO: 5812 - protein, 329 aa, Mimulus guttatus
MAGRLMHAVQYEGYGGGAAGLKHVEVPVPTPSKGEVLLKLEAASINPIDWKIQKGMLRPLLPRKLPCIPTTDVAGEVVEIGSGVKNFKPGDKVVAMLSALTGGGFSEYGVANENLTVPRPPEVSAAEGASLPVAALTAHMALTQSIGLKLDKSGPHKNILVTAASGGVGHYAVQLAKLGNAHVTATCGARNIDFVKSLGADEVLDYNTPEGAALTSPSGKKYDGVVHCAPAIPWSVFEPNLGSSGKVVDITPGPSAMWTFAVKKLTFSKKRLVPLLLIPKGENLQYVVDLVKEGKLKSVVDSKFPLSKAEEAWAKSIDGHATGKIIVEP

SEQ ID NO: 5813 - protein, 329 aa, Ipomoea nil
  misc_feature (217)..(217): Xaa can be any naturally occurring amino acid
MAGKLMRALQYDGYGGGAAGLKHIEVPVPTPNKNEVLLKLEATSINPVDWKIQKGMIRPLLPGKFPYIPATDVAGEVVEVGAGVKNFKVGDKVVAMLSHLTGGGFAEYAVAKESLTAIRPPEVSPAEAAGLPVAGLTALQALVGAAGVKLDGSGPQKNILVTAASGGVGHYAVQLAKLGNAHVTATCGARNLGFVKSLGADEVIDYKTPDGAALKSXSLQTYDAVIHCATGIPWSTFEPNLSKKGKVIDLTPGASAMWTFAVKKLTMSKKQLVPLLLIPKSENLEYLVGLVKEGKLKSVIDSKHPLSKAEEAWAMSIDGHATGKIIVQP

SEQ ID NO: 5814 - protein, 329 aa, Brassica napus
MAEKLMHALQYESYGGGAAALKHVQVPVPSPKANEVLLKLEATSLNPVDWKIQKGMIRPFLPRKFPCIPATDVAGEVLEVGSGVKNFKAGDKVVSVLSHLTGGGLAEYAVASEKLTVKRPQEVGPAEAAALPVAGLTALQALTNPAGLKLDGTGKQANILVTAASGGVGHYAVQLAKLGNAHVTATCGARNIDFVKSLGADEVLDYKTPEGAALKSPSGKKYDSVIHCANGIPFSTFEPNLSENGKVIDITPGPSAMWTFAVKKITMSKKQLVPLLLIPKAENLEFMVNLVKEGKVKTVIDSKHPLSKAEDAWAKSIDGHATGKIIIEP

SEQ ID NO: 5815 - protein, 329 aa, Coffea canephora
MAGKVMQAVQFDGYGGGAAALKHVELPVPTPTKGEVLLKLEATSLNPVDWKIQKGVLRPIMPRKFPYVPATDVAGEVVEVGPEVKNLKAGDKVVAFLNPLYGGGLAEFAVAKESLTVQRPPEVSAAEGASLPVAALTAHQALTQPAGVNLDGSGPQKNILVTAASGGVGHYAVQLAKLGNTHVTATCGARNIDFVKSLGADEVIDYKTPEGAALKSPSGKMYDAVIHCASGIPWSTFEPNLSARGKVIDLTPGPSALWTFAVKKLTLAKKQLVPLLAVPKSENLDFLVNLVKEGKLKSVIDSKHPLSRAEDAWAKSMDGHATGKIVVEP

SEQ ID NO: 5816 - protein, 329 aa, Raphanus sativus
MAGKLMHALQYESYGGGVAALKHVQVPVPSPKDNEVLLKLEATSINPVDWKIQKGMIRPFLPRKFPCIPATDVAGEVMEVGSGVKNFKAGDKVVSVLSHLTGGGFAEYAVASEKLTVKRPQEVGPAEAAALPVAGLTALQALTNPAGLKLDGTGKQANILVTAASGGVGHYAVQLAKLGNAHVTATCGARNIDFVKSLGADEVLDYKTPEGAALKSPSGKKYDAVVHCANGIPFSTFEPNLSENGKVIDITPGPKAMWTFAVKKITMSKKQLIPLLLIPKAENLEFMVNLVKEGKVKTVIDSKYPLSKAEDAWAKSIDGHATGKIIVEP

SEQ ID NO: 5817 - protein, 157 aa, Solanum phureja
SNYYFMNRSHIPAFGSWDCNNDFPIPFTQCFESARQAGLLRYSYSDDRDLYVAGDLYQNDILTPAMIVVPRRKRKSSITNEGVGKARKEGWVVCNCEYDEEKKDTSTVPPSPPPPKRAPKAVDEDLYKISPQLLHSKPTRKGVRGFFSSCLLPTCAS

SEQ ID NO: 5818 - protein, 615 aa, Brachypodium distachyon
MATSPAAGAAILGTLNDFTSQKNWDKFFAIRGVGDSFEWYAEWPQIQAPLLSLLLEEEGADILVPGCGSSALSEQLYDLGFRRITNVDFSRVIVADMLRRHARVRPEMRWRVMDMTNMQFPDESFDFILDKGGLDALMEPEVGMELGMKYLNEAKRVLKSGGKFVCFTLAESHVLALLFSEFRFGWDMSIQAIAGEPSNKSAFQTFMVVMAKGKMGVVHTIKSLLDQSAKYCNMAQAKVVIHALQNENRIRESHTSGGDILFSLQDLQLGAIGDLNVIVPGRRRHLILGEQGSSLYCYKAVLLDSKNQTGAFVYHCGVFIVPKARAQEWLFASEEGQWHVVESAKAARLIMVFLDRRHMDSDIDVIKKDLSPLVKDLEPEYPEEADPIPFMMASDGVKQRDILHEVTSEITGPMVVEDVVYESVDGDQSCMSEKMFRRLVFKRSSGLVQSEALLIRESPSDETDNKNKKSSTASKKKRSHKKGLTGSKSSLRIDHSYLGSSYHSSIICGLSLIASALSNAASSGEKVSTTIVGLGAGCLPMFLRGCLPYLDIEVVELDPIIEEVAKKYFGFSMDEQLKVHLGDGIRFIEEKAILYQMAKTAMQLEFLLLMLIHLT

SEQ ID NO: 5819 - protein, 735 aa, Brachypodium distachyon
MATSPAAGAAILGTLNDFTSQKNWDKFFAIRGVGDSFEWYAEWPQIQAPLLSLLLEEEGADILVPGCGSSALSEQLYDLGFRRITNVDFSRVIVADMLRRHARVRPEMRWRVMDMTNMQFPDESFDFILDKGGLDALMEPEVGMELGMKYLNEAKRVLKSGGKFVCFTLAESHVLALLFSEFRFGWDMSIQAIAGEPSNKSAFQTFMVVMAKGKMGVVHTIKSLLDQSAKYCNMAQAKVVIHALQNENRIRESHTSGGDILFSLQDLQLGAIGDLNVIVPGRRRHLILGEQGSSLYCYKAVLLDSKNQTGAFVYHCGVFIVPKARAQEWLFASEEGQWHVVESAKAARLIMVFLDRRHMDSDIDVIKKDLSPLVKDLEPEYPEEADPIPFMMASDGVKQRDILHEVTSEITGPMVVEDVVYESVDGDQSCMSEKMFRRLVFKRSSGLVQSEALLIRESPSDETDNKNKKSSTASKKKRSHKKGLTGSKSSLRIDHSYLGSSYHSSIICGLSLIASALSNAASSGEKVSTTIVGLGAGCLPMFLRGCLPYLDIEVVELDPIIEEVAKKYFGFSMDEQLKVHLGDGIRFIEEKAVPDHSALTHSVPNGKDSNAVRILIVDVDSSDLSSGLSCPPANFVEDHFLTSAKKFLSAGGLFVINLVVRSSTVREMVVSRLKAVFEHLYSLQLEEDVNEVLFASSSERYLEIDHLDGAATKLKAMLKFPVDLESDIQNLQKLQ

SEQ ID NO: 5820 - protein, 646 aa, Hordeum vulgare
GCRDELGALWHDGSDDLSFGGGGGGGGYSHSPSPLKWRDIHHHHHSPVSVFQGPSSSPASRSPSSASWLTGRERDRLFSGFVRNALGSCIDYVPATSPRPEVGGGELAFELDENLAGASPACEPYAQELLAGAQARHRIFHEELVVKAFFEAEKAHHGQTRASGDPFLQHCVETAVLLAKIGASATVVSAGLLHDTIDDSFVDYDHIFHMFGAGVADLVEGVSKLSHLSKLARDNNTASRTAEADRLHTMLLAMADARAVLIKLADRVHNMRTLEALPLVKQQRFAKETMEIFVPLANRLGIASWKDQLENLCFKHLNPEEHKELSSKFAETFDEALITSAVDTLDEGLREAGISYHNLSGRNKNLYSVYSKMQKKNLTMDEVHDIHGLRLVVDKEEDCYRALDVVHKLWPQVDGRFKDYISRPKLNGYRSLHTVVMSDGDHTFEVQIRTKEMHLQAEYGFAAHWRYKEGSCRHSFVLQMVEWARWVLTWQCEALNKEHSSSQVKSDAIKPPCPFPLHSEECPYSYTRQCNHEGPLFVILLEHDKMSVQEFPAGSTVMDLMHRVGANSPRWSPYSIPMKEDLRPKVNHEPISDTGRALNMGDVVELTPALPDKSLTEYREEIQRMYDRGGFALAATRSSGGGGSRR

SEQ ID NO: 5821 - protein, 646 aa, Hordeum vulgare
GCRDELGALWHDGSDDLSFGGGGGGGGYSHSPSPLKWRDIHHHHHSPVSVFQGPSSSPASRSPSSASWLTGRERDRLFSGFVRNALGSCIDYVPATSPRPEVGGGELAFELDENLAGASPACEPYAQELLAGAQARHRIFHEELVVKAFFEAEKAHHGQTRASGDPFLQHCVETAVLLAKIGASATVVSAGLLHDTIDDSFVDYDHIFHMFGAGVADLVEGVSKLSHLSKLARDNNTASRTAEADRLHTMLLAMADARAVLIKLADRVHNMRTLEALPLVKQQRFAKETMEIFVPLANRLGIASWKDQLENLCFKHLNPEEHKELSSKFAETFDEALITSAVDTLDEGLREAGISYHNLSGRNKNLYSVYSKMQKKNLTMDEVHDIHGLRLVVDKEEDCYRALDVVHKLWPQVDGRFKDYISLPKLNGYRSLHTVVMSDGDHTFEVQIRTKEMHLQAEYGFAAHWRYKEGSCRHSFVLQMVEWARWVLTWQCEALNKEHSSSQVKSDAIKPPCPFPLHSEECPYSYTRQCNHEGPLFVILLEHDKMSVQEFPAGSTVMDLMHRVGANSPRWSPYSIPMKEDLRPKVNHEPISDTGRALNMGDVVELTPALPDKSLTEYREEIQRMYDRGGFALAATRSSGGGGSRR

SEQ ID NO: 5822 - protein, 708 aa, Brachypodium distachyon
MSLSAISLYTSPPGAVYSSEFDPSCRGSSPCTTATPPPPGTSHRPSAVAGGLSCLFSSPAAAAAPPRAPAHDELGALWHDGSDDLSFGGSYSHSSSPLKRRDLHHHHHHSPVSVFQGPSSSPASRSPPASWLTGRERERLFSGFVRNALGSCIDYVPATSPRPELGGGELAFELDENLPEASPACEPYARELLAGAQARHRIFHEELVVRAFFEAEKAHHGQTRASGDPFLQHCVETAVLLAKIGANSTVVSAGLLHDTIDDSFVDYDHIFHMFGAGVADLVEGVSKLSHLSKLARDNNTASRTAEADRLHTMLLAMADARAVLIKLADRVHNMKTLEALPLVKQQRFAKETMEIFVPLANRLGIASWKDQLENLCFKHLNPEEYTELSSKLTETFDEALITSAVDTLDEGLREAGVSYRNLSGRHKNLYSVYSKMLKKNLTMDEVHDIHGLRLVVDKEEDCYQALEVVHKLWPQVTGRFKDYISRPKLNGYRSLHTVVLSEGVHPFEVQIRTKEMHLQAEYGFAAHWRYKEGSCRHSFVLQMVEWARWVLTWQCEAMNKEHSSCQVNSDAIRPPCPFPLHSEECAYSYTRQCNHEGPLFVILLEHDKMSVQEFPAGSTVMDLMDRVGANSPRWSPYSVPMKEDLRPKVNHEPISNLRRPLGMGDVVELTPALPDKSLTEYREEIQRMYDCGGFALAATRGSRGGSRR

SEQ ID NO: 5823 - protein, 486 aa, Brachypodium distachyon
TRASGDPFLQHCVETAVLLAKIGANSTVVSAGLLHDTIDDSFVDYDHIFHMFGAGVADLVEGVSKLSHLSKLARDNNTASRTAEADRLHTMLLAMADARAVLIKLADRVHNMKTLEALPLVKQQRFAKETMEIFVPLANRLGIASWKDQLENLCFKHLNPEEYTELSSKLTETFDEALITSAVDTLDEGLREAGVSYRNLSGRHKNLYSVYSKMLKKNLTMDEVHDIHGLRLVVDKEEDCYQALEVVHKLWPQVTGRFKDYISRPKLNGYRSLHTVVLSEGVHPFEVQIRTKEMHLQAEYGFAAHWRYKEGSCRHSFVLQMVEWARWVLTWQCEAMNKEHSSCQVNSDAIRPPCPFPLHSEECAYSYTRQCNHEGPLFVILLEHDKMSVQEFPAGSTVMDLMDRVGANSPRWSPYSVPMKEDLRPKVNHEPISNLRRPLGMGDVVELTPALPDKSLTEYREEIQRMYDCGGFALAATRGSRGGSRR

SEQ ID NO: 5824 - protein, 229 aa, Oryza sativa
MSLPAISLYTSPPPGAVYSSEFDPSSRGSSPPCSTAPPSTSHRPPAAAGGLSCLFSSPAAAASPPRAPPHDELGALWQDRSDEPAFAGGGGGYSSSPLKWRDLHHHHHHSPVSVFQGPSSSPAASRSPPASWLAGRDRDRERLFAGFVRNALGSCVDYAPALSPRSEVGGGELAFELDENLAEASPACEPCARELLAGAQARHRIFHEELVVKTFFEAEKAHRGQLHNL

SEQ ID NO: 5825 - protein, 1121 aa, Sorghum bicolor
MSRNLWPVLLISICFLFCPVRIHGFSWNIFSSSSAPKDGDGALVMELEGAVADFALDGTNDPRGLKLLENARNKLAGPRNCWQEAYRKLFASCSEIMADKERQSRLAWHLSSCFQEDSGRPPFASCAEGSKMVHCRKRLSESEGKVFLEFFLETNTLCHQLQAEAFKHNTERLVNDLTRSSKLAEEKLEVIEERSDQIIKESSQVKDTLSSIEMQADKLSETSKHVDEQINDVLIHSKTIFEQSKEIATTQKELSKGQTELREKIEAGMTRVEESYERLGNGMEKIKEETGHMQREIKSVGESMSSKMLDLQRTADDIGSVASKSVENQKQLLHGQTRAMDGLNKLHSSQAKALEESRETIQKLAQFGQRQQEELLSRQEEIRKAHEHLILNSHSILEAQEEFRAKQANIFAALDKLYILHNAILAESRFIKAFFFYCCIVFLIYMLTSAKQTFGIRGQLYFGLCITLLLEIGLIKIGADDFDKQFWVMSKVFLVRMVFLGASTVQILHSIYTYRDYEVLNHGLLQTLVEKGPSSSSPSRSPPASWLAARDRDRLFAGFVRNALGSCVDYAPPSSPRPEVGAGELAFELDENLAEAGPACEPYARELLASAQDRHRIFHEELVVKAFLEAEKAHRGQTRASGEPYLQHCVETAVLLAKIGANATVVSAGLLHDTIDDSFIDYDHIFHMFGAGVADLVEGVSKLSHLSKLARDNNTASRTVEADRLHTMLLAMADARAVLIKLADRLHNMKTLEALSLVKQQRFAKETKEIFVPLANRLGIASWKDQLENLCFKYLNPEEYKELSSKLTESFDEELITSAVGKLDKGLRDAGVSYHNLSGRHKSLYSIHSKMLKKNLTMEEIHDIHGLRLVVDTVEDCYEALCVVHKLWPRVTGRFKDYISRPKLNGYRSLHTVVMSEGVHPFEVQIRTKEMHLQAEYGFAAHWRYKEGTCRHSFVLQMVEWARWVLTWQCEAMNKERTASLGNDDTVRPPCPFPLHSEECPYSYTRQCNHDGPLFVILLEHDKMSVQEFPANSTVMDLMDRVGANSSRWSPYSIPVKEDLRPRVNHEPICDPNRKLSMGDVVELTPALPRKSLSGYREEIQRMYDRGGFALSTRGGGSRRC

SEQ ID NO: 5826 - protein, 716 aa, Zea mays
MSLPAISMYTSPPGAVYSSEFDPASRGSSPCTTAAPPPPAASYRLPSGGGGLSCLFSSPAAAAAPPRAPAHDDLGALWHNRSDDLSVPADGGGYSYSHSHSSSQLKRRDLHHHHHSPVSVFQGPSTSSPSRSPPASWLAARDRDRLFAGFVRNALGSCVDYAPPTSPRPEVGASELAFELDENLAEASPACEPYAQELLASAQDRHRIFHEELVVKAFLEAEKAHRGQTRASGDPYLQHCVETAVLLAKIGANATVVSAGLLHDTIDDSFIDYDHIFHIFGAGVADLVEGVSKLSHLSKLARDNNTASRTVEADRLHTMLLAMADARAVLIKLADRLHNMKTLEALPWVKQQRFAKETREIFVPLANRLGIASWKEQLENLCFKYLNPEEHRELSSKLTESFDEELITSAVDKLDKGLRDAGVSYHNLSGRHKSVYSIHSKMLKKNLAMEEIHDIHGLRLVVDNEEDCYEALCVVHRLWPRVTGRFKDYISRPKLNGYRSLHTVVMGEGVHPLEVQIRTKEMHLQAEYGFAAHWRYKEGRTCRHSFVLQMVEWARWVLTWQCEAMDKERTASSLGSGDAASARPPCPFPLHSEDCPYSYTRQCNHDGPLFVILLEHDKMSVQEFPADSTVMDLMDRVGANSSRWSPYSIPVKEDLRPRVNREPICDPNRKLSMGDVVELTPALPRRSLSGYREEIQRMYDRGGFALSAQGGGSRRC

SEQ ID NO: 5827 - protein, 717 aa, Sorghum bicolor
MSVPAIAVYTSPPGAAVHAPPEHESSSRGSAPCAAAASPSAAPSSHRHAGGLSCLFSSPSAAPRSTAHEELGALWHDRSDEPPIVVVAGGFGGGGYSYPQSSSSPSPFKLRDHLHRSPVSLFHSPAASSPASRSPSVSWLAGRERDRLFSSFVRNALGSCIDFAPVTSLPLGVRPAATGVDAAELAFELDESLSEAEPCCEPDARELLARVQARHCIFRDELVVKAFFEAERAHRGQKRASGDPYLQHCVETAVHLANIGANATVVSAGLLHDTIDDSFMDYDHIFRMFGAGVADLVEGVSKLSHLSKLARDNNTASRTVEADRLHTMFLAMADARAVLIKLADRLHNMKTIEALPLVKQQRFAKETMEIFVPLANRLGIASWKDQLENICFKHLNPEEHKELSSKLVMSFDEALLTSTLDNLDKGLRDEGISYHSLSGRHKSLYSIYSKMIKKNLTMDDVHDIHGLRLVVDTEEDCYRALDIVHKLWPRVTGRFKDYISHPKLNGYRSLHTVIICEGVHPFEIQIRTKEMHLQAEYGFAAHWRYKEGGCRHSFVLQMVEWARWVLTWQCEAMSKERPSSLSSSVGMRPPCPFPLHSEDCPYSYSRQCNHEGPIFVIMLEHDKMSVQELPANSTVVDLMERVGANSPRWSPYSFPLKEELRPRVNHKPISDPNRKLSMGDVVELTPALPHKSLSEYREEIQRMYERGGFALATTPRS

SEQ ID NO: 5828 - protein, 715 aa, Sorghum bicolor
VPAIAVYTSPPGAAVHAPPEHESSSRGSAPCAAAASPSAAPSSHRHAGGLSCLFSSPSAAPRSTAHEELGALWHDRSDEPPIVVVAGGFGGGGYSYPQSSSSPSPFKLRDHLHRSPVSLFHSPAASSPASRSPSVSWLAGRERDRLFSSFVRNALGSCIDFAPVTSLPLGVRPAATGVDAAELAFELDESLSEAEPCCEPDARELLARVQARHCIFRDELVVKAFFEAERAHRGQKRASGDPYLQHCVETAVHLANIGANATVVSAGLLHDTIDDSFMDYDHIFRMFGAGVADLVEGVSKLSHLSKLARDNNTASRTVEADRLHTMFLAMADARAVLIKLADRLHNMKTIEALPLVKQQRFAKETMEIFVPLANRLGIASWKDQLENICFKHLNPEEHKELSSKLVMSFDEALLTSTLDNLDKGLRDEGISYHSLSGRHKSLYSIYSKMIKKNLTMDDVHDIHGLRLVVDTEEDCYRALDIVHKLWPRVTGRFKDYISHPKLNGYRSLHTVIICEGVHPFEIQIRTKEMHLQAEYGFAAHWRYKEGGCRHSFVLQMVEWARWVLTWQCEAMSKERPSSLSSSVGMRPPCPFPLHSEDCPYSYSRQCNHEGPIFVIMLEHDKMSVQELPANSTVVDLMERVGANSPRWSPYSFPLKEELRPRVNHKPISDPNRKLSMGDVVELTPALPHKSLSEYREEIQRMYERGGFALATTPRS

SEQ ID NO: 5829 - protein, 350 aa, Panicum virgatum
MEIFVPLANRLGIASWKDQLENICFKHLNPEEHKELSSKLVMSFDEALLTSTLDKLDKGLRDEGISYHSLSGRHKSLYSIYSKMIKKNLTMDDVHDIHGLRLVVETEQDCYRALDIVHKLWPRVTGRFKDYISHPKLNGYRSLHTVIMCEGVHPFEIQIRTKEMHLQAEYGFAAHWRYKEGGCRHSFVLQMVEWARWVLTWQCEAMSKERPSALASSVGVRPPCPFPLHSEDCPYSYSRQCNHEGPIFVIMLEHDKMSVQELPANSTVVDLMERVGANSPRWSPYSFPLKEELRPRVNHKPISDPNRKLSMGDVVELTPALPHKSLTEYREEIQRMYERGGFALATTPRR

SEQ ID NO: 5830 - protein, 711 aa, Zea mays
VPAIAVYTSPPGAVYAPPELESSSRGSAPCAAAASPSAPSSHRHAAVAGGLSCLFSSPSAAPRATAHEELGALWHDRSDEPPSVAGGFGGGGYSYPQSSPSPLKLRDHLHRSPVSLFHTPASSPASRSPSVSWLAGRERERLFSSFVRNALGSCIDYAPVTSFPLGVRPAATGVDAAELAFELDENLSEAEPSCEPDAHELLAGAQARHHIFRDELVVKAFKEAERAHRGQKRASGDPYLQHCVETAVHLANIGANATVVSAGLLHDTIDDSFMDYDHIFRMFGAGVADLVEGVSKLSHLSKLARDNNTASRTVEADRLHTMFLAMADARAVLIKLADRLHNMNTIEALPLVKQQRFAKETMEIFVPLANRLGIASWKDHLENICFKHLNPEEHKELSSKLLMSFDEALLTSTLHNLDKSLRDEGISYHSLSGRHKSLYSIYSKMIKKNLTMDDVHDIHGLRLVVETEEDCYRALDIVHKLWPRVTGRFKDYICHPKLNGYRSLHTVIMCEGVHPFEIQIRTKEMHLQAEYGFAAHWRYKEGGCRHSFVLQMVEWARWVLTWQCETLSKERPSSLSSSVGIRPPCPFPLHSEDCSYSYSRQCNYEGPIFVIMLEHDKMSVQELPANSTVVDLMERVGANSPRWSPCSFPLKEELRPRVNHKPISDPNRKLSMGDVVELTPALPDKSLSEYREEIQRMYERGGFALATTPRS

SEQ ID NO: 5831 - protein, 76 aa, Saccharum officinarum
MSSTAAVTTAPGSGGAKTSWPEVVGLSIEEAKKVILKDKPDADIVVLPVGSRVTDDFLPNRVRIFVDTVAETPRVG

SEQ ID NO: 5832 - protein, 76 aa, Saccharum officinarum
MSSTATAAAPECGGSAKTSWPEVVGLSVEEAKKVILKDKPDADIVVLPVGSIVTTDFVPNRVRIFVDIVAETPHVG

SEQ ID NO: 5833 - protein, 269 aa, Zea mays
MRKRERENPCGICGHYHKYEEGEVCGVCGHRWKPSDGEGAPSRHESAFPTEVLKDFLFLGSYDNASRSEVLRTLSISHILNTVPDCHNLYKNSFTYHSLQRDRPLDFDEANQYLEKCERDKSRVLVHCMTGKNRSAAIVAAFLMKSRGWRLAQSFQWVKDRRPQVQLTDASQKELLEYELKLFGPSTQTLVPTESFASLGFGYTKPAGDMQTPVFNQTTMPSIFERFNPNDRPTNFTFGVERKAEANPRDNNSDGRVNPTSTENLMDSS

SEQ ID NO: 5834 - protein, 217 aa, Saccharum officinarum
  misc_feature (176)..(176): Xaa can be any naturally occurring amino acid
MRKRERENPCGICGHYHKYEEGEVCGVCGHRWKPSDGEGAPTRHESAFPTEVLKDFLFLGSYDNASRSEVLRTLSITHILNTVPDCHNLYKNSFTYHSLQRDRPLDFDEANQYLEKCERDNSRVLVHCMTGKNRSAAIVAAFLMKSRGWRLAQSVQWVKDRRPQVQLTNASQNELXEYELKLFGPSAQPLVPTESFASLGFGYQKPAGDIQAPMFTK

SEQ ID NO: 5835 - protein, 270 aa, Panicum virgatum
MRKRERENPCGICGHYHKYEEGEVCGVCGHRWKPSDGEGTPAKHESAFPTEVLKDFLFLGSYNNASRSEVLKTLSVSHILNTVPDCQNLYKNSFTYHRLQRDRPLDFDDANQFLEQCERDKLRVLVHCMTGKNRSAAVVAAFLMKSRGWRLAQSFQWVKDRRQQVQLTDASQNVLLEYEQKLFGPSSQPVIPTESFVSLGFGYPKPAGDTQAPAFNQMTAPSIFQRVGPNVFPLNFAFGAEGTVGVNPDNNDNGGAKANPASTDNPMDSS

SEQ ID NO: 5836 - protein, 269 aa, Panicum virgatum
MRKRERENPCGICGHYHKFEEGEVCGVCGHRWKPSEGEGTPARHESAIPTEVLKDFLFLGSYDNAARSEVLKTLGISHILNTVPDCHNLYHNSFTYHSLPRDRPLDFDGAIRFLEQCERDKARVLVHCMTGKNRSAAIVAAFLMNSRAWRLAQSLQWVKGCRPQVQLTDASQDELLEYEQKLFGLGAQPVIPTESFASLGFGYTKPAGDTQAPTFNQMTVPSIFERVSPNDIPANFTFGARRMVEVNPQDSDNNGGTNPASTDNVMDSS

SEQ ID NO: 5837 - protein, 254 aa, Saccharum officinarum
MASLQVSGAGVGAAAFAAKGKASIGALRLPSTVTVGEVRPARRAFRGLVVRAATVVAPKYTTLKPLADRVLVKINSSEEKTTGGILLPTTAQSKPQGGEVVAVGEGRIIGDKKVDVSIQVGAQVVYSKYAGTEVELNDYNHLVLKEDDIIGILETDDVKDMKPLNDRVVIKVAEAEDKTPGGLLLTETTKEKPSIGTVVAVGPGSLDDEGKRSPLSVSAGSTVLYSKYAGSEFKGADGTNYIVLRVSDLMAVLS

SEQ ID NO: 5838 - protein, 254 aa, Zea mays
MASVQVSGAGVGAAAFSVKGKASTGALRLRSTLTFGEVCPARRAFRGLVVRAATVVAPKYTTLKPLADRVLVKINSSEEKTTGGILLPTTAQSRPQGGEVVAVGEGRIIGDKKVDVSIQVGAQVVYSKYAGTEVALNDHSHLVLKEDDVIGILETDDVKDMKPLNDRVLIKVAEAEDKTPGGLLLTETAKEKPSIGTVVAVGPGPLDEDGERLALSVSAGSTVLYSKYAGSEFKGADGTNYIVLRASDLMAVLS

SEQ ID NO: 5839 - protein, 254 aa, Panicum virgatum
MATVQLSSARVGAAAFAAKGKASLEPLRLPARVTVGEARPARRAFRGLVVRAATVVAPKYTTLKPLADRVLVKIKSSEEKTTGGILLPMTAQSRPQGGEVVAVGEGRTIGDKKVDISIQVGAQVIYSKYAGTEVELNDYNHLVLKEDDIIGILETDDVKDMKPLNDRVLIKVAEAEDKTPGGLLLTETTKEKPSIGTVEAVGPGPLDEEGNRIPLSVSAGSTVLYSKYAGSEFKVADGTNYIVLRVSDLMAVLS

SEQ ID NO: 5840 - protein, 254 aa, Panicum virgatum
MTTMQLSSARVGAAAFAAKGKASLEPLRLPATVTVGEARPARRAFRGLVVKAATVVAPKYTALKPLADRVLVKIKSSEEKTTGGILLPTTAQSRPQCGEVVAVGEGRAIGDKKVDIGIQVGAQIIYSKYAGTEVELNDYNHLVLKEDDIIGILETDDVKDMKPLNDRVLIKVAEAEDKTPGGLLLTETTKEKPSIGTVVSVGPGPLDEEGSRIPLSVSAGSTVLYSKYAGSEFKGADGTNYIVLRVSDLMAVLS

SEQ ID NO: 5841 - protein, 254 aa, Cenchrus ciliaris
  misc_feature (76)..(76): Xaa can be any naturally occurring amino acid
  misc_feature (110)..(110): Xaa can be any naturally occurring amino acid
  misc_feature (114)..(115): Xaa can be any naturally occurring amino acid
  misc_feature (117)..(117): Xaa can be any naturally occurring amino acid
  misc_feature (122)..(122): Xaa can be any naturally occurring amino acid
  misc_feature (124)..(124): Xaa can be any naturally occurring amino acid
  misc_feature (138)..(140): Xaa can be any naturally occurring amino acid
  misc_feature (146)..(146): Xaa can be any naturally occurring amino acid
  misc_feature (149)..(149): Xaa can be any naturally occurring amino acid
  misc_feature (151)..(151): Xaa can be any naturally occurring amino acid
  misc_feature (160)..(160): Xaa can be any naturally occurring amino acid
MASLQLSGAGLGAAAFSANGKASLEKLRLPAMVAVGETRPARRAFRGLVVRAATVVAPKYTTLKPLADRVLVKIKXSEEKTTGGILLPTTAQSRPQGGEVVAVGEGRTIXDKKXXVXIQVGXQXVYSKYAGTEVELNXXXHLVLKXDDXIXILETDDVKXMKPLNDRVLIKVAEAEEKTPGGLLLTQTTKEKPSIGTVIAVGPGPLDEEGNRSPLSVSAGSTVLYSKYAGSEFKGADGTNYVVLRLSNLMAVLS

SEQ ID NO: 5842 - protein, 253 aa, Brachypodium distachyon
MASVQLCGAAVAAASFSRKGAASLEVLRVPTPAAGGARPARRAFRGLVARAATVVAPKYTTLKPLADRLLVKIKSAEQKTTGGILLPSTAQSKPQGGEVVAIGEGRTIADNKVEVSIQVGAQVVYSKYAGTEVELNDSNHLILKEDDIIGILETDDVKDMKPLGDRVLIKVAVAEDKTPGGLLLTETAKEKPSIGTVVAVGPGPLDEQGKRIALPVSAGSSVLYSKYAGAEFKGADGTNYIVLRVSDLMAVLS

SEQ ID NO: 5843 - protein, 255 aa, Oryza sativa
MAPVQFSAAGVGAVAFATKGMASRDALRLPPPAAVRVLRQAPRPSRGLVVRAAAASVAPKYTTLKPLADRVLVKIKSAEQKTTGGILLPSAAQSKPQGGEVVAIGEGRTVGDNKVEVSIQVGSQVVYSKYAGTEVELNDSNHLILKEDDIIGILETDDAKDMKPLSDRVLIKVAEAEDKTPGGLLLTETTKEKPSIGTVVAVGPGPLDEEGKRIPLSVSAGSTVLYSKYAGSEFKGSDGTSYIVLRVSDLMAVLS

SEQ ID NO: 5844 - protein, 337 aa, Zea mays
MAPWAIAIHGGAGVDPNLPEHRQEEAKRVLARCLQVGVDLLRAGAQALDVVEAVVRELETDPFFNSGRGSALTRAGTVEMEASIMDGRGRRCGAVSGVSTVKNPVSLARRVMDNSPHSYLAFDGAEEFARAQGLETVDNSYFITDDNVGMLKLAKEAGSILFDYRIPLAGTDTCSALAGAADSNGGGVHKAGMVMNGLPISVYAPETVGCAVVDASGACAAATSTGGLMNKMAGRIGDSPLIGSGTYACGACAVSCTGEGEAIIRCTLARDVAAVMEYKGLPLQQAVDYCVKERLDQGFAGLIAVSGTGEVAYGFNCTGMFRGCATEDGFMEVGIWE

SEQ ID NO: 5845 - protein, 332 aa, Hordeum vulgare
ARWAIAIHGGAGVDPNLPEHRQEEAKRVLARCLQVGVDLLRAGATALDVVEAVVRELETDPCFNSGRGSALTRAGTVEMEASIMDGRGRRCGAVSGVSTVRNPVSLARRVMDKSPHSYLAFDGAEDFAREQGLEVVDNSYFITEENVGMLKLAKEANTILFDYRIPLAGADTCSAQAAATENHNNNGMVMNGLPISIYAPETVGCAVVDCNGFTAAATSTGGLMNKMTGRIGDSPLIGAGTYACGHCAVSCTGEGEAIIRSTLARDVAAVMEYKGLPLQEAVDFCVKERLDEGFAGLIAVSGTGEVAYGFNCTGMFRGCATEDGFMEVGIWE

SEQ ID NO: 5846 - protein, 334 aa, Hordeum vulgare
MARWAIAIHGGAGVDPNLPEHRQEEAKRVLARCLQVGVDLLRAGATALDVVEAVVRELETDPCFNSGRGSALTRAGTVEMEASIMDGRGRRCGAVSGVSTVRNPVSLARRVMDKSPHSYLAFQGAEDFARQQGLEVVDNSYFITEENIGMLKLAKEANSILFDYRIPLVGADTCSAQAAAAADNHNNNGMVMNGLPISIYAPETVGCAVVDCNGFTAAATSTGGLMNKMTGRIGDSPLIGAGTYACGHCAVSCTGEGEAIIRSTLARDVAAVMEYKGLPLQEAVDFCVKERLDEGFAGLIAVSGTGEVAYGFNCTGMFRGCATEDGFMEVGIWE

SEQ ID NO: 5847 - protein, 335 aa, Brachypodium distachyon
MARWAIAIHGGAGVDPNLPEHRQEEAKRVLARCLQLGVDLLRAGTPALDVVEAVVRELESDPCFNSGRGSALSRSGSVEMEASIMDGRGRRCGAVSGVSTVKNPVSLARRVMEKSPHSYLAFDGAEEFAREQGLEVVDNSYFITEENVGMLKLAKEANSILFDYRIPLTGADTCSALAAASEKNHGAGNGMVMNGLPISIYAPETVGCAVVDSTGACAAATSTGGLMNKMNGRIGDSPLIGSGTYACKACAVSCTGEGEAIIRSTLARDVAAVMEYKGLPLQEAVDYCVNERLDEGFAGLIAVSGTGEVAYGFNCTGMFRGCATEDGFMEVGIWE

SEQ ID NO: 5848 - protein, 333 aa, Triticum aestivum
MARWAIAIHGGAGVDPNLPEHRQEEAKRVLARCLQVGVDLLRAGATALDVVEAVVRELETDPCFNSGRGSALTRAGTVEMEASIMDGRGRRCGAVSGVSTVKNPVSLARRVMDKSPHSYLAFDGAEDFAREQGLEVVDNSYFITEENVGMLKLAKEANSILFDYRIPLAGTDTCSAQAAAVEGHGSNGMVMNGLPISIYAQETVGCAVVDSNGFTAAATSTGGLMNKMTGRIGDSPLIGAGTYACGHCAVSCTGEGEAIIRSTLARDVAAVMEYKGLPLQEAVDFCVKERLDEGFAGLIAVSGTGEVAYGFNCTGMFRGCATEDGFMEVGIWD

SEQ ID NO: 5849 - protein, 333 aa, Triticum aestivum
  misc_feature (102)..(102): Xaa can be any naturally occurring amino acid
  misc_feature (156)..(156): Xaa can be any naturally occurring amino acid
MARWAIAIHGGAGVDPNLPEHRQEEAKRVLARCLQVGVDLLRSGAAALDVVEAVVRELETDPCFNSGRGSALTRAGTVEMEASIMDGRGRRCGAVSGVSTVXNPVSLARRVMDKSPHSYLAFDGAEDFAREQGLEVVDNSYFITEENIGMLKLAKXANTILFDYRIPLAGADTCSALAAASEKNNSNGMVMNGLPISIYAPETVGCAVVDSNGFTAAATSTGGLMNKMTGRIGDSPLIGAGTYACGHCAVSCTGEGEAIIRSTLARDVAAVMEYKGLPLQEAVDFCVKERLDEGFAGLIAVSGTGEVAYGFNCTGMFRGCATEDGFMEVGIWE

SEQ ID NO: 5850 - protein, 333 aa, Triticum aestivum
  misc_feature (88)..(88): Xaa can be any naturally occurring amino acid
  misc_feature (148)..(148): Xaa can be any naturally occurring amino acid
  misc_feature (159)..(159): Xaa can be any naturally occurring amino acid
  misc_feature (186)..(186): Xaa can be any naturally occurring amino acid
MARWAIAIHGGAGVDPNLPEHRQEEAKRVLARCLQVGVDLLRSGAAALDVVEAVVRELETDPCFNSGRGSALTRAGTVEMEASIMDGXGRRCGAVSGVSTVRNPVSLARRVMDKSPHSYLAFDGAEDFAREQGLEVVDNSYFITEENXGMLKLAKEANXILFDYRIPLAGADTCSALAAATENLNXNGMVMNGLPISIYAPETVGCAVVDSNGFTAAATSTGGLMNKMTGRIGDSPLIGAGTYACGHCAVSCTGEGEAIIRSTLARDVAAVMEYKGLPLQEAVDFCVKERLDEGFAGLIAVSGTGEVAYGFNCTGMFRGCATEDGFMEVGIWE

SEQ ID NO: 5851 - protein, 331 aa, Avena sativa
MGRWAIAIHGGAGVDPNLPEYRQEEAKRVLARCLQVGVDLLRAGSPALDVVEAVVRELETDPCFNSGRGSALTRAGTVEMEASIMDGRGRRCGAVSGVSTVRNPVSLARRVMEKSPHSYLAFAGAEDFARDQGLEVVDNSYFITEENVGMLKLAKEANTILFDYRIPLEDTCSALAAASENHASNGMVMNGLPISIYAQETVGCAVVDSSGFTAAATSTGGLMNKMTGRIGDSPLIGAGTYACNLCAVSCTGEGEAIIRCTLARDVAAVMEYKGLPLQEAVDFCVKERLDEGFAGLIAVSGTGEVAYGFNCTGMFRGCATQDGFMEVGIWE

SEQ ID NO: 5852 - protein, 333 aa, Oryza sativa
MARWAIAIHGGAGVDPNLPEHRQEEAKRVLARCLQVGVDALRSGAAALDVVEAVVRELESDPFFNSGRGSALTRLGTVEMEASIMDGRGRRCGAVSGVSTVKNPVSLARLVMDKSPHSYLAFDGAEQFARDQGLEVVDNSYFITEDNVGMLKLAKEANSILFDYRIPLSGSETCGAQAVSSDNSHGNGMVMNGLPISIYAPETVGCAVVDSSGHTAAATSTGGLMNKMTGRIGDSPLIGSGTYACGACAVSCTGEGEAIIRSTLARDVAAVMEYRGAGLQEAVDYCVKKRLDEGFAGLIAVSSTGEVAYGFNCTGMFRGCATEDGFMEVGIWE

SEQ ID NO: 5853 - protein, 330 aa, Avena sativa
GRWAIAIHGGAGVDPNLPEYRQEEAKRVLARCLQVGVDLLRAGSPALDVVEAVVRELETDPCFNSGRGSALTCAGTVEMEASIMDGRGRRCGAVSGVSTVKNPVSLARRVMEKSPHSYLAFAGAEDFARDQGLEVMDNSYFITEENVGMLKLAKEANTILFDYRIPLEDTCSALAAASENHTSNGMVMNGLPISIYAQETVGCAVVDSNGFTAAATSTGGLMNKMTGRIGDSPLIGAGTYACNLCAVSCTGEGEAIIRSTLARDVAAVMEYKGLPLQEAVDFCVKERLDEGFAGLIAVSGTGEVAYGFNCTGMFRGCATEDGFMEVGIWE

SEQ ID NO: 5854 - protein, 316 aa, Hordeum vulgare
MARWAIAIHGGAGVDPNLPEHRQEEAKRVLARCLQVGVDLLRAGATALDVVEAVVRELETDPCFNSGRGSALTRAGTVEMEASIMDGRGRRCGAVSGVSTVRNPVSLARRVMDKSPHSYLAFDGAEDFAREQGLEVVDNSYFITEENVGMLKLAKEANTILFDYRIPLAGADTCSAQAAATENHNNNGMVMNGLPISIYAPETVGCAVVDCNGFTAAATSTGGLMNKMTGRIGDSPLIGAGTYACGHCAVSCTGEGEAIIRSTLARDVAAVMEYKGLPLQEAVDFCVKERLDEGFAGLIAVSGPARWHTGSTAPAC

SEQ ID NO: 5855 - protein, 375 aa, Saccharum officinarum
MALQVTGGVGCCCPRPLPGSGGRRLAQAAALCLPPRAVASGATTVVEEDEGKVRLGGSSVAVTKLGIGAWSWGDTTYWNDSEWDDRRLREAQDAFDASIDNGMTFFDTAEVYGTALMGAVNSESLLGGFIKDRQQKEQVEVAVATKFAALPWRFGRGSVLSALKKSLDRLGLSSVELYQLHWPGIWGNEGYLDGLADAYEQGLVKAVGVSNYNEKRLRDAHARLKKRGVPLAANQVNYSLIYRTPELNGVKAACDELGITLIAYSPIAQGVLTGKYTPEKPPTGPRANTYTPEFLTKLQPLMNRIKEIGASYGKSPTQVSLNWLTCQGNVVPIPGAKNASQAKEFAGALGWSLTGDEVEELRTLAREIKGIKMPI

SEQ ID NO: 5856 - protein, 374 aa, Zea mays
MALQVTGGVGCCCPPGSARRLPQAAALCRPPRAVVSGATRVVEEDEGKVRLGGSGVAVTKLGIGAWSWGDTTYWNDSEWDDRRLREAQDAFDASIDNGMTFFDTAEVYGTALMGAVNSETLLGGFIKERQQKDQIEVSVATKFAALPWRFGRGSVLSALKKSLDRLGLASVELYQLHWPGIWGNEGYLDGLADAYEQGLVKAVGVSNYNEKRLRDAHARLKKRGVPLAANQVNYSLIYRTPELNGVKAACDELGITLIAYSPIAQGVLTGKYTPENPPTGPRANTYTPEFLAKLQPLMNRIKEIGASYGKSPTQVSLNWLTCQGNVVPIPGAKNASQAKEFAGALGWSLTGDEVEELRTLAREIKGIRMPIEES

SEQ ID NO: 5857 - protein, 373 aa, Panicum virgatum
MALQVTGGVTCRCPPALPGGGGWRARCRPPRAVASGAAAAVEEGEGKVRLGESGVAVTKLGIGAWSWGDTTYWNDSEWDDRRLKEAQEAFDASIDNGMTFFDTAEVYGTALMGAVNSESLLGGFIKERQQKEQIEVAVATKFAALPWRFGRGSVLSALKKSLDRLGLSSVELYQLHWPGIWGNEAYLDGLADAYEQGLVKAVGVSNYNEKRLRDAHARLKKRGVPLAANQVNYSLIYRTPELNGVKAACDELGITLIAYSPIAQGVLTGKYTPENPPTGPRANTYTPEFLTKLQPLMSRIKEIGASYGKSPTQVSLNWLTCQGNVVPIPGAKNASQAKEFAGALGWSLTGDEVEELRTLAREIKGIKMPIEES

SEQ ID NO: 5858 - protein, 372 aa, Oryza sativa
MALQVVAGGGCCCQRPVLGAGRRRLAAARAVASDAAAAKVSEEEGKVRLGGSEVAVSKLGIGAWSWGDTTYWNDSEWDDRRLQEAKAAFDTSIDNGMTLFDTAEVYGTALMGAVNSESLLGGFIKERQEKEQIDVAVATKFAALPWRFGRGSVLSALKKSLDRLGLSSVELYQLHWPGLWGNEGYLDGLADAYEQGLVKAVGVSNYNEKRLRDAYARMKKRGVPLAANQVNYSLIYRTPELNGVKAACDELGITLIAYSPIAQGVLSGKYTPEKPPTGPRANTYTPEFLTKLQPLMNRIKEIGESYGKNPTQVSLNWLTCQGNVVPIPGAKNAGQAQEFAGALGWSLTGDEVEELRSLAREIKGIKMPIEES

SEQ ID NO: 5859 - protein, 374 aa, Triticum aestivum
MASLQVGAGRGVGCCFGPLDGRRQERRATAALRPPRAGAGAKVAEEDKVRLGESSVAVSKLGIGAWSWGDTTYWNDSEWDDRRLKEAKAAFDASIDNGMTFFDTAEVYGTALMGAVNSESLLGDFIRERQQKGAVEVTVATKFAALPWRFGRGSVLSALKKSLERLGLPSVELYQLHWPGLWGNEGYLDGLADAYEQGLVKAVGVSNYNEKRLRDAHARLKKRGVPLAVNQVNYSLIYRTPEENGVKAACDELGVTLIAYSPIAQGVLSGKYTPENPPTGPRGNTYTPEFLAKLQPLMNRIKEIGVSYGKKPTQVSLNWLTCQGNVVPIPGAKNAGQAMEFAGALGWSLTADEVEELRTLAREIKGIKMPIEES

SEQ ID NO: 5860 - protein, 377 aa, Leymus cinereus x Leymus triticoides
  misc_feature (46)..(46): Xaa can be any naturally occurring amino acid
  misc_feature (314)..(314): Xaa can be any naturally occurring amino acid
MASLQVGAGRGVGCCFGPLDGRRQERRAMAALRPPRAAAAGAGAKXAEEDKVRLGESSVAVSKLGIGAWSWGDTTYWNDSEWDDRRLKEAKAAFDASIDNGMTFFDTAEVYGTALMGAVNSESLLGDFIRERQQKGPVEVTVATKFAALPWRFGRGSVLSALKKSLERLGLPSVELYQLHWPGLWGNEGYLDGLADAYEQGLVKAVGVSNYNEKRLRDAHARLKKRGVPLAVNQVNYSLIYRTPEENGVKAACDELGVTLIAYSPIAQGVLSGKYTPENPPTGPRGNTYTPEFLTKLQPLMNKIKEIGVSYGKXPTQVSLNWLTCQGNVVPIPGAKNAGQAMEFAGALGWSLSADEVEELRTLAREIKGIKMPIEES

SEQ ID NO: 5861 - protein, 378 aa, Hordeum vulgare
MASLQVGAGRGVGCCFGPLDGRRQERRATVALRPPRAAAAAGAGAKVAEEDKVRLGESSVAVSKLGIGAWSWGDTTYWNDSEWDDRRLKEAKAAFDASIDSGMTFFDTAEVYGTALMGAVNSESLLGDFIRERQQKGAVDVTVATKFAALPWRFGRGSVLSALKKSLERLGLPSVELYQLHWPGLWGNEGYLDGLADAYEQGLVKAVGVSNYNEKRLRNAHARLKKRGVPLAVNQVNYSLIYRTPEENGVKAACDELGVTLIAYSPIAQGVLSGKYTPENPPTGPRGNTYTPEFLTKLQPLMNRIKEIGVSYGKNPTQVSLNWLTCQGNVVPIPGAKNAGQAMEFAGALGWSLTADEVEELRTLAREIKGIKMPIEES

SEQ ID NO: 5862 - protein, 374 aa, Triticum aestivum
MASLQVGAGRGVGCCFGPLDGRRQERRAMAALRPPRAGAGAKVAEGDKVRLGESSVAVSKLGIGAWSWGDTTYWNDSEWDDRRLKEAKAAFDASIDSGMTFFDTAEVYGTALMGAVNSESLLGDFIRERQQKGAVEVTVATKFAALPWRFGRGSVLSALKKSLERLGLPSVELYQLHWPGLWGNEGYLDGLADAYEQGLVKAVGVSNYNEKRLRDAHGRLKKRGVPLAVNQVNYSLIYRTPEENGVKAACDELGVTLIAYSPIAQGVLSGKYTPENPPTGPRGNTYTPEFLTKLQPLMNRIKEIGVSYGKNPTQVSLNWLTCQGNVVPIPGAKNAGQAMEFAGALGWSLTFDEVEELRTLAREIKGIKMPIEES

SEQ ID NO: 5863 - protein, 372 aa, Avena sativa
MASLQVAAGGGVGSCFGPLNGGRRRARRAVLRPPRASAAVAEDQEKVRLGESSVAVSKLGIGAWSWGDTTYWNDSEWDDRRLKEAKAAFDASVDSGMTFFDTAEVYGTALMGAVNSESLLGDFIRERKQQGPVDVTVATKFAALPWRFGRGSVLSALKKSLERLGLPSVELYQLHWPGLWGNEGYLDGLADAYDQGLVKAVGVSNYNEKRLRDAHARLKKRGVPLAVNQVNYSLIYRTPEENGVKAACDDLGVTLIAYSPIAQGVLSGKYTPENPPTGPRGNTYTPEFLTKLQPLMNRIKEIGASYGKNPTQVSLNWLTCQGNVVPIPGAKSAGQAMDFAGALGWSLTVDEVEELRTLAREIKGIKMPIEES

SEQ ID NO: 5864 - protein, 372 aa, Festuca arundinacea
  misc_feature (129)..(129): Xaa can be any naturally occurring amino acid
  misc_feature (132)..(132): Xaa can be any naturally occurring amino acid
  misc_feature (159)..(159): Xaa can be any naturally occurring amino acid
  misc_feature (161)..(161): Xaa can be any naturally occurring amino acid
MASLQVGAGGGVGFCFGPLDGGRRRARRAVLRPPRASATVAEDQEKVRLGESSVAVSKLGIGAWSWGDTTYWNDSEWDDRRLKEAKAAFDASVDSGMTFFDTAEVYGTALMGAVNSESLLGDFIRERKXQGXVDVTVATKFAALPWRFGRGSVLSALKXSXERLGLPSVELYQLHWPGLWGNEGYLDGLADAYDQGLVKAVGVSNYNEKRLRDAHARLKKRGVPLAVNQVNYSLIYRTPEENGVKAACDELGVTLIAYSPIAQGVLSGKYTPENPPTGPRGNTYTPEFLTKLQPLMNRIKEIGVSYGKNPTQVSLNWLTCQGNVVPIPGAKNAGQAMEFAGALGWSLTADEVEELRTLAREIKGIKMPIEES

SEQ ID NO: 5865 - protein, 372 aa, Brachypodium distachyon
MAAAWSMQVGGGCRCSFGGRRAASGKAVRRLPVIRASAAKVEEEEKVRLGESSVAVSKLGIGAWSWGDTTYWNDSEWDDRRLKEAKAAFDASVDNGMTFFDTAEVYGTALMGAVNSESLLGDFIRERKEKGEVDVVVATKFAALPWRFGRGSVLSALKNSLGRLGLPSVELYQLHWPGLWGNEGYLDGLADAYEQGLVKAVGVSNYNEKRLRDAHARLKKRRVPLAANQVNYSLIYRTPELNGVKQACDELGVTLIAYSPIAQGVLSGKYTPEKPPTGPRGNTYTPEFLTKLQPLMNRIKEIGASYGKNPTQVSLNWLACQGNVVPIPGAKNAVQAMEFAGALGWSLTADEVEELRTLAREIKGIKMPIEES

SEQ ID NO: 5866 - protein, 461 aa, Zea mays
MAGKKRKSGSEKPTKHRLPLGADADAVAEASKRRRSGATKQHQADEEASIPPSLSAKILREARKQQEEEMRADSSDEQRPSAVEATAGPSTSSSFPVPAADGENEGDDVDEFDGFDALSEYDGGEVEINEEDEKALAAFMSKDKAAERTLGDIILQKIREKDAEVATGEGRPRVKLDNSIIELYKEVGKFLSRYTSGKIPKAFKRIPSMECWADVVQLTEPENWSPNAVYQATRLFSSNMNTKNAERFYEAILLPRVRNDIRKNKRLHFALYQSLKKALYKPAAFNKGILLPLCRERNCTLREAVIIGSIIQKVSIPFLHASVALVKLAEMEYCGTTSYFIKLFLDKKYALPYRALDAVLAHFMRFVDDERIMPVIWHQSLLAFVERYKNELEKKDKEKLARLLDHQKHYLVTPEIRRELRGSCNRGEKDTNLHTLSPISVITKPIEEDKWDVPQVPMEED

SEQ ID NO: 5867 - protein, 299 aa, Panicum virgatum
MPRSQLKGRPRVKLDNSIIELYKEVGKFLSRYTSGKIPKAFKRIPSLECWAEVLQLTEPENWSPNAVYQATRLFSSNMNTKNAERFYEAILLPRVRNDIRQNKRLHFALYQSLKKSLYKPAAFNKGILLPLCRERNCTLREAVIIGSIIQKVSIPFLHASVALVKLAEMEYCGTTSYFIKLFLDKKYALPYRALDAVLAHFMRFLDDERIMPVIWHQSLLAFVERYKNELEKKDKEKLVRLLDHQKHYLVTPEIRRELRGSCNRGEKDNNMETSSPISVITKPIDEDKWDVPQVPMEED

SEQ ID NO: 5868 - protein, 460 aa, Oryza sativa
MAGKKRKSASSDKQPKQQQQRLPLGADADAVADAAKRRRSGASKKHQAEEEASIPSSLSAKILREALTQQQEESLADQRPAAAATAAPSPSFSFPVPKKDGEEDEDDDDVDEFDGFDAQSEYDGGVPEIDEEDEKALAAFMSKDTSSKRSLGDIILEKIREKDAEISTEGRTPVKLDSSIIELYKGVGEFLSRYTSGKIPKGFKRIPSLECWPDVLQLTEPENWSPNAVYQATRLFSSNMNAKNAVRFYEAILLPRVRNDIRKNKRLHFALYQSLKKCLYKPAAFFKGILLPLCQERNCTLREAVIIGSIISKVSIPPLHASAALMKLAEMEYCGTTSYFIKLFLDKKYALPYRVVDAVFAHFMRFIDEERVMPVIWHQSLLAFVERYKNELEKKDKEKLARLLDHQKHYLVTPEIRRELRMSCNRGEKDTIMSICSPVSVITKPIEEDRWNVPEVPMEE

SEQ ID NO: 5869 - protein, 206 aa, Zea mays
MFPCRPLAPPHLPRAPSLARLPLSSLRPPSSSLRVVRCMAKERRVRMVAKQIQRELADMLTRDPVLQRAVLPEAALGADRYLSSLTTIADVELSNDLQVCKVYVSVFGDERGKKVAIEGLKAKTKYVRSQIGRRMKLRLTPEIRFIEDESMERGSRILAILDKLKEEREQQEGKDGEEDDDSYISEEDDGDWDADEPDEEDIIYVK

SEQ ID NO: 5870 - protein, 202 aa, Panicum virgatum
MLPCRPLAPPPPPLPRALTFARLPPSSLRVVRCMAKERRVRMVAKQIQRELADMLTRDPVLQRAVLPEAALGADRYLSSLTTIADVELSNDLQVCKVYVSVFGDERGKKVAIDGLKAKTKYVRSQIGKRMKLRLTPEIRFIEDESMERGSRILAILDKLKEEREQQEGKDGEEDAEGSYISEEEDGDWDADEPDEEDIIYVK

SEQ ID NO: 5871 - protein, 209 aa, Oryza sativa
MFTCRPLVSPPLPRRLAVASPLAPARPPPSSASSLRVVRCMAKERRVRMVAKQIQRELADMLTRDPVLQRAVLPEAALGADQYLSSLTTIADVELSNDLQVCKVYVSVFGDERGKKVAIAGLKAKTKYVRSQIGKRMKLRLTPEIRFIEDESMERGSRILAILDKLKEEREQQEGNEEEEDGEGANLSEEEEGDWDADEPDEEDIIYVK

SEQ ID NO: 5872 - protein, 208 aa, Avena sativa
MFPCRPLVSPPLPRALAAAAPVSMRRLPSTALSLRVVRCMAKERRVRMVAKQIQRELADMLTRDPIMQRAVLPEAALGADRYLSSLTTIADVELSNDLQVCKVYVSVFGDERGKKVAMAGLKDKTKYVRSQIGKRMKLRLTPEIRFIEDESMERGSRILTILDKLKEEREQREGNDVEEDGEASDLVEEEDGDWDGDEPDEEDIIYVK

SEQ ID NO: 5873 - protein, 212 aa, Leymus cinereus x Leymus triticoides
MFPCRPLVSPPPPRALAAAAPVSVRRLPSSSSWSSMSLRVVRCMAKERRARMVAKQIQRELADMLTRDPVMQRAVLPEAALGADRYLSSLTTIADVELSNDLQVCKVYVSVFGDERGKKVAMAGLKDKTKYVRSQIGKRMKLRLTPEIRFIEDESMERGSRILTILDKLKEEREQREGNGEEEDGEASDIAEEEDGDWEGDEPDEEDIIYVK

SEQ ID NO: 5874 - protein, 244 aa, Triticum aestivum
RYCWILNTIPFPLPHSDGRRPHRGAKSPTTARMFPCRPLVSPPLPRALVAAAPVSVRRLPWPSSWSPTSLRVVRCMAKERRVRMVAKQIQRELADMLTRDPVMQRAVLPEAALGADRYLSSLTTIADVELSNDLQVCKVYVSVFGDERGKKVAMAGLKDKTKYVRSQIGKRMKLRLTPEIRFIEDESMERGSRILTILDKLKEEREQRDGNGEEEDGEASDMAEEEDGDWEGDEPDEEDIIYVK

SEQ ID NO: 5875 - protein, 205 aa, Brachypodium distachyon
MFPCRPLVSPPLPRALAVSVTVRRLPSSALSLRVVRCMAKERRVRMVAKQIQRELADMLTRDPIMLRAVLPEAALGADRYLSSLTTIADVELSNDLQVCKVYVSVFGDERGKKVAMAGLKDKTKYVRSQIGKRMKLRLTPEIRFIEDESMERGSRILTILDKLKEEREKQEGNDLEEDAETSDLGEEDGDWEGDEPDEEDIIYVK

SEQ ID NO: 5876 - protein, 235 aa, Triticum aestivum
IPFPLPHSDGRRPHHGAKSPTTPKPARMFPYRPLVSPPLPRALAAAAPVSVRRLPWASTSLRVVRCMAKERRVRMVAKQIQRELADMLTRDPVMQRAVLPEAALGADRYLSSLTTIADVELSNDLQVCKVYVSVFGDERGKKVAMAGLKDKTKYVRSQIGKRMKLRLTPEIRFIEDESMERGSRILTILDKLKEEREQREGNAEDEDGEVSDIAEEEDGDWEGDEPDEEDIIYVK

SEQ ID NO: 5877 - protein, 241 aa, Brachypodium distachyon
MARGKVQLRRIENPVHRQVTFCKRRAGLLKKARELSVLCDADIGIIVFSAHGKLYDLATTGTMDGLIERYKSASGGEGSMQADGFGDHRMDPKQEAMVLKQEIDLLQKGLRYIYGNRANEQMSVEELNSLERYLEIWMFNIRSAKMQIMIQEIQALKSKAIWILYYMQEDMLKAANEILQEKIVEQHGLVGHHGLIDVGMTIADQQNGHFSTDPLIEEITNPLTILSGYSTCRGSEMGYSF

SEQ ID NO: 5878 - protein, 914 aa, Sorghum bicolor
MSSGKAQQRPHAVLIPQPAQGHVTPMLHLAKALHARGFRVTYVNSEYNHRRLLRSRGQDSLAGTDGFRFEAVPDGLPQSDNDDVTQDIAALCLSTTEHSAAPFRDLLARLNATPGSPPVSCVIADGVMSFAQRVAEEMGILALVFWTTSACGFMGYLHFAELIRRAYVPLKDESDLSNGYLDTAIDWIPGMPGIRLKDIPSFIRTTDPDDVMLNFDGGEAQNARKARGVILNTYDALEQDVVDALRREFPRVYTVGPLATFANAAAGGGLDAIGGNLWKEDTSCLRWLDTQRPGSVVYVNFGSITVMTAAQLAEFAWGLASCGSPFLWVIRPDLVSGENAMLPEGFVTDTKERGILASWCPQELVLSHPSVGLFLTHCGWNSTLESICAGVPMLCWPFFAEQPTNCRYVCDKWGIGMEIDSDVRRQEVARLVREAMDGERGKAMRLKSMVWKEKARQAVDEGGSSRKNMDRMYNHRRLLRSRGADALDGLDDFRFETIPDGLPPSGNDDDDVTQDIPTLCESLLRNGAAPFRDLLTRLNRMPGRPPVTCVVLDNFMSFAQRVANEMGILAVVFCTMSACGFMGYLHYKELMDRGYVPLKDESYLTNGYLDTVLDWVPGMPGIRLRDIPSFIRTTDPDEFMVHFDSNEAQNAHRAQGVIFNTFDALEQDVVDAMRRIFPRVYTIGPLLTFAGTMARPDAAAISGSLWKEDLSCLRWLDARTGGSVVYVNFGSITVMTPAQLAEFAWGLARCGRPFLWVIRPDLVTGDKAMLPEEFYAETKERGLFLSWCPQEQVLSHPSTGLFLTHSGWNSTLESIRAGVPMICWPFFAEQVTNCRYACNNWGIGLEIDNNVTREEVARLIKEAMDGEKGKDMKAKATMWKEKAVAATEGGGTSSVNIERLVEFMLEGNVPTAAS

SEQ ID NO: 5879 - protein, 902 aa, Zea mays
KAQRRPHAVLIPQPAQGHVTPMLHLAKALHARGFRVTYVNSEYNHRRLLRSRGQDSLAGTDGFHFEAVPDGLPQSDNDDVTQDIAALCLSTTAHSAAPFRDLLARLNAMPGSPPVSCVIADGVMSFAQRVAEEMGILALVFWTTSACGFMGYLHFAELIRRGYVPLKDESDLTNGYLDTAIDWIPGMPDIRLKDIPSFIRTTDRDDVMLNFDGGEAQNARRARGVILNTYDALEQDVVDALRREFPRVYTVGPLAAFANAAAGGELDAIGGNLWKEDTSYLRWLDTQRPGSVVYVNFGSITVMTAAQLAEFAWGLAGCGRPFLWVIRPDLVSGETAMLPEGFVTDTKGRGILASWCPQELVLSHPSVGLFLTHCGWNSTLESVCAGVPMLCWPFFAEQPTNCRYVCDKWGIGMEIDNDVRREEVARLVREAIDGEWGKAMRVKSIVWKEKARQAVEDGGSSRKNLDRLYNHRRLLRSRGADSLAGLDDFRFETIPDGLPPSGSDDDVTQDIPALCESLSRSGAAPFRDLLARLNGMPGRPPVTCVVLDNFMSFAQRVASEMGILAVVFCTMSACGFMGYLHFKELMDRGYVPLKDESYLTNGYLDTVLDWVPGMRGIRLRDMPSFIRTTDPDEFMVHFDSGEAQNARRAQGIIVNTFDALEQDVVGALRGVFPRVYTIGPLLTFARDMVRPDASAICGNLWKEDPSCLGWLDAQGPGSVVYVNFGSITVMTPAQLAEFAWGLANCGRPFLWVIRPDLVTGEKAMLPEEFYAETRERGLFLSWCPQEQVLSHPSTGLFLTHSGWNSTLESIRAGVPMICWPFFAEQTTNCRYACANWGIGLEIDNNVTRDEVARLIEEAMDGEKGKDMKAKATVWKEKAVAATESGGTSSVSIDRLVEFLLEG

SEQ ID NO: 5880 - protein, 482 aa, Oryza sativa
MSSCEARRAHAVLIPQPAQGHVTPMLHLAKALHARGFFVTYVNSEYNHRRLLRSSGPGALAGAAGFRFEAVPDGMPESGNDDVTQDIAALCVSTTRHSAEPFRELLVRLNSTPGTPPVSCVIADGVMSFAQRVAEEMGILALVFWTTSACGFMGYLHFAELIRRGYVPLKDESDLTNGYLDTPIDWIPGMRGIRLKDVPSFIRTTDPDDVMLNFDGGEAQNARKARGLILNTYDALEQDVVDALRREFPRVYTVGPLPAFAKAAAGEVGAIGGNLWKEDTGCLRWLDAQQPGSVVYVNFGSITVMSPAHLAEFAWGLACCGRPFLWVIRPDLVSGEKAMLPEEFVGETKERGVLASWCPQELVLSHPSVGLFLTHCGWNSTLESICAGVPMICWPFFAEQPTNCRYVCDKWGVGMEIDSNVSRTEVARLVREAMEGERGKAMRVNAMVWKEKAKEATEEGGSSSRNLDRLIEFLHSSGSDAR

SEQ ID NO: 5881 - protein, 602 aa, Zea mays
MQRLLALVAALLVLLASRPALATDPYAFFDWDVSYVTAAPLGVKQQVIGINGKFPGPVVNVSTNWNVVVNVLNDLDEPLLITWNGIQHRKNCWQDGVLGTNCPIPPGWNWTYEFQVKDQIGSFFYFPSTGLQRAAGGFGGIVVNNRDVIAVPFARPDGDITIFIGDWYNKNHTDLRKMLDKGKDLGIPDGVLINGKGPYRYNDSLVPPGIEYETFNVHPGRTYRIRVHNVGTSTSLNFRIQGHSMVLVETEGSYTSQQNYTSLDVHVGQSYSFLVATDQNASSDYYVVASARQVNGSQPLWRRVTGVAVLRYSTSGGPASGALPDPPQDQDDRAFSMNQARSVRWNLSAGAARPNPQGSFRYSAISVTQAYLLRGAGPVWIGGRRRAALNGLSYAPPETPLRLADAYGVEGVYTLDFPERPPLRGAAPRIARSVINGTYRGFMELIFQNNDTRMQSYHMDGYAFFVVGMDYGEWTEDSRGTYNKGDGVARSTIQVYPGAWAAVLVSLDNVGVWNVRSQNLDSWYLGQEVYVRVVNPEDTGNKTEMAIPANALYCGQLHKYQKEQTPHHKMGASAAAPRSSVSLARRLLATALLLAGSFVFAP

SEQ ID NO: 5882 - protein, 576 aa, Oryza sativa
MWRALAAAAAAVAVAVVVAARPAAATDPYAFFDWDVGYVTAAPLGVKQQAKLASIILLGVIGINGKFPGPTVNISTNWNVVVNVLNDLDEPLLITWNGIQHRKNCWQDGVLGTNCPIPSGWNWTYEFQVKDQIGSFFYFPSTGLQRAAGGYGGVVVNNRDVIAVPFGRPDGDITIFIGDWYNKNHTDLRKMLDSGKDLGMPDGVLINGKGPYRYNDSLVPAGIEYETINVDPGKTYRIRVHNVGTSTSLNFRIQGHNMVLVETEGSYTTQQNYTNLDVHVGQSYSFLVTTDQNASSDYYVVASARMDQFDKSFSMNQARSVRWNLSAGAARPNPQGSFRYSSINVTQAYLLRSTAPVTINGRRRATLNGLSFTPPETPLRLADAYGVRGVYSLDFPERPLRGAPRMGRSIINGTYRGFMELIFQNNDTRMQSYHMDGYAFFVVGMDYGEWTEDSRGTYNKGDGVARSTVQVYPGAWAAVLVSLDNVGVWNVRSENLDSWYLGQEVYVRVVNPEDTGNKTEMAIPDNALFCGQLHKYQKQQTPHHKMGTSAAAAAVVGSRVAAAAMLLLAGAVMISP

SEQ ID NO: 5883 - protein, 82 aa, Saccharum officinarum
MSSMAATAPDCGGTKTSWPEVVGKSVEEAKKVILKDKPDADIVVLPVGSIVTTDFVPNRVRIFVDIVAERHPTSADKRLADA

SEQ ID NO: 5884 - protein, 74 aa, Sorghum bicolor
MSSTATAAPECGGAKTSWPEVVGKSVEEAKKVILKDKPDADIVVLPVGSPVTMDYRTNRVRIFVDTVAQTPHVG

SEQ ID NO: 5885 - protein, 74 aa, Triticum aestivum
MSSTAAAAPECGGAKTSWPEVVGKSVEEAKKVILKDKPDADIVVLPVGSPVTMDYRTNRVRIFVDTVAQTPHVG

SEQ ID NO: 5886 - protein, 74 aa, Panicum virgatum
MSSSAEAADQCGGGKTSWPEVVGMSIEEAKKVILKDKPDADIHVLPVGTPVTRDFRPNRVRIFVGTVAQTPHVG

SEQ ID NO: 5887 - protein, 73 aa, Saccharum officinarum
MTSTATAPECGSAKTSWPEVVGLTIEEAKKVILKDKPDADIVVLPVGSIVTADYRPDRVRIFVDTVAQTPHVG

SEQ ID NO: 5888 - protein, 81 aa, Saccharum officinarum
MSSTATAAPECGGAKTSWPEVVGQNVEEAKKVILKDKPDADIVVLPVGSPVTMDYRTDRVPRLRRHRRPDAPCRLIKAIAI

SEQ ID NO: 5889 - protein, 74 aa, Saccharum officinarum
MSSTATAAPECDGPKTSWPEVVGLSVEEAKKVILKDKPDADIVVLPTGSPVTMDYRPNRVRIFVDTVAQTPYVG

SEQ ID NO: 5890 - protein, 73 aa, Zea mays
MSSTECGGGGGGAKTSWPEVVGLSVEDAKKVILKDKPDADIVVLPVGSVVTADYRPNRVRIFVDIVAQTPHIG

SEQ ID NO: 5891 - protein, 72 aa, Saccharum officinarum
MSSSAEAERGGAKKSWPEVVGLSVEEAKKVILKDKPDADIFVLPVGSSVTADFRPNRVRIFVDTVAETPRVG

SEQ ID NO: 5892 - protein, 75 aa, Saccharum officinarum
MRCTATAAAPECGDAKTSWPEVVGLSVEEAKKVILKDKPDADIVVVPVGSSVTTDFVLNRVRIFVDIVAQTPRVG

SEQ ID NO: 5893 - protein, 320 aa, Zea mays
MEYRDKLVLAPMVRVGTLPFRLLAAEYGADITYGEEIIDHKFLKCERVTNESLGTTDFVEKGTDSVVFRTCPQERGRVVFQMGTSNAVRALKAAQIVCRDVSAIDINMGCPKSFSLSGGMGAALLSKPELIHDILTTLRRNLDTTVTCKIRLLNTPKDTVELARRIEKTGVPALAVHGRKIKDRPRDLAKWDEIADVVSALSIPVIANGDVFEYEDFKRIKDATGAASVMVARGAMWNASIFCAKGKTPWEDVKREYVRKSILWDNDVKSTKHTLKEMIMHYSCLELPEGKGVIKCDTSEDLARLYGEEDYYNFVVANRK

SEQ ID NO: 5894 - protein, 320 aa, Panicum virgatum
  misc_feature (93)..(93): Xaa can be any naturally occurring amino acid
MEYRDKLVLAPMVRVGTLPFRLLAAEYGADITYGEEIIDHKFLKCERVINESLGTTDFVEKGTDNVVFRTCPQERGRVVFQMGTSHAVRALKXAEIVCHDVAAIDINMGCPKSFSLSGGMGAALLSKPELIHDILTTLRRNLDTTVTCKIRLLNTPKDTVELARRIEKTGVPALAVHGRKIKDRPRDPAKWDEIADVVSALSIPVIANGDVFEYEDFKRIKDATGAASVMVARGAMWNASIFCAKGKTPWEEVKREYVRKSILWDNDVKSTKHTLKEMIMHYSCLELPEGKGVIKCDTSADLARLYGEEDYYNFVVSNRK

SEQ ID NO: 5895 - protein, 319 aa, Oryza sativa
MEYRDKLVLAPMVRVGTLPFRLLAAEYGADITYGEEIIDHKFLKCERVTNESLGTTDFLERGTDTVVFRTCPQERDRVVFQMGTSDAVRALKAAQLVCNDVAAIDINMGCPKSFSLSGGMGAALLSKPELIHDILTTLRRNLDTTVTCKIRLLNTRQDTVELARRVEKIGVPALAVHGRKVKDRPRDPAKWDEIADVVSALSIPVIANGDVFEYEDFKRIKDATGAASVMVARGAMWNASIFCPKGKTPWEDVKREYVRKSILWDNDLKSTKQTIKEMIMHYSCLEFPEGKGVNKCDTIADLAKLYGEEYYNFVLSNRN

SEQ ID NO: 5896 - protein, 320 aa, Brachypodium distachyon
MEYRNKLVLAPMVRVGTLPFRLLAAEYGADITYGEEIVDHKFLKCERVANESLGTTDFLERGTDNLVFRTCPQERDRVVFQMGTSDAVRALKAAQIVCNDVAAIDINMGCPKSFSVSGGMGAALLSKPELIHDILTTLRRNLDTTLTCKIRLLNTRQDTVELARRIEKTGVPALAVHGRKVKDRPRDPSKWDEIADVVSALSIPVIANGDVFEYDDFKRIKDATGATSVMAARGALWNASIFCAKGTTPWEEVKREYIRKSILWDNDVKSTKHTLKEMIMRYSCLELAEGKGVIKCDSSADIAKLYKEEDYYNFVVSNRK

SEQ ID NO: 5897 - protein, 320 aa, Hordeum vulgare
MDYRNKLVLAPMVRAGTLPFRLLAAEYGADITYGEEIIDHKFVHCQRVTNESLGTTDFLERGTDSVVFRTCPQERDRVVFQMGTSDAVRALKAAEIVCNDVAAIDINMGCPKAFSVSGGMGSALLSKPELIHDILTTLRRNLNTPVTCKIRLLNTRQDTVELARRIEKCGVPALAVHGRKVKDRPRDPAKWDEIADVVSALSIPVIANGDVFEYEDFKRIKDATGATSVMAARGALWNASIFSPNGKVPWEDFKREYVRKTILWDNCIKSTKTTLREIIMHYICLELPEGKGVIKCGSSADVARLYGEEDYYNFVVSNRK

SEQ ID NO: 5898 - protein, 320 aa, Triticum aestivum
MEYRNKMVLAPMVRAGTLPFRLLAAEYGADITYGEEIIDHKFVNCQRVINESLGTTDFVERGTDSVVFRTCPQERDKVVFQIGTSDAVRALKAAELVCNDIAAIDINMGCPKAFSVSGGMGSALLSKPELIHDILTTLRRNLNTPVTCKIRLLNTRQDTVELARRIEKCGVPALAVHGRKVKDRPRDPAKWDEIADVVSALSIPVIANGNVFEYEDFKRIKDATGATSVMAARGALWNASIFSAKGKVPWEDFKTEYVRKTILWDNDIKSTKTTLREIIMHYICLEGTEGKGVIKCGLSADVARLYGEEDYYNFVVSNRK

SEQ ID NO: 5899 - protein, 330 aa, Ricinus communis
MEYENKLVLAPMVRVGTLPFRLLAAEYGADITYGEEIIDHKLLKCERKVNEYIGCTDFVEKGTENVVFRTCNEEKNRVVFQMGTSDAVRALTAAQMVCKDVAAIDINMGCPKSFSISGGMGAALLTKPELIHDILTTLKRNLDSPVTCKIRLLKSPQDTVELARRIEKTGVSALAVHGRKVADRPRDPAKWSEIADIVSTLSIPVIANGDVFDYGDFERIKAATGASSVMVARGALWNASIFSPKGKVHWEDVKREYVRKSILWDNDVKSTKHTLKEMIMHYSCLELPEGKGVIKSETLADIAKFYGEERYYQLVNEKRLGLDGSIEKFL

SEQ ID NO: 5900 - protein, 326 aa, Coffea canephora
MDYRDKLVLAPMVRVGTLPFRLLAAEYGADITYGEEIIDHKLLKCERRINDVLRCTDIVEKGTESVVFRTCPEERNKVVFQMGTSDAVRALKAAQLVCKDVAAVDINMGCPKSFSLSGGMGAALLSKPELIQDILTTLKRNLHTPVTCKIRLLKSSRDTVELAQRIEKTGVSALAVHGRRVADRPRDPAKWNEIADVVAALSIPVIANGDVFEFEDFERMKVATGASCVMVARGALWNASIFSPTGKLPWEDVKREYIRKSILWDNDIKSTKQTLKEMIMHYSCLEFPEGKAVTKAETLADLAQLYGQEQYYEYVKLNQLSSTRSR

SEQ ID NO: 5901 - protein, 325 aa, Solanum lycopersicum
MDYRNKLVLAPMVRVGTLPFRLLAAQYGADITYGEEIIDHKIIKCERRVNDVLGTTDIVEKGTDNVVFRTCPEERNRVVFQMGTSDAMRALKAAEIVCKDVAAVDVNMGCPKSFSISGGMGAALLSKPELIHDILTTLRRNLDVPITCKIRLLKDPQDTVELARRIEMTGVSALAVHGRKVPDRPRDPAKWNEIADVAAALSIPVIANGDVFEYEDFQRIRNVTGASSVMVARGAMWNASIFSSEGKTPWEDVKREYVRKSILWDNDIKSTKHTLKEMITHYSSLGSPEGLAVIKSDTFADVAKLYGEEEYYEYVSESRRKQQMK

SEQ ID NO: 5902 - protein, 325 aa, Manihot esculenta
MDYQNKLVLAPMVRVGTLPFRLLAAEYGADITYGEEIIDHKMVKCERKVNEYIGCTDFVEKGTENVVFRTCYEERNRVIFQIGTSDAVRALTAAQIVCKDVAAIDVNMGCPKSFSISGGMGAALLNKPELIHDILTTLKRNLSCPVTCKIRLLKSSQDTVELARRIEKTGVSALAVHGRKVADRPRDPAKWSEIADVVSALSIPVIANGDVFDYGDFARIKAATGASSVMVARGALWNASVFSPEGKVHWEEVKREYVRKSILWDNDIKSTKHTLKEMIMHYSCLELPEGKGVIKSENLADIAKLYGEERYYQFVNENRFSSNGS

SEQ ID NO: 5903 - protein, 324 aa, Solanum phureja
MDYRNKLVLAPMVRVGTLPFRLLAAQYGADITYGEEIIDHKIIKCERRVNDVLGTTDIVEKGTDNVVFRTCPEERNRVVFQMGTSDAMRALKAAEIVCKDVAAVDVNMGCPKSFSISGGMGAALLSKPELIHDILTTLRRNLDVPITCKIRLLKDPQDTVELARRIEMTGVSALAVHGRKVPDRPRDPAKWNEIADVAAALSIPVIANGDVFEYEDFQRVRNVTGASSVMVARGAIWNASIFSSEGKIPWEDVKREYVRKSILWDNDIKSTKHTLKEMITHYSSLGRPEGLAVIKSDTLADLAKLYGEEEYYEYVSESRRKQIT

SEQ ID NO: 5904 - protein, 132 aa, Solanum tuberosum
MDYRNKLVLAPMVRVGTLPFRLLAAQYGADITYGEEIIDHKIIKCERRVNDVLGTTDIVEKGTDNVVFRTCPEERNRVVFQMGTSDAMRALKAAEIVCKDVAAVDVNMGCPKSFSISGGMGAALVEQTRAHP

SEQ ID NO: 5905 - protein, 716 aa, Saccharum officinarum
MENADSARAFVKDVKRIIIKVGTAVVTGQNGRLAMGRLGSLCEQVKQLNFQGYEVILVTSGAVGVGRQRLQYRKLIHSSFADLQNPQMNFDGKACAAVGQSGLMAIYDTLFSQLDVTSSQLLVTDRDFKDPSFGDQLRETVFSLLNLKVIPLFNENDAISTRRQPYEDSSGIFWDNDSLAALLAAELNADLLIMLSDVEGLYSGPPSDPQSKIIHTYVNEKHGKLISFGEKSNVGRGGMQAKVAAAANAASKGVPVVIASGFATDSIIKVLKGEKIGTLFHNEANLWECSKEATAREMAVAARDCSRRLQKLSSEERKKILLDIADALEANEDAIRSENEADVEAAQAAGYEKSLVARMTLKPGKITNLARSIRAIADMEDPISHTLKRTEVAKDLVFEKAYCPLGVLLIIFESRPDALVQIASLAIRSGNGLLLKGGKEAMRSNTILHKVITGVIPDIVGKKLIGHVTSKDEIADLLALDDVIDLVIPRGSKNLVSQIKATTKIPVLGHADGICHVYIDKSADMDMAKRIVLDAKVDYPAACNAMETLLVHKDLNKSEGLDDLLVELEKEGVVIYGGPVAHDKLKVPKVDSFRHEYSSMACTLEFVDDVQSAIDHINRYGSAHTDCIITTDESAAEAFLQQVDSAAVFHNASTRFCDGTRFGLGAEVGISTGRIHARGPVGVDGLLTTRCILRGSGQVVNGDKGVVYTHKDLPLQ

SEQ ID NO: 5906 - protein, 716 aa, Saccharum officinarum
  misc_feature (530)..(530): Xaa can be any naturally occurring amino acid
MENADSARAFVKDVKRIIIKVGTAVVTGQNGRLAMGRLGSLCEQVKQLNFQGYEVILVTSGAVGVGRQRLQYRKLIHSSFADLQNPQMNFDGKACAAVGQSGLMAIYDTLFSQLDVTSSQLLVTDRDFKDPSFGDQLRETVFSLLNLKVIPLFNENDAISTRRQPYEDSSGIFWDNDSLAALLAAELNADLLIMLSDVEGLYSGPPSDPQSKIIHTYVNEKHGKLISFGEKSNVGRGGMQAKVAAAANAASKGVPVVIASGFATDSIIKVLKGEKIGTLFHNEANLWECSKEATAREMAVAARDCSRRLQKLSSEERKKILLDIADALEANEDAIRSENEADVEAAQAAGYEKSLVARMTLKPGKITNLARSIRAIADMEDPISHTLKRTEVAKDLVFEKAYCPLGVLLIIFESRPDALVQIASLAIRSGNGLLLKGGKEAMRSNTILHKVITGVIPDIVGKKLIGHVTSKDEIADLLALDDVIDLVIPRGSKNLVSQIKATTKIPVLGHADGICHVYIDKSADMDMAKXIVLDAKVDYPAACNAMETLLVHKDLNKSEGLDDLLVELEKEGVVIYGGPVAHDKLKVPKVDSFRHEYSSMACTLEFVDDVQSAIDHINRYGSAHTDCIITTDESAAEAFLQQVDSAAVFHNASTRFCDGTRFGLGAEVGISTGRIHARGPVGVDGLLTTRCILRGSGQVVNGDKGVVYTHKDLPLQ

SEQ ID NO: 5907 - protein, 716 aa, Zea mays
METADPARAFVKDVKRIIIKVGTAVVTGMNGRLAMGRLGSLCEQVKQLNFQGYEVILVTSGAVGVGRQRLQYRKLIHSSFADLQNPQMNFDGKACAAVGQSVLMAIYDTLFSQLDVTSSQLLVTDRDFKDPSFGDQLRETVFSLLDLKVVPLFNENDAISTRRQPYEDSSGIFWDNDSLAALLAAELNADLLIMLSDVEGLYSGPPSDPQSKIIHTYVNEKHGKLISFGEKSSVGRGGMQAKVTAAANAASKGVPVVIASGFATDSIITVLKGEKIGTLFHNEANLWACSKEATAREMAVAARDCSRRLQKLSSEERKQILLDIADALEANEDAIRSENDADVEAAQVAGYEKSLVARMTLKPGKITNLARSIRKTADMEDPISHTLKRTEVAKDLVFEKAYCPLGVLLIIFESRPDALVQIASLAIRSGNGLLLKGGKEVMRSNAILHKVITGVIPDTVGKKLIGLVTSKEEIADLLALDDVIDLVIPRGSKSLVSQIKATTKIPVLGHADGICHVYIDKSADMDMAKRIVLDAKIDYPAACNAMETLLVHKDLNKSEGLDDLLVELEKEGVVIYGGPVAHDKLKVPKVDSFRHEYSSMACTVEFVDDVQSAIDHINRYGSAHTDCIITTDRSAAEAFLQQVDSAAVFHNASTRFCDGTRFGLGAEVGISTERIHARGPVGVDGLLTTRCILRGSGQVVNGDKGVVYTHKDLPLQ

SEQ ID NO: 5908 - protein, 716 aa, Panicum virgatum
METADSTRAFVKDVKRIIIKVGTAVVTGQNGRLAMGRLGSLCEQVKQLNFQGYEVILVTSGAVGVGRQRLQYRKLIHSSFADLQNPQMDFDGKACAAVGQSGLMAIYDTLFSQLDVTSSQLLVTDRDFKDPSFGDQLRETVFALLDLKVIPLFNENDAISTRRQPYEDPSGIFWDNDSLAALLAAELSADILIMLSDVEGLYSGPPSDPQSKIIHTYVNEKHGKLISFGEKSCVGRGGMQAKVVAAVNAASKGVPVVIASGFATDSIIKVLKGEKIGTLFHNEANSWECTKEATAREMAVAARDCSRWLQKLSSEERKKILLDIADALEANEDAIRRENEADVEAAQDAGYEKSLVARMTLKPGKITNLARSIRAIADMEDPISHTLKRTEVAKDLVFEKAYCPLGVLLIIFESRPDALVQIASLAIRSGNGLLLKGGKEAMRSNAILHKVITGAIPDSVGKKLIGLVTTKDEIADLLALDDVIDLVIPRGSKNLVSQIKATTKIPVLGHADGICHVYIDKSADMDMAKRIVLDAKVDYPAACNAMETLLVHKDLNKTEGLDDLLVELEKEGVVIYGGPVAHDKLKVPKVESFRHEYSSMACTLEFVDDVHSAIDHINRYGSAHTDCIITTDEKAAEAFLQQVESAAVFHNASTRFCDGTRFGLGAEVGISTGRIHARGPVGVDGLLTTRCILRGSGQVVNGDKGVVYTHRDLPLQ

SEQ ID NO: 5909 - protein, 730 aa, Hordeum vulgare
MGRGGIGGAVAAADLENSDSTRCFVRDVKRIVVKVGTAVVTGQNGRLAMGRLGALCEQVKELNFQGYEVILVTSGAVGVGRQRLKYRKLINSSFADLQNPQLDLDGKACAAVGQSGLMAIYDTLFSQLDVTSSQLLVTDRDFRDPSFGHQLRETVVSLLDLKVIPVFNENDAISTRRAPYEDSSGIFWDNDSLATLLAKELDADLLIMLSDVEGLYSGPPSDPQSKIIHTYINEKHGKLINFGEKSRVGRGGMQAKVAAAVTAASKGVPAVIASGFVTDSIIKIMRGEKIGTLFHNEANVWDCTKEVTTREMAVAAKDCSRHLQNLSSEERKKILLDIADALEANVGLIIAENEADLAAAQDAGYEKSLVARMTLKAGKITSLAESIRAIADMEDPISHTLKKTEVAKDLVFEKMYCPLGVLLIIFESRPDALVQIAALAIRSGNGLLLKGGKEAMRSNTILHKVITSVIPDGVGKKLIGLVKSKEEIADLLKLDDVIDLVIPRGSNRLVSQIKATTKIPVLGHADGICHVYIDKSADMDMAKRIVLDAKVDYPAACNAMETLLVHKDLNKTEGLDDLLMELAKEGVVIYGGPVAHDTLKVPKVDSFHHEYSSMACTLEFVDDIQSAIDHINRYGSAHTDCIITTDKKSADTFLQQVDSAAVFHNASTRFCDGTRFGLGAEVGISTGRIHARGPVGVDGLLTTRCILRGSGQVVNGDKGVVYTHKDLPLQ

SEQ ID NO: 5910 - protein, 735 aa, Oryza sativa
MGRGGIGGAGLVAAVAKADVENTDSTRGFVKDVKRIIIKVGTAVVTGPNGRLAMGRLGALCEQVKQLNFEGYEVILVTSGAVGVGRQRLKYRKLVNSSFADLQNPQMDMDGKACAAVGQSVLMAIYDTLFSQLDVTSSQLLVTDRDFMDPSFGNQLRETVNSLLDLKVIPVFNENDAISTRRQPYEDSSGIFWDNDSLARLLAQELKADLLIMLSDVEGLYSGPPSDPQSKIIHTYVHEQHGKLISFGEKSRVGRGGMQAKVAAAFTASSKGIPVVIASGFAIDSIIKVMRGEKIGTLFHREANQWGCSKEATAREMAVAARDCSRHLQKLSSEERKKILLDIADALEANEDLITSENQADLDLAQDIGYDKSLVARMTIKPGKIKSLAGSIREIADMEDPISHTLKRTEVAKDLVFEKTYCPLGVLLIIFESRPDALVQIASLAIRSGNGLLLKGGKEAMRSNTILHKVITGAIPDVVGKKLIGLVKNKDEIADLLKLDDVIDLVIPRGSNKLVSQIKAATKIPVLGHADGICHVYIDKSADMDMAKRIVLDAKVDYPAACNAMETLLVHKDLNRTEGLDDLLVELEKEGVVIYGGPVAHDTLKLPKVDSFHHEYNSMACTLEFVDDVQSAIDHINRYGSAHTDCIITTDGKAAETFLQQVDSAAVFHNASTRFCDGARFGLGAEVGISTGRIHARGPVGVDGLLTTRCILRGSGQVVNGDKGVVYTHRELPLQ

SEQ ID NO: 5911 - protein, 716 aa, Brachypodium distachyon
MENSDSTRCFVRDVKRIVIKVGTAVVTGQNGRLAMGRLGALCEQVKELNFQGYEVILVTSGAVGVGRQRLKYRKLINSSFADLQNPQLDLDGKACAAVGQSGLMAIYDTLFSQLDVTSSQLLVTDRDFLDPSFGHQLRETVISLLDLKVIPVFNENDAISTRKQPYEDSSGIFWDNDSLATLLAQELNADLLIMLSDVEGLYSGPPSDPQSKIIHTYITEKHGRLINFGEKSRVGRGGMQAKVAAAVTAASKGVPAVIASGFAIDSIIKVMRGEKIGTLFHNEANFWDCSKEVTTREMAVAAKDCSRHLQNLSSEERKKILLDIADALEANEDLITSENEADLAAAQDAGYEKSLVARMTLKAGKITSLARSIRAIADMEDPISHTLKKTEIAKDLVYEKMYCPLGVLLIIFESRPDALVQIAALAIRSGNGLLLKGGKEAMRSNTILHKVITGVIPDVVGKKLIGLVKSKDEIADLLKLDDVIDLVIPRGSNKLVSQIKAATKIPVLGHADGICHVYIDKSADMDMAKRIVLDAKVDYPAACNAMETLLVHKDLNKTEGLDDLLMELAKEGVVIYGGPVAHDTLKVPKVDSFHHEYSSMACTLEFVDDVQSAIDHINRYGSAHTDCIITTDKKSADTFLQQVDSAAVFHNASTRFCDGTRFGLGAEVGISTGRIHARGPVGVDGLLTTRCILRGSGQVVNGDKGVMYTHRELPLQ

SEQ ID NO: 5912 - protein, 766 aa, Triticum aestivum
PPTHLDLASPTRFFSSPVSIRSERAPAGRHAPAERRMGRGGIGGAVAAADLENSDSTRGFVRDVKRIVVKVGTAVVTGQNGRLAMGRLGALCEQVKELNFQGYEVILVTSGAVGVGRQRLKYRKLINSSFADLQNPQLDLDGKACAAVGQSGLMAIYDTLFSQLDVTSSQLLVTDRDFRDPSFGHQLRETVVSLLDLKVIPVFNENDAISTRRAPYEDSSGIFWDNDSLATLLAKELDADLLIMLSDVEGLYSGPPSDPQSKIIHTYINEKHGKLINFGEKSRVGRGGMQAKVAAAVTAASKGVPAVIASGFVTDSIIKIMRGEKIGTLFHNEANVWDCSKEVTTREMAVAAKDCSRHLQNLSSEERKKILLDIAGALDANVDLIISENEADLAAAQDSGYEKSLVARMTLKAGKITSLAESIRAIADMEDPISHTLKKTEVAKDLVFEKMYCPLGVLLIIFESRPDALVQIAALAIRSGNGLLLKGGKEAMRSNTILHKVITSVIPDAVGKKLIGLVKSKDEIADLLKLDDVIDLVIPRGSNRLVSQIKAQTKIPVLGHADGICHVYIDKSADMDMAKRIVLDAKVDYPAACNAMETLLVHKDLNKTEGLDDLLMELAKEGVVIYGGPVAHDTLKVPKVDSFHHEYSSMACTLEFVDDVQSAIDHINRYGSAHTDCIITTDKKSADTFLQQVDSAAVFHNASTRFCDGTRFGLGAEVGISTGRIHARGPVGVDGLLTTRCILRGSGQVVNGDKGVVYTHKDLPLQ

SEQ ID NO: 5913 - protein, 633 aa, Pennisetum glaucum
CRTTDGLDGKACAAVGQSGLMAIYDTLFSQLDVTSSQLLVTDRDFKDPSFGDQLRETVFALLDLKVIPLFNENDAISTRKQPYEDPSGIFWDNDSLAALLAAELNADLLIMLSDVEGLYSGPPSDPQSKIIHTYVNEKHAKLISFGEKSRVGRGGMQAKVFAAANAASKGVPVVIASGFATDSIMKVLKGEKIGTLFHNEANLWECSKEATAREMAVAARDCSRRLQKLSSEERKKILLDIADALEANEDAIRSENEADVEAAQYAGYEKSLIARMTLKPGKITNLARSIRAIADMEDPISHTLKRTEVAKDLVFEKAYCPLGVLLIIFESRPDALVQIATLAIRSGNGLLLKGGKEAMRSNAILHKIITEVIPDAVGKKLIGLVTSKDEIADLLALDDVIDLVIPRGSKNLVSQIKATTKIPVLGHADGICHVYIDKSADMDMAKRIVLDAKVDYPAACNAMETLLIHNDLSKSEGLDDLLVELEKEGVVIYGGPIAHDKLKLPKVDSFRHEYSSMACTLEFVDDVHSAIDHINRYGSAHTDCIITTDEKAAEAFLQQVDSAAVFHNASTRFCDGTRFGLGAEVGISTGRIHARGPVGVDGLLTTRCILRGSGQVVNGDKGVVYTHRDLPLQ

SEQ ID NO: 5914 - protein, 248 aa, Zea mays
MEEREKLVCLAKLAEQAERYDDMVEFMKNLARMDVDMSAEERHLFSVGFKNTIGAKRASWRIICSHEQKVAADRQTGVMIDAYKKKVEEELRKVCNEVLSVIAIHCLPLASTGENIVFFYKMKGDYYRYLAEFSTGTEKKAASDQSLMAYQHAMVVASSELSPAHQIRLGLALNLSVFFYEIMNSHERACQVAKQAFDEALTEINSGEGVYKDSTLMMQLLKDNLALWTSELTGGEASKGNDDVDMEG

SEQ ID NO: 5915 - protein, 248 aa, Panicum virgatum
MEEREKVVCLAKLAEQAERYDHMVEFVKKLARMDVDMSAEERHLFSVGFKNTIGTKRASWRIICSLEQKLTSGDQAGVMIDAYKKKVEDELRKVCNEVLSIIAIHCLPLANSGENIVFFYKMKGDYYHYLAEFSTGTEKKAAADQSLMAYQHAMVVASSELSPAHQIRLGLALNFSVFFYEIMNSHERACQVAKQAFDEALTEINSAGEGVYKDSTIMMQLLKDNLALWTSELTGGEASKDNAIDMEG

SEQ ID NO: 5916 - protein, 244 aa, Pennisetum glaucum
EKIVCLAKLAEQAERYDDMVEFMKKLARMDVDMNAEERHLFSVGFKNIIGAKRASWRLICSLEQKLTGGDQAGVMIDAYKKKVEDELRKLCNEVLSIIAIHCLPLTSSGENVVFFYKMKGDYYRYLAEFSTGTEKKAAADQSLMAYQHAMVVASSDLSPAHQIRLGLALNFSVFFYEIMNSHERACQVAKQAFDEALAEIKSAGEGVYKDSTLMMQFLKDNLALWTSELTGGEPSRDNDIDMEG

SEQ ID NO: 5917 - protein, 284 aa, Panicum virgatum
MEEREKVVCLAKLAEQAERYDDMVEFVKKLARMDVDMSAEERHLFSVGFKNTIGAKRASWRIICSFEQKLTTGDQAGVMIDAYKNKVEDELRKVCNEVLSIIAIHCLPLANSGENVMFFYKMKGDYYRYLAEFSTGTEKKAAADQSLMAYQHAMVVASSELSPAHQIRLGLALNFSVLFYEIMNSHERACQVAKQAFDEALAEINSAGEGIYKDSTLMMQLLKDNLALWTSELTAGLIEMHAELLSSNASEPRVLSFSASEEEPYVSFLLQFLFLSFGHRLVLE

SEQ ID NO: 5918 - protein, 248 aa, Brachypodium distachyon
MEERVKVVCMAKLAEQAERYDDMVDLMKKLARMDVDMSGEERHLFSVGFKNTIGAKRASWRILSSLEQKVTTGEQAGGMINDYRKKVEDELRMVCNEILSIIAIHCLPLANSGENIVFFYKMKGDYYRYLAEFSTGTEKKAAADQSLVAYQHAMVVASTELSPVHPIRLGLALNFSVFFYEIMNCHERACQVAKQAFDEATAEINSMGVEGYNDSTLMMQLLKDNLTLWTSELTGGESSKDNDLDMEG

SEQ ID NO: 5919 - protein, 244 aa, Avena sativa
GKVVCMAKLAEQAERYDDMVEFMKNLARMDVDMSAEERHLFSVGFKNTIGARRASWRILSSLEQKVTAGERASRMINVYRKKVEDELRMVCNEILSIIAIHCLPLANTGENVVFFYKMKGDYYRYLAEFSTETEKKSAADQSLMAYQHAMVVASTELSPAHPIRLGLALNFSVFFYEIMNCHERACQVAKQAFDEATREIKSTGADGYNDSTLMMQLLKDNLALWTSEINEGEASKDNDIDMEG

SEQ ID NO: 5920 - protein, 299 aa, Saccharum officinarum
MGAWVSVLLGMDDGAAAAAAGPAAVGLGDLPELCAAQVLLRLDPPEICRLARLNHAFRGAAGADFVWEAKLPENYSYLMEFVGSGDEGRRRRRRAGKKEIYARLARPVPFGGGHKEFWLDKSKGMICMALSSKALVITGIDDRRYWQHMPTSESRFQSVAYLQQIWWFEVVGEVDFCFPVGTYSLYFRVHLGKFYKRFGRRHCTSEHVHGWDKKPVRFQLSTSDGQQALSQCYLEEPGSWVLYHAGDFVASKPDQPMKLKFSMAQIDCTHTKGGLCIDSVLIYPKGKGFQQERVIRSQK

SEQ ID NO: 5921 - protein, 299 aa, Saccharum officinarum
MGAWVSVLLGMDDGAAAAAAGPAAVGLGDLPELCAAQVLLRLDPPEICRLARLNHAFRGAAGADFVWEAKLPENYSYLMEFVGSGDEGRRRRRRAGKKEIYARLARPVPFGGGHKEFWLDKSKGMICMALSSKALVITGIDDRRYWQHMPTSESRFQSVAYLQQIWWFEVVGEVDFCFPVGTYSLYFRVHLGKFYKRFGRRHCTSEHVHGWDKKPVRFQLSTSDGQQALSQCYLEEPGSWVLYHAGDFVASKPDQPMKLKFSMAQIDCTHTKGGLCMDSVLIYPKGKGFQQERVIRSQK

SEQ ID NO: 5922 - protein, 296 aa, Zea mays
MGAWVSVLLGMDGAAAAGPAAVGLGDLPELCAAQVLLRLDPPEICRLAQVNHAFRGAAGADFVWEAKLPENYNYLMEFVGSGDEGKRRRRRAGKKEIYARLARPVPFGDGKKEFWLDKNKGMICMALSSKALVITGIDDRRYWQHMPTSESRFQSVAYLQQIWWFEVVGEVDFCFPVGTYSLYFRVHLGKFYRRFGRRQCTSEHVHGWDKKPVRFQLSTSDGQQALSQCYLEEPGSWVLYHAGDFVASKPDQLMKLKFSMAQIDCTHTKGGLCIDSVLIYPKGKGFHQERVVRSQK

SEQ ID NO: 5923 - protein, 301 aa, Brachypodium distachyon
MGAGVSSLFFGIGGEAAQEPGAPGLGDLPELCAAEVLLRLDAPEICRLARLNHAFRGAAGADFVWEAKLPENYRHLMGYVEGGGDEGRRRRRRAGKKEIYARLSRPVPFDGGTKEFWLEKSKGRVCMALSSKALVITGIDDRRYWTHMPTAESRFQSVAYLQQIWWFEVVGELDFCFPVGTYSLYFRIHLGKFYKRFGRRVCSSEHVHGWDKKPVRFQLATSDGQHALSQCYLDEPGSWVLYHAGDFVVSKPDQALKLKFSMAQIDCTHTKGGLCVDSVLVYPKGFQQEKVITAKSSEMRL

SEQ ID NO: 5924 - protein, 302 aa, Hordeum vulgare
MGAGVSSFLFGVGGPAAEAAPGAAGLGDLPELCAAQVLLRLDAPEICRLARLNHAFRGAAGADFVWEAKLPENYRHLIGYVEGGGEEGRRRRRRAGTKEIYARLSRPVSFDDGTKEFWLEKSKGRVCMALSSKALVITGIDDRRYWTHMPTTESRFQSVAYLQQIWWFEVVGELDFCFPVGTYSLYFRVHLGKFSKRFGRRVCSTEHVHGWNKKPVRFQLSTSDGQNALSQCYLDEPGSWVLYHAGDFVSSKPGQSLKLKFSMAQIDCTHTKGGLCVDSVLVYPKGFQQEKVVTGKISEMRS

SEQ ID NO: 5925 - protein, 302 aa, Pseudoroegneria spicata
MGAGVSSFLFGVGGAAAEAAPGAAGLGDLPELCAAQVLLRLDAPEICRLARLNHAFRGAAGADFVWEAKLPENYRHLIGYVEGGGEEGRRRRRRAGTKEIYARLSRPVSFDDGTKEFWLEKSKGRVCMALSSKALVITGIDDRRYWTHMPTTESRFQSVAYLQQIWWFEVVGELDFCFPVGTYSLYFRVHLGKFSKRFGRRACSTEHVHGWNKKPVRFQLSTSDGQNALSQCYLDEPGSWVLYHAGDFVSSNPGQALKLKFSMAQIDCTHTKGGLCVDSVLVYPKGFQQEKVVTGKISEMRS

SEQ ID NO: 5926 - protein, 300 aa, Triticum aestivum
MGAGVSSFFFGAAAEAAPGAAGLGDLPELCAAQVLLRLDAPEICRLARLNHAFRGAAGADFVWEAKLPENYRHLIGYVEGGGEEGRRRRRRAGTKEIYARLSRPVSFDDGTKEFWLEKSKGRVCMALSSKALVITGIDDRRYWTHMPTTESRFQSVAYLQQIWWFEVVGELDFCFPVGTYSLYFRVHLGKFSKRFGRRVCSTEHVHGWNKKPVRFQLSTSDGQNALSQCYLDEPGSWVLYHAGDFVSTNPRQALKLKFSMAQIDCTHTKGGLCVDSVLVYPKGFQQEKVVTGKISEMRSS

SEQ ID NO: 5927 - protein, 310 aa, Oryza sativa
MGAGVSGLFGLGGDEGETSAAVGGAAAAGLGDLPELCAAEVLLRLDAPEICRLARLNHAFRGAAGADFVWEAKLPENYRYLMSFVEGGGGGDDGRQLRRRRWRPAGKKEIYARLARPVPFDGGSKEFWLEKSKGRVCMALSSKSLVITGIDDRRYWQHIPTAESRFYSVAYLQQIWWFEVVGEIDFSFPVGTYSLYFRIHLGKFYKRFGRRVCSTEHVHGWDKKPVRFQLSTSDGQHSLSQCSLGEPGSWVLYHAGDFVVSKPDQTIKLKFSMAQIDCTHTKGGLCVDSAFIYPKGFQQERMVRSQKCRC

SEQ ID NO: 5928 - protein, 480 aa, Solanum phureja
ILVLNMDKKRHAVCVPFPAQGHVIPFMKLAKILHSRGFYVTFVNTEYNHRRLIRSQGPDFVKGFQDFQFETIPEGLPPSDRDATQDPTSLCDSIRKNCLTPFRDLLSKLGSSPVVPPISCVISDGVMTFAIKAAQEFGILDVQFWTASACGYMGYLQFDELTRRGIIPFKDDSFMEDGTLDTIVDGIPGMRNIRLKDLPSFIMTTDPDDILLNYLSDEAHNCLKSSAMIINTFIELEREVLEAIEARFPNIYVTGPLSLMEKTIPENELSSFRPSLWKEEFLCLEWLNKQEPSSVIYVNYGCVTLMSDHHLKEFAWGLANSKHPFLWIVRPDIVMGYSAVLPDEFLEEIKDRGLLASWCPQDQVLSHPSIGVFITHCGWNSTIESISSGVPLICWPFFAEQQTNCRYACAEWGIGVEVNKDVKRQEIEAIIKDMLEGKKGKELKDKALEWKKKAVEATDIGGPSWKHFDTFLERLLLNRE

SEQ ID NO: 5929 - protein, 475 aa, Solanum phureja
MDKKPHAVCIPFPAQGQVMPFMKLAKILHSRGFYVTFVNTEYNHKRLIRSQGPDFVKGFQDFQYETIPEGLSQSDRDVTQDPASLCDSIRKNCLTPFRDLLSKLGSSPVVPPISCIISDGLMSFAIKAAQEFGILDVQFWTASACGYMGYLQYDELTRRGTIPFKDDSFMEDGTLDRVVDGIPGMRNIRFKDLPSFIMTTDPHDILLNYLSDEAQNCLKSSAMIINTFTELEREVLEAIEARFPNIYVTGPLSLMEKTIHENKLSSFRPSLWKEEFQCLEWLNKQEPSSVIYVNYGCVTLMSDHHLKEFAWGLANSKHPFLWIVRPDIMMGDSAVLPDEFLEEIKDRGLLASWCPQDQVLSHPSIGVFLTHCGWNSTIESISSGVPLICWPFFAEQQTNCRYACVEWGIGVEVNKDVKRQEIEAIINDMLEGEKGKDLKDKALEWKKKAAEATDTGGSSWKHFDTFLEKLLLSRE

SEQ ID NO: 5930 - protein, 460 aa, Solanum phureja
QGHVIPFMKLAKILHSRGFYVTFVNTEYNHKRLIRSQGPDFVKGFQDFQFDTIPEGLPPSDRDVTQDPASLCDSIRKNCLTPFRDLLSKLISSPVIPPISCIISDGMMSFAIKAAQEFGILDVQFWTASACGYMGYLQYDELRRREIIPFKDNSFMEDGTLDTIVDEIPGMRNIRLKDLPSFIMTTDPDDILLNYLSDEAQNCLKSSAMIINTFTELEREVLEEIQAKFPNIYVTGPLSLMEKTIPENELSSFRPSLWKEEFQCLEWLNKQEPSSVIFVSYGCVTLMSDHHLKEFAWGLANSKHPFLWIVRPDIVMGDSAVLPDEFLVEIKDRGLLASWCPQDQVLSHPSIGVFLTHCGWNSTIESISSGVPLICWPFFAEQQTNCRYACAEWGIGVEVKQDVKRQEIKAIIKEMLEGERSKELKDKALEWKKKAAEATDIGGSSWKHFDTLLEKLLLNK

SEQ ID NO: 5931 - protein, 205 aa, Solanum phureja
MERRISMLLNLTERIEQSSVIYVNYGCMTLMSDHHLKEFAWGLANSKHPFLWIVRPDIMMGDSAVLPDEFLEEIKDRGLLASWCPQNQVLSHPSIGFFLTHCGWNSMIESIGSGVPLICWPFFAEQQTNCQYACAEWGIGVEVNQDVKREEIEAIIKDMLEGEKGKELKGKAVEWKKKAAEATDIGGPSWKHFDTFLEKLLLNRE

SEQ ID NO: 5932 - protein, 194 aa, Arabidopsis lyrata
MTSSIHELSDNVGSHEKQEQIDSHFQPPIPPGRNYESIATSLVYSEPVPHPGSTHSMAPGQYPYPDPYYRSIFAPPPQPYTGVHLQLMGIQQQGVPLPSDAVEEPVFVNAKQYHGILRRRQSRARLESQNKVIKSRKPYLHESRHLHAIRRPRGCGGRFLNAKKDDEHHEDSTHEENSNLSSDKSAMAASSGTS

SEQ ID NO: 5933 - protein, 306 aa, Arabidopsis lyrata
MQVFQRKESSWGNSIIPTNSNIQGSESFSLTKDMMMSTTQFPGTKHSGLQLQDQDSTSSQSTEESGGGEVASFEEHNRYGCSIVNTNLSGYIENPGKPIENYTKSTTTSSMVSQDSVFPAPTSGQISWSLQCAETSHFNGFLAPEYASAPTVLPHLEMMGLVSSRVPLPHNIQENEPIFVNAKQYHAILRRRKHRAKLEAQNKLIKCRKPYLHESRHLHALKRARGSGGRFLNTKKLQESANSLCSSQMANGQNFSMSSRGGGSGLGSSSITPSSNSNRINMFQNPQFRFSGYPSTHHASALMSGT

SEQ ID NO: 5934 - protein, 396 aa, Arabidopsis lyrata
MGFWSLLEVASMPVIQVLVMSLVGAFLASDRCKLFPVEARNSMNKVVFVLFAPALMFANLAQTVTLEDIISWWFMPVNMGLTFLIGGLLGWMVVKILKPPPYLEGLIVATCSAGNMGNLPIILVPAICDEDKSPFGNRSVCRTVGLSYASFSMALGGFYIWTYTFRLIKGSAMRIQAIEESERTAIKSSNSDLEADHKTHLLGAPEDKENKVVKEETGFWRKVVDFLHEILEELLAPPTLGAIIGFIFGAVRWLRNLIIGDDAPLRIVQSTAKLLGDGTIPCMTIILGGNLIQGLRSSAVKPVVVLGIVCVRYIIMPIIGIGIVLTAANLGFLPADPLFQYVLMLQFTLPPAMNIGTMTQLYNVAQDECSVLMLWTYLVAILALTVWSTIFLHLLV

SEQ ID NO: 5935 - protein, 164 aa, Arabidopsis lyrata
MATSKCYYPRPSHRFFTTDQHVTAASDFELDEWDLYNTGSDSPSNFSFSDLTITSGRTGTNRKIHGGSGSGSGTAASSLPVNVPDWSKILGDESRRQRQIYNEEEVDGDEISCGGGTRRVPPHELLANRRMASFSVHEGAGRTLKGRDLSRVRNTIFKIRGIED

SEQ ID NO: 5936 - protein, 165 aa, Brassica napus
MATSKCYYPRPSHRFFSTDQHVSSPSDFELDEWDLFNTGSDSASGFTFSDLTITSDRTGANRKPRGGSVSEKFAGSAASSLPVNVPDWSKILGEESPRRQTSNEEYDGDEVAACGGETRRVPPHELLASRRMASFSVHEGAGRTLKGRDLSRVRNTIFKIRGIED

SEQ ID NO: 5937 - protein, 627 aa, Arabidopsis lyrata
MSASWADVADSENTGSGSFNQNSHPSRPAYVPPHLRNRPATSEPVAPLPANDRVGFGGPPSASRWAPGGSSVGVGGGYRADAGRPGSGSGYGGRGGGGWNNRSGGWDRREREVNPFDNDDSEPEPAFSEQDNTVINFDAYEDIPIETSGDNVPPPVNTFAEIDLGEALNLNIRRCKYVKPTPVQRHAIPILLEGRDLMACAQTGSGKTAAFCFPIISGIMKDQHVQRPRGSRTVYPLAVILSPTRELASQIHDEAKKFSYQTGVKVVVAYGGTPINQQLRELERGVDILVATPGRLNDLLERARVSMQMIRFLALDEADRMLDMGFEPQIRKIVEQMDMPPRGVRQTLLFSATFPREIQRLAADFLANYIFLAVGRVGSSTDLIVQRVEFVLDSDKRSHLMDLLHAQRENGIQGKQALTLVFVETKRGADSLENWLCINGFPATSIHGDRTQQEREVALKAFKSGRTPILVATDVAARGLDIPHVAHVVNFDLPNDIDDYVHRIGRTGRAGKSGLATAFFNDGNTSLARPLAELMQEANQEVPAWLTRYASRSSFGGGKNRRSGGRFGGRDFRREGSFGRGGGGGGGYGGGGGYGGGGGYGGGGGYGGGYSGAPSGGYGGEPPSAWD

SEQ ID NO: 5938 - protein, 608 aa, Arabidopsis lyrata
MSASWADVADSEKAGSKPKTSYVPPHLRNRPSEPAAAPLPQNDHAGYGGQPAGSRWAPPSSGGGGGTGGGYRNDGGRPGYGYGGGGGGGGGWNNSSGGWNRKEREVNPFGDDAELEPVFTEQENTGINFDAYEDIPVETSGGDVPPPVNTFADIDLGDALNLNIRRCKYVRPTPVQRHAIPILLGQRDLMACAQTGSGKTAAFCFPIISGIMKDQHVQRPRGSRTVYPLAVILSPTRELACQIHDEAKKFSYQTGVKVVVAYGGTPINQQLRELERGVDILVATPGRLNDLLERARVSMQRIKFLALDEADRMLDMGFEPQIRKIVEQMDMPPRGERQTMLFSATFPREIQRLAADFMSNYIFLAVGRVGSSTDLITQRIEFVQESDKRSHLMDLLHAQRETQDKQSLTLVFVETKRGADTLENWLCMNEFPATSIHGDRTQQEREVALRSFKSGRTPILVATDVAARGLDIPHVAHVVNFDLPNDIDDYVHRIGRTGRAGKSGIATAFFNENNAQMARLLAELMQEANQEVPEWLTRYASRASFGGGKKRSGGRFGGRDFRREGSYSRGGGGGGGGNDYYGGGGYGGGGYGGAPSGGYGAGVTSAWD

SEQ ID NO: 5939 - protein, 612 aa, Arabidopsis thaliana
MSASWADVADSEKAVSQSKPPYVPPHLRNRPSEPVAAPLPQNDHAGYGGQPAGSRWAPPSSGGGGASGGGYRNDGGRTGYGYGAGGGGGGGGGWNNRSGGWDRREREVNPFGDDAELEPVFTEQENTGINFDAYEDIPVETSGGDVPPPVNTFADIDLGDALNLNIRRCKYVRPTPVQRHAIPILLAERDLMACAQTGSGKTAAFCFPIISGIMKDQHVERPRGSRAVYPFAVILSPTRELACQIHDEAKKFSYQTGVKVVVAYGGTPIHQQLRELERGCDILVATPGRLNDLLERARVSMQMIRFLALDEADRMLDMGFEPQIRKIVEQMDMPPRGVRQTMLFSATFPSQIQRLAADFMSNYIFLAVGRVGSSTDLITQRVEFVQESDKRSHLMDLLHAQRETQDKQSLTLVFVETKRGADTLENWLCMNEFPATSIHGDRTQQEREVALRSFKTGRTPILVATDVAARGLDIPHVAHVVNFDLPNDIDDYVHRIGRTGRAGKSGIATAFFNENNAQLARSLAELMQEANQEVPEWLTRYASRASFGGGKKRSGGRFGGRDFRREGSYSRGGGGGGGGGGSDYYGGGGYGGGGYGGAPSGGYGAGVTSAWD

SEQ ID NO: 5940 - protein, 400 aa, Arabidopsis lyrata
MAGICCGVVGETEPAAPVDSTTRASLRRRLDLLPSIKIVADSAVAPPLESCRKRQKRETVLSRNLDLESNVRSEHKKVKSAVTNSNSVTEAESCFFSDVPRIGTTSVCGRRRDMEDAVSIHPSFLQRNSENLHFYGVFDGHGCSHVAEKCRERLHDIVKKEVEVMASDEWKETMVKSFQKMDKEVSQRECNLVVNGANRSMKNSCRCELQSPQCDAVGSTAVVSVVTPEKIIVSNCGDSRAVLCRNGVAIPLSVDHKPDRPDELIRIQQAGGRVIYWDGARVLGVLAMSRAIGDNYLKPYVIPDPEVTVTDRTDDDECLILASDGLWDVVPNETACGVARMCLRGAGPMDGDDSDAAAAHNACSDAALLLTKLALARQSSDNVSVVVVDLRKRRNNQSSS

SEQ ID NO: 5941 - protein, 401 aa, Brassica napus
MAGICCGVVGESEPAVTVDSSTRASLRRRLDLLPSIKIVAPPLESSRKRQKRETPSGNQDLESNVRSERNVEKKARSSPVKNSNLIPSSATEAESCFVSDAPKIGTTSVCGRRRDMEDAVSVHHSLIHKNSENLHFYGVFDGHGCSHVAEKCRERLHEIVKRDVEAMAAGGEDEWKETMAKSFQKMDREVCQRDSNNGAASRSVKSSCRCELQSPQCDAVGSTAVVSVVTPEKIVVSNCGDSRAVLCRNGVAIPLSSDHKPDRPDELIRIQQAGGRVIYWDGARVLGVLAMSRAIGDNYLKPYVIPDPEVAVTDRTDDDECLILASDGLWDVVTNETACGVARMCLQGAAAADGGDSDTAHNACSDAALLLTKLALARQSSDNVSVVVVDLRKRRSNNQVS

SEQ ID NO: 5942 - protein, 400 aa, Brassica napus
MAGICCGVVGESEPTVTVDSSTRASLRRRLDLLPSIKIVAPPLESSRKRQKRETPSGNQDLESNVRSERNVEKKARSSPVKNSNLIPSSATEAESCFVSDAPKIGTTSVCGRRRDMEDAVSVHHSLIHKNSENLHFYGVFDGHGCSHVAEKCRERLHEIVKRDVEAMAAGGEDEWKETMAKSFQKMDREVSQRDSNGAASRSVKSSCRCELQSPQCDAVGSTAVVSVVTPEKIVVSNCGDSRAVLCRNGVAIPLSSDHKPDRPDELIRIQQAGGRVIYWDGARVLGVLAMSRAIGDNYLKPYVIPDPEVTVTDRTDDDECLILASDGLWDVVTNETACGVARMCLQGAAAADGGDSDTAHNACSDAALLLTKLALARQSSDNVSVVVVDLRKRRSNNQVS

SEQ ID NO: 5943 - protein, 401 aa, Brassica napus
MAGICCGVVGESEPTVTVDSSTRASLRRRLDLLPSIKIVAPPLESSRKRQKRETPSGNQDLESNVRSERNVEKKARSSPPVKNSNLIPSSATEAESCFVSDAPKIGTTSVCGRRRDMEDAVSVHHSLIHKNSENLHFYGVFDGHGCSHVAEKCRERLHEIVKRDVEAMAAGGEDEWKETMAKSFQKMDREVSQRDSNSAASRSVKSSCRCELQSPQCDAVGSTAVVSVVTPEKIVVSNCGDSRAVLCRNGVAIPLSSDHKPDRPDELIRIQQAGGRVIYWDGARVLGVLAMSRAIGDNYLKPYVIPDPEVTVTDRTDDDECLILASDGLWDVVTNETACGVARMCLQGAAAADGGDSDTAHNACSDASLLLTKLALARQSSDNVSVVVVDLRKRRSNNQVS

SEQ ID NO: 5944 - protein, 403 aa, Brassica rapa
  misc_feature (97)..(97): Xaa can be any naturally occurring amino acid
MAGICCGVVGESEPTVTVDSSTRASLRRRLDLLPSIKIVAPPLESSRKRQKRETPSGNQDLESNVRSERNVEKKARSSPPVKNSNLIPSSATEAESXFVSDAPKIGTTSVCGRRRDMEDAVSVHHSLIHKNSENLHFYGVFDGHGCSHVAEKCRERLHEIVKRDVEAMAAGGEDEWKETMAKSFQKMDREVSQRDSNNGAASRNSVKSSCRCELQSPQCDAVGSTAVVSVVTPEKIVVSNCGDSRAVLCRNGVAIPLSSDHKPDRPDELIRIQQAGGRVIYWDGARVLGVLAMSRAIGDNYLKPYVIPDPEVTVTDRTDDDECLILASDGLWDVVTNETACGVARMCLQGAAAADGGDSDTVHNACSDASLLLTKLALARQSSDNVSVVVVDLRKRRSNNQVS

SEQ ID NO: 5945 - protein, 391 aa, Brassica napus
MAGICCGVVGESEPAAPADSVTRTSLKRRLDLLPSIKIVAKSAVAPPLETCRKRQKRETPSLVPTLPDLESNMKAGSAVTKSNSISSSATEEAGSSFFSDAPKIGTTSVCGKRRDMEDAVSLHPSLLRRNSEDIHFYGVFDGHGCSHVAEKCRERLHEIVKHEVEAMASDNEWKETMAKSFQKMDREVSQRDASRSAKSSCRCELQSPQWDAVGSTAVVSVVTPEKIVVSNCGDSRAVLCRNVLAIPLSSDHKPDRPDELNRIQEAGGRVIYWDGARVLGVLAMSRAIGDNYLKPYVIPDPEVTVTDRTEDDECLILASDGLWDVVTNETACGVARMCLKGAEVAEGGGDSDTAHNACSDAALLLTKLALARQSSDNVSVVVVDLRKRRNN

SEQ ID NO: 5946 - protein, 537 aa, Arabidopsis lyrata
MSVVLLSSTSATITKSQSKKIPFLSPTTKFPFKVSISPSRSKLFNNPLRVAAPPSIPTSDPAEEKRIEEEFGGDTEEEESEFKWRDHWYPVSLVEDLDPNVPTRFQLLGRDLVLWFDRNDQKWAAFDDLCPHRLAPLSEGRLDENGHLQCSYHGWSFSGCGSCTRIPQAATSGPEARAVKSPRACAIKFPTMVSQGLLFVWPDENGWDRANSIEPPRLPDDFDRPEFSTVTIQRDLFYGYDTLMENVSDPSHIDFAHHKVTGRRDRAKPLPFKVESSGPWGFQGANDDNPRITAKFVAPCYSLNKIEIDAKLPIFGNQKWVIWICSFNIPMAPGKTRSIVCSARNFFQFSVPGPAWWQVVPRWYEHWTSNLVYDGDMIVLQGQEKVFLSKSMESPDYDVNKQYTKLTFTPTQADRFVLAFRNWLRRHGKSQPEWFGSTTANQPLPSTVLTKRQMLDRFEQHTQVCSSCKGAYNSFQILKKFLVGATVFCAATAGVPSDVQIRLVLAGLSLISAASAYALHEQEKNFVFRDYVHSEIE

SEQ ID NO: 5947 - protein, 538 aa, Brassica napus
MSVVLVSSASATLTKSKSIKIPFLSPNSAKFPSRVSISPQRPKLLDSPLRVAAPPSVPTSDPAEESRIEEEHGGDKEEEGSEFKWRDHWYPVSLVEDLDPNSPTRFQLLGRDLVLWFDRNDQKWAAFDDLCPHRLAPLSEGRLDENGHLQCSYHGWSFAGCGSCTRIPQAATSGPEARAVKSPRACAIKFPTMVSQGLLFVWPDENGWDRANSIEPPRLPDDFDKPEFSTVTIQRDLFYGYDTLMENVSDPSHIDFAHHKVTGRRDRAKPLPFKVESSGPWGFQGANDDSPKITAKFVAPCYSLNKIEIDAKLPIVGNQKWVIWICSFNIPMAPGKTRSIVCSARNFFQFSVPGPAWWQVVPRWYEHWTSNLVYDGDMIVLQGQEKVFLSKSMESPDYDVNKQYTKLTFTPTQADRFVLAFRNWLRRYGKSQPEWFGSTAANQPLPSTVLTKREMLDRFEQHTQVCSSCKGAYNGFQIVKKFLVGTTVFLAATAGVPSDVQIRLVLAGLALISAASAYALHEKEKNFVFRDYVHSEIE

SEQ ID NO: 5948 - protein, 538 aa, Brassica napus
MSVVLVSSASATLTKSKSIKIPFLSPNSAKFPSRVSISPQRRKLLDSPLRVAAPPSVPTSDPAEESRIEEEHGGDKEEEGSEFKWRDHWYPVSLVEDLDPNSPTRFQLLGRDLVLWFDRNDQKWAAFDDLCPHRLAPLSEGRLDENGHLQCSYHGWSFAGCGSCTKIPQAATSGPEARAVKSPRACAIKFPTMVSQGLLFVWPDENGWDRANSIEPPRLPDDFDKPEFSTVTIQRDLFYGYDTLMENVSDPSHIDFAHHKVTGRRDRAKPLPFKVESSGPWGFQGANDDSPKITAKFVAPCYSLNKIEIDAKLPIVGNQKWVIWICSFNIPMAPGKTRSIVCSARNFFQFSVPGPAWWQVVPRWYEHWTSNLVYDGDMIVLQGQEKVFLSKSMESPDYDVNKQYTKLTFTPTQADRFVLAFRNWLRRYGKSQPEWFGSTAANQPLPSTVLTKREMLDRFEQHTQVCSSCKGAYNGFQIVKKFLVGTTVLLAATAGVPSDVQIRLVLAGLALISAASAYALHEKEKNFVFRDYVHSEIE

SEQ ID NO: 5949 - protein, 534 aa, Brassica napus
  misc_feature (42)..(42): Xaa can be any naturally occurring amino acid
  misc_feature (162)..(162): Xaa can be any naturally occurring amino acid
  misc_feature (211)..(211): Xaa can be any naturally occurring amino acid
  misc_feature (274)..(274): Xaa can be any naturally occurring amino acid
  misc_feature (286)..(286): Xaa can be any naturally occurring amino acid
  misc_feature (485)..(485): Xaa can be any naturally occurring amino acid
MSVVLVSSASATLTKSKSIKIPFLSPNSAKFPSRVSISPQRXKLLDSPLRVAAPPSVPTSDPAEESRIEEEHGEEGSEFKWRDHWYPVSLVEDLDPNSPTRFQLLGRDLVLWFDRNDQKWAAFDDLCPHRLAPLSEGRLDENGHLQCSYHGWSFAGCGSCTXIPQAATSGPEARAVKSPRACAIKFPTMVSQGLLFVWPDENGWDRANSIXPPRLPDDFDKPEFSTVTIQRDLFYGYDTLMENVSDPSHIDFAHHKVTGRRDRAKPLPFKVESXGPWGFQGANDDXPKITAKFVAPCYSLNKIEIDAKLPIVGNQKWVIWICSFNIPMAPGKTRSIVCSARNFFQFSVPGPAWWQVVPRWYEHWTSNLVYDGDMIVLQGQEKVFLSKSMESPDYDVNKQYTKLTFTPTQADRFVLAFRNWLRRYGKSQPEWFGSTAANQPLPSTVLTKREMLDRFEQHTQVCSSCKGAYNGFQIVKKFLVGTTVXLAATAGVPSDVQIRLVLAGLALISAASAYALHEKEKNFVFRDYVHSEIE

SEQ ID NO: 5950 - protein, 553 aa, Brassica rapa
  misc_feature (233)..(233): Xaa can be any naturally occurring amino acid
  misc_feature (239)..(239): Xaa can be any naturally occurring amino acid
  misc_feature (251)..(251): Xaa can be any naturally occurring amino acid
  misc_feature (257)..(257): Xaa can be any naturally occurring amino acid
  misc_feature (259)..(259): Xaa can be any naturally occurring amino acid
SLFFSQVSAKIIPTKEAMSVVLVSSASATLTKSKSIKIPFLSPNSSAKFPSRVSISPQRRKLLDSPLRVAAPPSVPTSDPAEESSRIEEEHGEEGSEFKWRDHWYPVSLVEDLDPNSPTRFQLLGRDLVLWFDRNDQKWAAFDDLCPHRLAPLSEGRLDENGHLQCSYHGWSFAGCGSCTKIPQAATSGPEARAVKSPRACAIKFPAMVSQGLLFVWPDENGWDRANSVQPPXLPDDFXKPEFSTVTIQRXLFYGYXTXMENVSDPSHIDFAHHKVTGRRDRAKPLPFKVESSGPWGFQGANDDSPKITAKFVAPCYSLNKIEIDAKLPIVGNQKWVIWICSFNIPMAPGKTRSIVCSARNFFQFSVPGPAWWQVVPRWYEHWTSNLVYDGDMIVLQGQEKVFLSKSMESPDYDVNKQYTKLTFTPTQADRFVLAFRNWLRRYGKSQPEWFGSTAANQPLPSTVLTKREMLDRFEQHTQVCSSCKGAYNGFQIVKKFLVGTTVFLAATAGVPSDVQIRLVLAGLALISAASAYALHEKEKNFVFRDYVHSEIE

SEQ ID NO: 5951 - protein, 646 aa, Arabidopsis lyrata
MSSNSWADVSESERAPSGAWGYSRPSRTNYVPPHLRSRTPSSEFVAPSPGNDRGGYGGANSGYGGRGQGYGGRGSGYGGRGGVGGGWNTRSGGWDRRDTETNPFGNDGNSDPVVNEQENTVINFEAYEDIPIETSGDNVPPPVNTFAEIDLGEVLNLNIQRCKYVKPTPVQRNAIPILAAGRDLMACAQTGSGKTAAFCFPIISGIMKDQHIERPRGVRGVYPLAVILSPTRELACQIHDEARKFSYQTGVKVVVAYGGTPVNQQIRELERGVDILVATPGRLNDLLERGRVSLQMVKFLALDEADRMLDMGFEPQIRKIVQQMDMPPPGVRQTMLFSATFPREIQRLASDFLSNYIFLAVGRVGSSTDLIVQRVEFVHDSDKRSHLMDLLHAQRENGNQGKQALTLVFVETKKGADSLENWLCINGFPATTIHGDRSQQEREVALRSFKTGRTPILVATDVAARGLDIPHVAHVVNFDLPNDIDDYVHRIGRTGRAGNSGLATAFFNDNNTSMAKPLAELMQEANQEVPDWLTRYASRASFGGGKNRRSGGRFGGRDFRRESFSRGGGGADYYGGGGGYGGVPGGGYGAMPGGYGPVPGGGYGTVPGGGYAPYGRGGGAYYGGGPGGYGTVPSQGYGPGVASAWD

SEQ ID NO: 5952 - protein, 189 aa, Arabidopsis lyrata
MGDSDRDSGGGQNGNNPNGQSSLSPREQDRFLPIANVSRIMKKALPANAKISKDAKETMQECVSEFISFVTGEASDKCQKEKRKTINGDDLLWAMTTLGFEDYVEPLKVYLQRFREIEGERTGLGRPQTGAEVGEHQRDAVGDGAGFYGGGGMQYHQHHQFLHQQNHMYGATGGGSDSGGGAASGRTRT

SEQ ID NO: 5953 - protein, 276 aa, Arabidopsis lyrata
MSASSSSNPMSRDEATLLPSVQDKYGGVMTEMSHPMDPSLFSTLLRSSLSTWTLQGKKGVWIKLPKQLIGLAETAVKEGFWFHHAEKDYLMLVYWIPKEDHTLPANASHRVGIGAFVINHNREVLVVQEKTGRFQGQGIWKFPTGVVNEGEDIHDGSVREVKEETGVDTEFDQILAFRQTHKAFFGKSDLFFVCMLKPLSLEINAQESEIEAAQWMPWEEYIKQPFVQNYELLRYMTEICSAKTNGDYEGFTPLRVTAPDQQGNLYYNTRDLHSRN

SEQ ID NO: 5954 - protein, 198 aa, Brassica napus
MGDSDRDSGGGQTGNNQNGQSSLSPREQDRFLPIANVSRIMKKALPANAKISKDAKETMQECVSEFISFVTGEASDKCQKEKRKTINGDDLLWAMTTLGFEDYVEPLKVYLQRFREIEGERTGLGRPQTGGEAGEASERRWCRRRRWRILRWWDGDAVSTASSVSSSAEPYVWVHRRWWRRPQWRKELKRFGEVDLCI

SEQ ID NO: 5955 - protein, 186 aa, Brassica napus
MGDSDKDSGGGQNGQSPLSPREQDRFLPIANVSRIMKKALPANAKISKDAKETMQECVSEFISFVTGEASDKCQKEKRKTINGDDLLWAMTTLGFEDYVEPLKVYLQRFREIEGERAGLGRPQTGGEGGEHQRDAGLGDGGGFYGGGGMQYHQHHQFLQQQNRMYGSTGGGGGDGGGGAGSGRTRT

SEQ ID NO: 5956 - protein, 187 aa, Brassica napus
  misc_feature (130)..(130): Xaa can be any naturally occurring amino acid
MGDSDRDSGGGQTGNNQNGQSSLSPREQDRFLPIANVSRIMKKALPANAKISKDAKETMQECVSEFISFVTGEASDKCQKEKRKTINGDDLLWAMTTLGFEDYVEPLKVYLQRFREIEGERTGLGRPQTXGEAGEHQRDGGVGDGGGGYYGGGMGMQYQQHHQFLHQQNHMYGSTGGGGGGHSGGRS

SEQ ID NO: 5957 - protein, 182 aa, Raphanus sativus
MGDSDKDSGGGQNGQSPLSPREQDRFLPIANVSRIMKKALPANAKISKDAKETMQECVSEFISFVTGEASDKCQKEKRKTINGDDLLWAMTTLGFEDYVEPLKVYLQRFREIEGERAGLGRPHTGGEAGEHQRDAGVGEGGGFYGGGMQYHQHQFLHHQQNHMYGSTGGDGGGGAASGRTRT

SEQ ID NO: 5958 - protein, 184 aa, Brassica rapa
MGDSDRDSGGGQTGNNQNGQSSLSPREQDRFLPIANVSRIMKKALPANAKISKDAKETMQECVSEFISFVTGEASDKCQKEKRKTINGDDLLWAMTTLGFEDYVEPLKVYLQRFREIEGERTGLGRPQTGGEAGEHQRDGDGGGGYYGGGMGMGYQQHHQFLQQQNHMYGSTGGGGGGHSGGRS

SEQ ID NO: 5959 - protein, 179 aa, Raphanus sativus
  misc_feature (34)..(34): Xaa can be any naturally occurring amino acid
  misc_feature (167)..(167): Xaa can be any naturally occurring amino acid
  misc_feature (172)..(172): Xaa can be any naturally occurring amino acid
MGDSDKDSGGGQNGQSPLSPREQDRFLPIANVSXIMKKALPANAKISKDAKETMQECVSEFISFVTGEASDKCQKEKRKTINGDDLLWAMTTLGFEDYVEPLKVYLQRFREIEGERAGLGRPQHTGGEAGEHQRDGGGFYGGGGMQYHQHHQFLHQQNHMYGSTGGXGGGGXGSGRTRT

SEQ ID NO: 5960 - protein, 304 aa, Raphanus sativus
CFPADGFSAFRRVSTATRNRSMSASSSSSTNPMAGEEANNGGVTLLPVVEDKYGGVMTEISHPMDPSAFSALLQSSLSTWTLQGKKGVWIKLPRQLIGLAEAAVKEGFWFHHAEKDYLMLVYWIPKVGDTIPSNASHRVGIGAFVLNHKKEVLVVQEKTGRFQGQGIWKFPTGVVNEGEYIHDGSVREVKEETGVDTEFVQVLAFRQTHKAFFEKSDLFFVCMLNPLSLEINAQETEIEAAQWMPWEEYTKQPFVQNHELLRYMTAICSAKTNGDYEGFTPLRVSAPDQQGNLYFNTRDLRSRH

SEQ ID NO: 5961 - protein, 694 aa, Brachypodium distachyon
MPSIATVAEPMAVDDSASKKAKRKQLKAETAAAEAMETASSGKKEKKEKKRKAKEPSPPPPASDEEERSSTSSDSEPAPAAKKAKKEKKDKKKKSEEEVDDDGELTASGGDEDPADPNALANFRISEPLKQKLKSKGINALFPIQATTFGLVLDGHDLVGRARTGQGKTLAFVLPILESLVNGPHKATRRTDYGRLPSVLVLLPTRELANQVHADFEFYGGAFGLSTCCAYGGSHYRPQEMAMRKGVDIVVGTPGRVKDFIVKGTLNLKSLKFRVLDEADEMLNMGFVDDVELILGKVEDVTKVQTLLFSATLPEWVKKLSMRFLKADKKTVDLVGNEKMKASSSVKHLALPCNRAARSQIIPDIIKCYSRGGRTIIFTETKESASELSGLIPGSRALHGDIAQAQREVVIAGFRSGKFLVLVATNVAARGLDINDVQLIIQCEPPRDVEAYIHRSGRTGRAGNTGVAVMLFEPRYKYSVTRIERESGVKFEHISAPQPTDVAQSAGNEAADAIASVSDSVIPVFRQQAEELLSSSSMSAVDLLAKALAKAVGYTDIKKRSLLSSMENYTTLQLQTGRPMYTPGFALTTLKRFMPEDKLSDVHGITLTADGTGAVFDVPSAEVQDYILGSENAAMVTLDEVKQLPPLQEREQQSRGNSGGSRFGRGGGGRRFGGGGGRGGGGRGRGGGGRFNRR

SEQ ID NO: 5962 - protein, 696 aa, Avena sativa
MPSIAATAEPMAVDDSASKKAKRKQLKAAEAEAAAAAAASSGKKEKKEKKEKKRKAKEPSSSDEEGRSSTSSESEPAPKKAKKEKKAKKVEAEEEEGNDDGELTASGEDEPADPNALDNFRISEPLKHKLREKGIKALFPIQATTFSLLLDGNDLVGRARTGQGKTLAFVLPILESLVNGPHKATRRSDYGRPPSVLVLLPTRELANQVHADFECYGGAFGLSTCCAYGGSPYRPQEMAMRKGVDIVVGTPGRVKDLIVKGTLNLKSLKFRVLDEADEMLNMGFVDDVELILGKVDDVTKVQTLLFSATLPEWVKKLSMRFLKADKKTVDLVGNEKMKASASVRHLALPCNRAARQRVIPDIIRCYSHGGRTIIFTETKDSASELAGLIPGSRALHGDIAQAQREVVIAGFRSGKFLVLVATNVAARGLDINDVQLIIQCEPPKDVEAYIHRSGRTGRAGNTGIAVMLFEPRYKFGLTRIERESGVKFEHVSAPQPSDVAQSAGNEAAEAIASVSDSVIPVFRQQAEELLSSSSMSAVDLLAKALAKAVGYTDIKKRSLLSSMENCTTLQLTTGSSMYTPSYVISTLKRFMPEDRLSNVQGVALTTDGRGAVFDVPSAEVQDYLLGAENAAGVTLDEVKELPALQEREQQSRGGGSRWGGGGGGRGGGGRRFGGGGGGRGGFGGRGRGGGGRFGRR

SEQ ID NO: 5963 - protein, 710 aa, Zea mays
MSPALAAAVEPMAVDDSASKKAKRKQLKAAAAAAAAEAEEEAASAKKKEKKEKKRKAKEPSPPLPSAASSGEEKSSTSSEETAPTAKKAKKDKTKKNVEVSSSASDDDGEITAGSDEDPADPNALTNFRISEPLRQSLRSKGIKALFPIQATTFDLVLDGSDLVGRARTGQGKTLAFVLPILESLVNGANKASRRTEHGRTPSVLVLLPTRELANQVHADFEFYGATFGLSACCVYGGSPYRPQEMALRRGVDIVVGTPGRIKDFIVKGTLNLKCLKFRVLDEADEMLNMGFVDDVELILGKVEDATKVQTLLFSATLPDWVNKLSMRFLKVDRKTVDLVGNEKLKASASVKHLALPCNKAARAQLIPDIIRCYSHGGRTIIFTETKDSASELSGLIPGSRALHGDVVQAQREVILAGFRSGKFQVLVATNVAARGLDINDVQLIIQCEPPRDVEAYIHRSGRTGRAGNTGVAVMLYEPRYKYSVSRLERESGVKFEHISAPQPTDVAQSAGSEAADAIASVSDSVIPVFRQQAEQLLSSSTLSAADLLAKALAKAVGYTDIKKRSLLSSMEDYATLHLQTGRQMWSPGFAFTILKRFMPEEKLADVKGATLTADGTGVVFDVPAADVEDYIQASENAAQVTIDEVQQLPPLQEKQQQQSRGNSGGGRFGRGGGGRFSGGGRGGGFGGGGRGRGGGGGRGGGGNRFNRRN

SEQ ID NO: 5964 - protein, 696 aa, Oryza sativa
MPSLPVAAAEPMAVDESASKKSKRKLKAAEVEVEASSRKKEKKEKKRKAKEPSPSSSSSSEEEERSSTSSDEPAPAAKKAKKEKTKEKVVVEEEEEDDDEGELTASGDEDPADPNALANFRISESLREKLKSKGIKALFPIQATTFDLVLDGHDLVGRARTGQGKTLAFVLPILESLVNGTHKASRRTDYGRPPTVLVLLPTRELAKQVHTDFAFYGATFGLSACCVYGGSDYRSQEMAIRKGVDIVVGTPGRVKDFVEKGTLNFRSLKFRVLDEADEMLNMGFVDDVELILGKVEDVTKVQTLLFSATIPEWVKKLSLRFLKSGKKTVDLVGDEKLKASASVRHLALPCNRAARAQVIPDIIRCYSRGGRTIIFTETKESASDLSGLIAGSRALHGDVAQAQREVILAGFRSGKFLVLVATNVAARGLDINDVQLIIQCEPPRDVEAYIHRSGRTGRAGNTGVAVMLFEPRYKFNVNRIERESGVKFEHISAPQPTDVAQSAGTEAAEAISSVSDSVIPVFREQAEQLLNSSGMSAVDLLAKALAKAVGYTDIKKRSLLSSMDNHTTLLLQTGRSVYAAGFVLSTLKRFMPEERLADVKGITITADGTGAVFDVPSAEVEDYIQGAQNAAMVTVEEVKQLPPLQEREQSGGSRGGGRFGNRRFSGGGGGRGGGGRGFGGGRGRGGGGGNRFNKRY

SEQ ID NO: 5965 - protein, 711 aa, Sorghum bicolor
MSPALASAVEPMAVDDSASKKAKRKQLKAAAAAAEAEAEAASAKKKEKKEKKRKAKEPSPPPPSASSSDEEEKSSTSSEETAPAAKKAKKEKTKKNVEVSSSASDDDGEITASSDEDPADPNALTNFRISEPLRQSLRSKGIKALFPIQATTFDLVLDGNDLVGRARTGQGKTLAFVLPILESLVNGAHKASRRTEHGRTPSVIVLLPTRELANQVHADFEFYGATFGLSACCVYGGSPYRPQEMALRRGVDIVVGTPGRVKDFIVKGTLNLKNLKFRVLDEADEMLNMGFVDDVELILGKVEDATKVQTLLFSATLPDWVNKLSMRFLKVDRKTVDLVGNEKLKASASVKHLALPCNKAARAQVIPDIIRCYSHGGRTIIFTETKDSASELSGLIPGSRALHGDVVQAQREVILAGFRGGKFQVLVATNVAARGLDINDVQLIIQCEPPRDVEAYIHRSGRTGRAGNTGVAVMLYEPRYKYSVNRLERESGVKFEHISAPQPTDVAQSAGSEAADAISSVSDSVIPVFRQQAEQLLSSSSLSAADLLAKALAKAVGYTDIKKRSLLSSMEDYTTLHLQTGRPMWSPGFAFTILKRFMPEEKLADVKGATLTADGTGVVFDVPAADVEDYIQASENAAQVTIDEVKQLPPLQEKEQSRGNSGGGRFGRGGGGRFSGGGRGGGFGGGGRGRGGGGRGFSGRGGGGNRFNRRN

SEQ ID NO: 5966 - protein, 707 aa, Zea mays
MSPALAAGVEPMAVDDSASKKAKRKQLKAAAAAAEAEAEAASVKKKEKKEKKRKVKEPSPPLPSAASSDEEEKSSTSSEETAPAAKKAKEKTKKNVDVSSSASDDDGEITASSDEDPADPNALTNFRISESLRQSLRSKGIKSLFPIQATTFDLVLDGSDLVGRARTGQGKTLAFVLPILESLVNGANKASRRTEHGRTPSVLVLLPTRELANQVHADFEFYGATFGLSACCVYGGSPYRPQEMALRRGVDIVVGTPGRVKDFIVKGTLNLKCLKFRVLDEADEMLNMGFVDDVELILGKVEDATKVQTLLFSATLPEWVNKLSMRFLKVDRKTVDLVGNEKLKASASVKHLALPCNKAARAQVIPDIIRCYSHGGRTIIFTETKDSASELSGLIHGSRALHGDVAQAQREVILAGFRSGKFQVLVATNVAARGLDINDVQLIIQCEPPRDVEAYIHRSGRTGRAGNTGVAVMLYEPRYKHSVSRLERESGVKFEHISAPQPTDVAQSAGSEAADAIASVSDSVIPIFRQQAEQLLSSSSLSAADLLAKALAKAVGYTDIKKRSLLSSLEDYSTLHLQTGRPMWSPGFAFTILKRFMPEDKLADVKGATLTADGTGVVFDVPAADVEDYIQASESAAQVTIDEVKQLPPLQEKDQSRGNSGGGRFGHGGGRRFSGGGGGGRGFSGRGGGGRGFSGRGGGGSRFNRRN

SEQ ID NO: 5967 - protein, 712 aa, Saccharum officinarum
MSPALAAAVEPTAVDDSASKKAKRKQLKVAAAAAAEAEAEAASAKKKEKKEKKRKAKEPSPPPPSASSSDEEEKSSTSSEETAPAPKKAKKEKTKKNAEVSSSASDDDGEITASSDEDPADPNALTNFRISEPLRQSLRSKGIKALFPIQATTFDLVLDGSDLVGRARTGQGKTLAFVLPILESLVNGANKASRRTEHGRTPSVLVLLPTRELANQVHADFEFYGATFELSACCVYGGSPYRPQEMALRRGVDIVVGTPGRVKDFIVKGTLNLKSLKFRVLDEADEMLNMGFVDDVELILGKVEDATKVQTLLFSATLPDWVNKLSMRFLKVDRKTVDLVGNEKLKASASVKHLALPCNKAARAQVIPDIIRCYSHGGRTIIFTETKDSASELSGLIPGSRALHGDVVQAQREVILAGFRSGKFQVLVATNVAARGLDINDVQLIIQCEPPRDVEAYIHRSGRTGRAGNTGVAVMLYEPRYKHSVSRLERESGVKFEHISAPQPTDVAQSAGSEAADAIASVSDSVIPVFRQQAEQLLSSSSLSAADLLAKALAKAVGYTDIKKRSLLSSMEDYTTLHLQTGRPMWSPGFAFTILKRFMPEEKLADVKGATLTADGTGVVFDVPAADVEDYIQASENAAQVTIDEVKQMPPLQEKEQSRGNSGGGRFGRGGGGRYSGGGRGGGFGGGGRGRGGGGRGFSGRGGGGNRFNRRN

SEQ ID NO: 5968 - protein, 649 aa, Panicum virgatum
SPSSDEEEKSSTSSEETAPAAKKSKKEMAKKTVEASSPASEDDGEVTASSDEDPADPNALTNFRISEPLRQRLKSKGIKALFPIQATTFDLVLDGSDLVGRARTGQGKTLAFVLPILESLVNGTHKATRKTDYGRPPSVLVLLPTRELANQVHADFEFYGATYGLSACCVYGGSPYRPQEMALRKGVDIVVGTPGRVKDFIVKGTLNLKCLKFRVLDEADEMLNMGFVDDVELILGKVEDVTKVQTLLFSATLPDWVNKLSMRFLKGNRKTVDLVGNEKLKASASVKHLALPCNKAARAQVIPDIIRCYSHGGRTIIFTETKDSASELSGLIPGSRALHGDVVQAQREVILAGFRGGKFQVLVATNVAARGLDINDVQLIIQCEPPRDVEAYIHRSGRTGRAGNTGVAVMLYEPRYKHSVSRLERESGVQFEHISAPQPTDVAQSAGTEAADAIASVSDSVIPIFREQAEQLLSSSSLSAADLLAKALAKAVGYTDIKKRSLLSSMEDYTTLHLQTGRPMWSPGFAFTILKRFMPEEKLADVKGATLTADGTGVVFDVPAADVEDYIQASESAAQVTIDEVKQLPPLQEREQSRGNSGGGRFGRGGGSRFGGGGGRGGGSRFGGGGGRGGGGRGFSGRGGGGNRFNRRN

SEQ ID NO: 5969 - protein, 305 aa, Triticum aestivum
  misc_feature (14)..(14): Xaa can be any naturally occurring amino acid
TRPEREREREKRKXRQRERRLAEERREEAEQGRREGSPEGGHAPSASHISQLELRARAEAHEMRRKQNMQENGTIMIQFGQQVPNCESSASDSPQEVSGMSEGSFNEQNDQSGNRDGYTKSSDEGKMMSALSLGNSEMAYTPPKPDRTHPFAISYPYADPYYGGAVAAYGAHAIMHPQMVGMVPSSRVPLPIEPAAAEEPIYVNAKQYHAILRRRQLRAKLEAENKLVKSRKPYLHESRHQHAMKRARGTGGRFLNAKEKSEASGGGNASARSGHAGVPPDGGMFSKHDHTLPSGDFHYRARGGA

SEQ ID NO: 5970 - protein, 242 aa, Pseudoroegneria spicata
  misc_feature (19)..(20): Xaa can be any naturally occurring amino acid
  misc_feature (33)..(33): Xaa can be any naturally occurring amino acid
MRRKENMHENGTIMIQFGXXVPNCESSASDSPXEVSGMSEGSFNEQNDQSGTRDGYTKSDEGKMMSALSLGNSETAYTPPKPDRTHPFAISYPYADPYYGGAVAAYGAHAIMHPQMVGMVPSSRVPLPIEPAAAEEPIYVNAKQYHAILRRRQLRAKLEAENKLVKSRKPYLHESRHQHAMKRARGTGGRFLNAKEKSEASGGGTASARSGHAGVPTDSGMFSKHDHTLPSGDFHYRARGGA

SEQ ID NO: 5971 - protein, 242 aa, Avena sativa
MRRKENMHENGTIMIQFGHQVPTYDSSPSDSPREVSGMSEGSLNEQNGQSGNRNGYTKSDEGKMMSALSLGNTDTAYTQPKPDRAHPFAMPYPYGDPFYGGAVAAYGSHAIMHPQMVGMVPSARVPLPIEPAAAEEPIYVNAKQYHAILRRRQLRAKLEAENKLVKSRKPYLHESRHQHAMKRARGTGGRFLNAKEKSEASGGGASTRPGGHTGIPTNGGIFSKHDHTLSSGDFHYRARGGA

SEQ ID NO: 5972 - protein, 284 aa, Triticum aestivum
EEQVAEEAAAREEGSPEGGHAPSSSHISQLELRARVETHKMRRKQNMHENGTIMIQFGQQVPNCESSASDSPQEVSGMSEGSFNEQNDQSGNRDGYTKSDEGKMMSALSLGNSETAYTPPKPDRTHPFAISYPYADPYYGGAVAAYGTHAIMHPQMVGMVPSSRVPLPIEPAAAEEPIYVNAKQYHAILRRRQLRAKLEAENKLVKSRKPYLHESRHQHAMKRARGTGGRFLNAKEKSEAASGGGNASARSGHAGVPTDGGGMFSKHDHTLPSGDFHYRARGGA

SEQ ID NO: 5973 - protein, 239 aa, Brachypodium distachyon
MRRKEDMHENGTIMIQFGHQVPNYDSSASDSPQEVSGMSEGSHNEQNEQSGRRDGYTNSDEGKMMSALSLGNSETTYAQPKPDRTHPFAVAYPYADPFYGGAYGSHAVMHPQIVGMVPSSRVPLPIEQAAAEEPIYVNAKQYHAILRRRQLRAKLEAENKLVKSRKPYLHESRHLHAMKRARGTGGRFLNSKQQPEGSSGSDASTRAGHSGIPANGGMFSKHDHTLSSGDLQYRVRGGA

SEQ ID NO: 5974 - protein, 293 aa, Triticum aestivum
RERRLAEERRREEQVAEEAAAREEGSPEGGHAPSTSHISQLELRARVEAHEMRRKQNMHENGTIMIQFGQQVPNCESSASDSPQEVSGMSEGSFNEQNDQSGNRDGYTKSDEGKMMSALSLGNSETAYTPPKPDRTHPFAISYPYADPYYGGAVAAYGAHAIMHPQMVGMVPSSRVPLPIEPAAAEEPIYVNAKQYHAILRRRQLRAKLEAENKLVKSRKPYLHESRHQHAMKRARGTGGRFLNAKEKSEASGGGNASARPGYAGVPADGGMFSKHDHTLPSGDFHYRARGGA

SEQ ID NO: 5975 - protein, 80 aa, Triticum aestivum
LLSSTASPPSTDRVKSSPSAGTSTTMAGTANCIDIILAIILPPLGVFLKFGCGHEFWICLLLTFLGYIPGIIYAIYAITK

SEQ ID NO: 5976 - protein, 82 aa, Triticum aestivum
LCSALVFPLHPPPSEKALRPPGERSTTMAGTANCIDIILAIILPPLGVFLKFGCGHEFWICLLLTFLGYIPGIIYAIYAITK

SEQ ID NO: 5977 - protein, 69 aa, Triticum aestivum
LLPVVINSSKDRVPNIKFNVAKVLQSLVPILDQSTVKPCLVELSEDPDVDVRYYANQALQACDQIMMSS

SEQ ID NO: 5978 - protein, 54 aa, Leymus cinereus x Leymus triticoides
MGTANCIDIILAIILPPLGVFLKFGCGHEFWICLLLTFLGYIPGIIYAIYAITK

SEQ ID NO: 5979 - protein, 55 aa, Unknown
  Sequence found in Organisms: Oryza sativa, Triticum aestivum
MAGTANCIDILIAIILPPLGVFLKFGCGHEFWICLLLTFLGYIPGIIYAIYAITK

SEQ ID NO: 5980 - protein, 55 aa, Pseudoroegneria spicata
MAGTANCIDILIAIILPPLGVFLKFGCGHEFWICLLLTFLGFIPGIIYAIYAITK

SEQ ID NO: 5981 - protein, 55 aa, Tropaeolum majus
MAGTANCVDIILAIILPPLGVFLKFGCGKEFWICLLLTILGYIPGIIYAVYAITK

SEQ ID NO: 5982 - protein, 53 aa, Hordeum vulgare
MAGTAKCIHIILMIILPPLGVFLKFGCGHEFWICLLLTFLGYIPGIIYAIYAI

SEQ ID NO: 5983 - protein, 54 aa, Leymus cinereus x Leymus triticoides
MGTATCIDIIIAIILPPLGVFLKFGCGHEFWICLLLTFLGFIPGIIYAIYAITK

SEQ ID NO: 5984 - protein, 57 aa, Musa acuminata
MADEGTANCIDIILAIILPPLGVFLKFGCKAEFWICLLLTILGYIPGIIYAVYAITK

SEQ ID NO: 5985 - protein, 56 aa, Orobanche aegyptiaca
MADGTANCIDILVAILLPPLGVFLKFGCGVEFWICLLLTLLGYIPGIIYAIYAITK

SEQ ID NO: 5986 - protein, 54 aa, Linum usitatissimum
MGTANCIDIILAILLPPLGVFLKFGCQVEFWICLLLTILGYIPGIIYAIYAITK

SEQ ID NO: 5987 - protein, 55 aa, Pennisetum glaucum
MAGTANCIDILIAIILPPLGVFLKFGCKCEFWICLLLTLLGYLPGIIYAIYAITK

SEQ ID NO: 5988 - protein, 54 aa, Avena sativa
MGAATCIDIILAIILPPLGVFLKFGCGHEFWICLLLTFLGYLPGILYAIYAITK

SEQ ID NO: 5989 - protein, 53 aa, Panicum virgatum
MAANCIDILIAILLPPLGVFLKFGCGHEFWICLLLTFLGYIPGIIYAVYAITK

SEQ ID NO: 5990 - protein, 57 aa, Zingiber officinale
MADEGTANCIDIILAIILPPLGVFLKFGCQVEFWICLLLTLFGYIPGIIYAVYAITK

SEQ ID NO: 5991 - protein, 57 aa, Populus trichocarpa
MADEGTATCIDILLAIILPPLGVFLKFGCGVEFWICLLLTFFGYLPGIIYAIYAITK

SEQ ID NO: 5992 - protein, 57 aa, Populus trichocarpa
MADEGTANCIDILLAIILPPLGVFLKFGCGVEFWICLLLTLFGYLPGIIYAIYAITK

SEQ ID NO: 5993 - protein, 57 aa, Saccharum officinarum
MAEGTANCVDILIAIILPPLGVFLKFGCGHEFWICLLLTFLGYLPGIIYAVYAITKY

SEQ ID NO: 5994 - protein, 56 aa, Eragrostis curvula
MADGTANCVDILIAIILPPLGVFLKFGCGHEFWICLLLTFLGYLPGIIYAVYAITQ

SEQ ID NO: 5995 - protein, 56 aa, Saccharum officinarum
MAEGTANCVDILIAIILPPLGVFLKFGCGHQFWICLLLTFLGYLPGIIYAVYAITK

SEQ ID NO: 5996 - protein, 56 aa, Saccharum officinarum
MAEGAANCVDILIAIILPPLGVFLKFGCGHEFWICLLLTFLGYLPGIIYAVYAITK

SEQ ID NO: 5997 - protein, 56 aa, Panicum virgatum
MAEGTANCLDILIAILLPPLGVFLKHGCGHEFWICLLLTFLGYIPGIIYAVYAITK

SEQ ID NO: 5998 - protein, 56 aa, Panicum virgatum
MKAGTANCIDIIIAIILPPLGVFLKFGCKVEFWLCLLLTFLGYLPGIIYAIYAITK

SEQ ID NO: 5999 - protein, 54 aa, Triphysaria pusilla
MGTATCIDIILAIILPPLGVFLKFGCGVEFWICLILTLLGYLPGIIYAIYAITK

SEQ ID NO: 6000 - protein, 63 aa, Secale cereale
SPSDERSTMAGTANCIDIILAIILPPLGVFLKFGCGHEFWICLLLTFLGYIPGIIYAIYAITK

SEQ ID NO: 6001 - protein, 54 aa, Euphorbia esula
MGTANCVDIILAILLPPLGVFLKFGCNVEFWICLLLTILGYIPGIIYAIYAITK

SEQ ID NO: 6002 - protein, 66 aa, Brassica napus
MADEGSGSGSGSGTANCIDIVLAILLPPLGVFLKFGCHVEFWICLALTFLGYIPGIIYAIYAITKK

SEQ ID NO: 6003 - protein, 90 aa, Cryptomeria japonica
NSLVLCVLFCDFCALFSVLSSSVCLCCGIVIREIMREGTANCVDIILAIILPPLGVFLKFGCHAEFWICLLLTILGYLPGIIYAIYAITK

SEQ ID NO: 6004 - protein, 78 aa, Euphorbia esula
LLHFRNRIQKLHFRFLKFLESDKKMGTANCVDIILAIILPPLGVFLKFGCNVEFWICLLLTILGYIPGIIYAIYIITK

SEQ ID NO: 6005 - protein, 57 aa, Musa acuminata
MADKGTANCIDILLAIILPPLGVFLKFGCEMEFWICLLLTLFGYIPGIIYAVYAITK

SEQ ID NO: 6006 - protein, 55 aa, Eucalyptus gunnii
MSGTMNCIDIILAIILPPLGVFLKFGCQVEFWICLILTLFGWIPGIIYAIYAITK

SEQ ID NO: 6007 - protein, 54 aa, Liriodendron tulipifera
MAAANCVDIILAILLPPLGVFLKFGCKAEFWICLLLTILGYIPGIIYAVYAITK

SEQ ID NO: 6008 - protein, 54 aa, Lotus japonicus
MGTATCVDIILAIILPPLGVFLRFGCKVEFWICLLLTILGYIPGIIYAIYAITK

SEQ ID NO: 6009 - protein, 54 aa, Medicago truncatula
MGTATCIDIILAIILPPLGVFLKFGCNVEFWICLILTILGYLPGIIYAIYAITK

SEQ ID NO: 6010 - protein, 54 aa, Picea glauca
MGTANCVDILLAIILPPLGVFLKFGCHAEFWICLLLTLLGYLPGIIYAIYAITK

SEQ ID NO: 6011 - protein, 98 aa, Cryptomeria japonica
KLSQNLTPCLCKIFELLYWVLLFCFSVFLFVLWYYHRRIIMREGTANCIDIILAILLPPLGVFLKFGCHVEFWICLLLTILGYLPGIIYAIYTITKTP

SEQ ID NO: 6012 - protein, 88 aa, Cryptomeria japonica
CRESSVHFFVKSCLFCSVLCLCCGFVTREIMREGTANCVDIVLAIILPPLGVFLKFGCNVEFWICLLLTILGYLPGIIYAIYAITKTP

SEQ ID NO: 6013 - protein, 62 aa, Picea glauca
MREGTANCVDILLAIILPPLGVFLKFGCHAEFWICLLLTLLGYLPGIIYAIYAITKGDREWT

SEQ ID NO: 6014 - protein, 83 aa, Picea glauca
ELLFAFPECPFDEALGSNDRRILLSAYIAIMAANCLDILLAIILPPLGVFLKFGCNAEFWICLLLTILGYIPGIIYAVYAITK

SEQ ID NO: 6015 - protein, 58 aa, Citrus sinensis
MADEGTATCIDIILAIILPPLGVFLKFGCKVEFWICLLLTIFGYIPGIIYAVYAITKN

SEQ ID NO: 6016 - protein, 58 aa, Zea mays
MSEGTANCVDILIAIILPPLGVFLKYGCGHEFWICLLLTFLGYIPGIIYAIYAITKNN

SEQ ID NO: 6017 - protein, 57 aa, Musa acuminata
MADEGTANCIDILLAIILPPLGVFLKFGCQVEFWICLLLTLFGYLPGIIYAVYAITK

SEQ ID NO: 6018 - protein, 57 aa, Glycyrrhiza uralensis
MAREGTATCIDILLAIILPPLGVFLKFGCHVEFWICLVLTLFGYIPGIIYAIYAITK

SEQ ID NO: 6019 - protein, 55 aa, Salvia sclarea
MAAATCIDIIVAIILPPLGVFLKFGCKHEFWLCLLLTLLGYIPGIIYAVYAITKN

SEQ ID NO: 6020 - protein, 56 aa, Zea mays
MSDGTATCIDIILAIILPPLGVFFKFGCGVEFWICLILTFLGYLPGIIYAVWAITK

SEQ ID NO: 6021 - protein, 56 aa, Pennisetum glaucum
MSDGTANCIDIILAIILPPLGVFFKFGCGVEFWICLVLTFFGYLPGIIYAVWAITK

SEQ ID NO: 6022 - protein, 56 aa, Triticum aestivum
MSEGTANCVDILIAIILPPLGVFLKFGCGHQFWICLLLTFLGYLPGIIYAVYAITK

SEQ ID NO: 6023 - protein, 176 aa, Mimulus guttatus
MLNTDFGEGIARRTSSGRYVSYSHDDLDSELGSNDFLNYTVQMPPTPDNQPNNNTTGNNPGSAQKVEEQFVSNSLFTGGFNSITRAHLMDKVIDSSSDANSHHPLMGAAAAKGSSNNSKGKMGAATCIDIILAIILPPLGVFLKFGCKLEFWICLLLTIFGYLPGIIYAIYAITKD

SEQ ID NO: 6024 - protein, 56 aa, Tropaeolum majus
MASEGTLNVYRHPFGNHLASSWCFPQIWMPGGVLDLFGAYTFWLHPWNYICYLCHH

SEQ ID NO: 6025 - protein, 87 aa, Lactuca sativa
RGIFKYHYHSHPHPNPNTKRNRCPNRKRNTAKMGGTATCIDIILAIILPPLGVFFKFGCKVEFWICVLLTLFGWIPGIIYAIYAITK

SEQ ID NO: 6026 - protein, 62 aa, Arachis hypogaea
MADEGTGTATCIDILLAIILPPLGVFLKFGCKAEFWICLLLTILGYLPGIIYAVYAITKKNK

SEQ ID NO: 6027 - protein, 66 aa, Picea glauca
MKEGTANCVDIILAIILPPLGVFLKFGCHAEFWICLLLTILGYLPGIVYAIYAITQDNTRSSRAAV

SEQ ID NO: 6028 - protein, 59 aa, Picea glauca
MREGTANCVDIILAIILPPVGVFLKFGCHAEFWICLLLTILGYLPGIVYAIYAITKDNP

SEQ ID NO: 6029 - protein, 66 aa, Triticum aestivum
REGGGSSSSSREAMSANCVDILIAIILPPLGVFLKFGCGHQFWICLLLTFLGYLPGIIYAVYAITK

SEQ ID NO: 6030 - protein, 54 aa, Cicer arietinum
MGTATCVDIILAIILPPLGVFLKFGCNVEFWICLILTILGYLPGIIYAIYAITK

SEQ ID NO: 6031 - protein, 54 aa, Musa acuminata
MGTATCIDILVAIILPPLGVFLKFGCKVEFWLCLLLTILGYIPGIIYAIYAITK

SEQ ID NO: 6032 - protein, 54 aa, Populus trichocarpa
MSSTNFIDILLAIILPPLGVFLKFGCGAEFWICLLLTILGYIPGIIYAVYIITK

SEQ ID NO: 6033 - protein, 55 aa, Populus trichocarpa
MAGAVKCIDILIAIILPPLGVFLRFGCGVEFWICLLLTILGYIPGIIYAVYAITK

SEQ ID NO: 6034 - protein, 55 aa, Lactuca sativa
MGGTATCIDIILAIILPPLGVFFKFGCKVEFWICVLLTLFGWIPGIIYAIYAITK

SEQ ID NO: 6035 - protein, 57 aa, Cucumis sativus
MADEGTTNCIDILLAILLPPLGVFLKFGCQVEFWICLVLTFFGYIPGIIYAVYAITK

SEQ ID NO: 6036 - protein, 57 aa, Unknown
  Sequence found in Organisms: Hordeum vulgare, Triticum aestivum
MADEGTANCIDIILAIILPPLGVFFKFACGIEFWICLLLTFFGYLPGIIYAVWVITK

SEQ ID NO: 6037 - protein, 57 aa, Phaseolus coccineus
MADGSTATCIDILLAIILPPLGVFLKHGCKVEFWICLLLTILGYIPGIIYAVYAITK

SEQ ID NO: 6038 - protein, 57 aa, Fagus grandifolia
MASEGTANCIDIILAIILPPLGVFLKFGCQVEFWICLLLTLFGYLPGIIYAVWVITK

SEQ ID NO: 6039 - protein, 57 aa, Unknown
  Sequence found in Organisms: Castanea mollissima, Quercus alba
MADEGTATCIDILLAIILPPLGVFLKFGCQIEFWICLLLTLFGYLPGIIYAVYAITK

SEQ ID NO: 6040 - protein, 57 aa, Eucalyptus gunnii
MADEGTMNCIDIILAIILPPLGVFLKFGCQVEFWICLVLTLFGWIPGIIYAVYAITK

SEQ ID NO: 6041 - protein, 57 aa, Actinidia deliciosa
MSDESTANCIDIILAIILPPLGVFLKFGCKVEFWICLLLTLFGYIPGIIYAVYAITK

SEQ ID NO: 6042 - protein, 57 aa, Sorghum bicolor
MSEGTANCVDILIAIILPPLGVFLKFGCGHQFWICLLLTFLGYLPGIIYAVYAITKQ

SEQ ID NO: 6043 - protein, 57 aa, Glycine max
MADDSTATCIDIILAIILPPLGVFLKFGCNVEFWICLVLTLFGYIPGIIYAVYAITK

SEQ ID NO: 6044 - protein, 57 aa, Saccharum officinarum
  misc_feature (46)..(46): Xaa can be any naturally occurring amino acid
  misc_feature (56)..(57): Xaa can be any naturally occurring amino acid
MAEGTANCVDILIAIILPPLGVFLKFGCGHQFWICLLLTFLGYLPXIIYAVYAITXX

SEQ ID NO: 6045 - protein, 57 aa, Juglans hindsii x Juglans regia
MADEGTATCIDILLAIILPPLGVFLKFGCQVEFWICLLLTIFGYLPGIIYAVYAITK

SEQ ID NO: 6046 - protein, 98 aa, Triticum aestivum
LLHLPFSRSLFTSSPLPWLSLRRFEREREREREREREGRKKMADEGTANCIDIILAIILPPLGVFFKFACGIEFWICLLLTFFGYLPGIIYAVWVITK

SEQ ID NO: 6047 - protein, 90 aa, Triticum aestivum
LHSTYLSRPPCSHHPSPLAFRWTLREREGGRRKMADEGTANCIDIILAIILPPLGVFFKFACGIEFWICLLLTFFGYLPGIIYAVWVITK

SEQ ID NO: 6048 - protein, 56 aa, Linum usitatissimum
MKEGTANCVDIILAILLPPLGVFLKFGCHVEFWICLLLTIFGYLPGIIYAIYAITK

SEQ ID NO: 6049 - protein, 56 aa, Rhizophora mangle
MAEGAATCIDILLAILLPPLGVFLKYGCKVEFWICLLLTILGYIPGIIYAVYAITK

SEQ ID NO: 6050 - protein, 55 aa, Salvia sclarea
MGAATCLDIILAIILPPLGVFLKFGCKHEFWICLLLTLFGYIPGIIYAIYVITKD

SEQ ID NO: 6051 - protein, 56 aa, Bruguiera gymnorhiza
MAEGAATCVDILLAIILPPLGVFLKFGCKVEFWICLLLTILGYIPGIIYAVYVITK

SEQ ID NO: 6052 - protein, 56 aa, Catharanthus roseus
MSDGTATCLDILLAIILPPLGVFLKYGCQMEFWICLLLTILGYIPGIIYAVYAITK

SEQ ID NO: 6053 - protein, 56 aa, Cenchrus ciliaris
MSDGTANCIDIILAIILPPLGVFFKFGCGVEFWICLVLTFFGYLPGIIYAVWVITK

SEQ ID NO: 6054 - protein, 56 aa, Pennisetum glaucum
MSEGTANCVDILIAIILPPLGVFLKHGCGHEFWICLVLTFLGYLPGIIYAVYAITK

SEQ ID NO: 6055 - protein, 56 aa, Oryza sativa
MADSTATCIDIILAIILPPLGVFFKFGCGIEFWICLLLTFFGYLPGIIYAVWVITK

SEQ ID NO: 6056 - protein, 56 aa, Saccharum officinarum
MSDGTATCIDIILAIILPPLGVFFKFGCGVEFWICLILTFFGYLPGIIYAVWAITK

SEQ ID NO: 6057 - protein, 56 aa, Panicum virgatum
MSDGTATCIDIILAIILPPLGVFFKFGCGVEFWICLVLTFFGYLPGIIYAVWAITK

SEQ ID NO: 6058 - protein, 56 aa, Panicum virgatum
MSEGPANCIDILIAIILPPLGVFLKFGCKLEFWICLLLTFLGYLPGIIYAVYAITK

SEQ ID NO: 6059 - protein, 57 aa, Artemisia annua
MPSEGTLNCIDIILAIILPPLGVFFKFGCHVEFWICVLLTLFGWIPGIIYAIYAITK

SEQ ID NO: 6060 - protein, 57 aa, Unknown
  Sequence found in Organisms: Zea mays, Sorghum bicolor, Saccharum officinarum
MKEGTANCVDILIAIILPPLGVFLKFGCKVEFWLCLLLTFLAYLPGIIYAIYAITKD

SEQ ID NO: 6061 - protein, 76 aa, Artemisia annua
SQIIQILFEIQYPILNKKNMPSEGTLNCIDIILAIILPPLGVFFKFGCHVEFWICVLLTLFGWIPGIIYAIYAITK

SEQ ID NO: 6062 - protein, 89 aa, Festuca arundinacea
  misc_feature (7)..(7): Xaa can be any naturally occurring amino acid
HEAARGXTTSLSSLLFHLPSLACRFPLERREKMSDEGTANCIDIILAIILPPLGVFFKFACGIEFWICLLLTFFGYLPGIIYAVWVITK

SEQ ID NO: 6063 - protein, 57 aa, Zea mays
MKEGTANCIDILIAIILPPLGVFLKFGCKVEFWLCLLLTFLAYLPGIIYAIYVITKD

SEQ ID NO: 6064 - protein, 59 aa, Pinus taeda
MRDGTANCCDILLAILLPPLGVFFKYGCHAEFWICLLLTILGYIPGIIYAIYAITKQNP

SEQ ID NO: 6065 - protein, 81 aa, Oryza sativa
MFSFYRKTNDDITWNLNESGSYYANSAYLFQFQGSFSSIDFHSIWRCPAELKMRFFGWLILHQNSHGPKSFAPALALQLDL

SEQ ID NO: 6066 - protein, 57 aa, Fragaria vesca
MPSEGTANFIDIIIAILLPPLGVFLKFGCHVEFWICLLLTIFGYIPGIIYAIYVITK

SEQ ID NO: 6067 - protein, 72 aa, Triticum aestivum
VIIRAEGREREREREMKEGTANCIDILIAIILPPLGVFLKFGCKVEFWLCLLLTFLAYLPGIIYAIYVITKD

SEQ ID NO: 6068 - protein, 55 aa, Artemisia annua
MSGTANCVDIILAIILPPLGVFFKFGCQVQFWICLLLTLLGWIPGVIYAIYVITK

SEQ ID NO: 6069 - protein, 54 aa, Panax ginseng
MGTATCIDIILAIFLPPLGVFLKFGCKVEFWICLLLTILGYIPGILYALYVITK

SEQ ID NO: 6070 - protein, 53 aa, Unknown
  Sequence found in Organisms: Sorghum bicolor, Saccharum officinarum
MSANCVDILIAIILPPLGVFLKFGCGHQFWICLLLTFLGYLPGIIYAVYAITK

SEQ ID NO: 6071 - protein, 54 aa, Trifolium pratense
MGTATCVDIILAIILPPLGVFLRFGCKVEFWICLILTILGYLPGIIYAIYAITK

SEQ ID NO: 6072 - protein, 54 aa, Festuca arundinacea
MGAATCIDIILAIILPPLGVFLKFGCGIEFWICLLLTFLGYIPGILYALYVLTQ

SEQ ID NO: 6073 - protein, 54 aa, Lactuca sativa
MGTATCIDIILAIILPPLGVFFKFGCKVEFWICVLLTLFGWIPGIIYAIYAITK

SEQ ID NO: 6074 - protein, 59 aa, Juglans hindsii x Juglans regia
MVHEAGTATCVDIILAIILPPLGVFLKFGCKMEFWICLLLTILGYIPGIIYAVYAITKM

SEQ ID NO: 6075 - protein, 57 aa, Heritiera littoralis
MAEDGTATCIDILLAILLPPLGVFLKYGCKAEFWICLVLTLFGYIPGIIYAIYAITK

SEQ ID NO: 6076 - protein, 57 aa, Jatropha curcas
MPSEGTATCIDILLAVILPPLGVFLKFGCKAEFWICLLLTILGYIPGIIYAVYAITK

SEQ ID NO: 6077 - protein, 57 aa, Unknown
  Sequence found in Organisms: Brachypodium distachyon, Avena sativa
MADEGTANCIDIILAIILPPLGVFFKFACGIEFWICLLLTFFGYLPGIIYAVWVITR

SEQ ID NO: 6078 - protein, 57 aa, Hordeum vulgare
MADEGTANCIDIILAIILPPLGVFFKFACGIEFWICLLVTFFGYLPGIIYAVWVITK

SEQ ID NO: 6079 - protein, 57 aa, Manihot esculenta
MADEGTATCIDILLAILLPPLGVFLKYGCKAEFWICLVLTFFGYIPGIIYAVYAITK

SEQ ID NO: 6080 - protein, 58 aa, Citrus sinensis
MADGSTATCVDILLAVILPPLGVFLKFGCKAEFWICLLLTILGYIPGIIYAVYAITKK

SEQ ID NO: 6081 - protein, 95 aa, Gossypium hirsutum
GTHSPLATRTLSKNNPLPERNESLEFICLGLVKKEKKKMADDSTATCVDILLAIILPPLGVFLKFGCQVEFWICLVLTLFGYIPGIIYAIYAITK

SEQ ID NO: 6082 - protein, 57 aa, Vigna unguiculata
MAGDGTATCIDILLAIILPPLGVFLKYGCKVEFWICLVLTLFGYIPGIIYAVYAITK

SEQ ID NO: 6083 - protein, 57 aa, Vigna unguiculata
MAGDSTANCVDILIAIILPPLGVFLKYACKCEFWICLLLTILGYIPGIIYAVYAITK

SEQ ID NO: 6084 - protein, 57 aa, Cucumis melo
MADERTTNCIDILLAILLPPLGVFLKFGCQVEFWICLVLTFFGYIPGIIYAVYAITK

SEQ ID NO: 6085 - protein, 65 aa, Avena sativa
LGFPAREKMADEGTANCIDIILAIILPPLGVFFKFACGIEFWICLLLTFFGYLPGIIYAVWVITR

SEQ ID NO: 6086 - protein, 69 aa, Secale cereale
  misc_feature (63)..(63): Xaa can be any naturally occurring amino acid
PRVRSERQRRRKMADEGTANCIDIILAIILPPLGVFFKFACGIEFWICLLLTFFGYLPGIIYXVWVITK

SEQ ID NO: 6087 - protein, 56 aa, Gerbera hybrid cultivar
MSEGTANCVDIILAIILPPLGVFFKFGCHVEFWICLLLTLFGWIPGIIYAVYAITK

SEQ ID NO: 6088 - protein, 56 aa, Panax ginseng
MKEGTATFIDILLAIILPPLGVFLKFGCEVEFWICLLLTLFGYLPGIIYAIYAITK

SEQ ID NO: 6089 - protein, 56 aa, Tragopogon dubius
MSGGTATCIDIILAIILPPLGVFFKFGCQIEFWICVLLTLFGWIPGIIYAIYAITK

SEQ ID NO: 6090 - protein, 56 aa, Ricinus communis
MADGAATCIDILLAIILPPLGVFLKYGCKVEFWICLILTLFGYIPGIIYAVYAITK

SEQ ID NO: 6091 - protein, 56 aa, Nuphar advena
MSDNTANCVDILIAILLPPLGVFLKFGCQVEFWLCLLLTFLGYLPGIIYAIYAITK

SEQ ID NO: 6092 - protein, 56 aa, Arachis hypogaea
MAEGTATCIDILLAIILPPLGVFLKYGCHVEFWICLVLTLFGYLPGIIYAVYAITK

SEQ ID NO: 6093 - protein, 56 aa, Panicum virgatum
MSDGTATCLDIILAIILPPLGVFFKFGCGVEFWICLVLTFFGYLPGIIYAVWAITK

SEQ ID NO: 6094 - protein, 54 aa, Medicago truncatula
MGTATCVDIILAIILPPLGVFLKFGCNVEFWICLILTILGYLPGILYAIYVITK

SEQ ID NO: 6095 - protein, 59 aa, Pinus taeda
MREGTATCVDIFLAIVLPPLGVFFKYGCHAEFWICLLLTILGYIPGIIYAIYAITKENP

SEQ ID NO: 6096 - protein, 60 aa, Brassica oleracea
GSGSGSGTANCIDIVLAILLPPLGVFLKFGCHVEFWICLALTFLGYIPGIIYAIYAITKK

SEQ ID NO: 6097 - protein, 54 aa, Unknown
  Sequence found in Organisms: Centaurea maculosa, Lactuca sativa
MGTATFIDIILAIILPPLGVFFKFGCQVEFWICVLLTLFGWIPGIIYAIYAITK

SEQ ID NO: 6098 - protein, 60 aa, Castanea mollissima
MTAATCIDIILAIILPPLGVFLKFGCEVEFWICLLLTILGYLPGILYAIYIITKSPYRLS

SEQ ID NO: 6099 - protein, 55 aa, Lactuca sativa
  misc_feature (8)..(8): Xaa can be any naturally occurring amino acid
MGSTATCXDIILAIILPPLGVFFKFGCKVEFWICVLLTLFGWIPGIIYAIYAITK

SEQ ID NO: 6100 - protein, 59 aa, Eragrostis curvula
MSEGTANCIDILIAIVLPPLGVFLKFGCKVEFWLCLLLTLLAYLPGIIYAIYAITKTTE

SEQ ID NO: 6101 - protein, 57 aa, Eragrostis curvula
MSDSTATCIDIILAIILPPLGVFFKFGCGVEFWICLLLTFFGYLPGIIYAVWIITKQ

SEQ ID NO: 6102 - protein, 57 aa, Zea mays
MKEGTANWGDILMAIILPPLGVFLKFGCRVEFWLCLLLTFLAYLPGIIYAIYAITKD

SEQ ID NO: 6103 - protein, 90 aa, Pinus taeda
  misc_feature (33)..(33): Xaa can be any naturally occurring amino acid
FFGSLHTLTLFASLSWVSLHFSEKVVIISVIMXEGTATCVDIFLAIVLPPLGVFFKYGCHAEFWICLLLTILGYIPGIIYAIYAITKENP

SEQ ID NO: 6104 - protein, 56 aa, Pinus taeda
MKEGTANCVDIFLAIILPPLGVFFKFGCHAEFWICLLLTLLGYLPGIIYAVYAITQ

SEQ ID NO: 6105 - protein, 57 aa, Prunus persica
MPSEGTANFIDILIAILLPPLGVFLKFGCHVEFWICLLLTIFGYIPGIIYAVYAITK

SEQ ID NO: 6106 - protein, 57 aa, Prunus persica
MPSEGTANFVDILIAILLPPLGVFLKFGCHVEFWICLLLTFFGYIPGIIYAVYAITK

SEQ ID NO: 6107 - protein, 98 aa, Carthamus tinctorius
NINQINNPPSLWIWKHREAVLEEDGYSNLHRHNSGYHPSSPWRLLQVRLPGGVLDMRLVDLVWMDPWNYLRHLCHHQVILMVLQSHQMEMEMEMVAGG

SEQ ID NO: 6108 - protein, 54 aa, Picea glauca
MGTATCVDILLAIILPPLGVFLKFGCHAEFWICLLLTLLGYLPGILYAIYAITQ

SEQ ID NO: 6109 - protein, 57 aa, Helianthus annuus
MPSEGTLNCIDIILAIILPPLGVFFKFGCHVEFWICVLLTLFGWIPGVIYAIYAITK

SEQ ID NO: 6110 - protein, 57 aa, Helianthus annuus
MPSNGTLNFIDIILAIILPPLGVFLKFGCRVEFWICVLLTLLGWIPGIIYAVYVITK

SEQ ID NO: 6111 - protein, 56 aa, Panicum virgatum
  misc_feature (28)..(28): Xaa can be any naturally occurring amino acid
MKEGTANCVDILIAIILPPLGVLLKFGXKVEFWLCLLLTFLGYLPGIIYAIYAITK

SEQ ID NO: 6112 - protein, 518 aa, Hordeum vulgare
MRTPATTTLPCVLVLLVAVASRASAAAITKGDFPPGFVFGTGSSAYQIEGAVAEDGRKPSIWDTFTHSGYSADGATADVTADQYHKYKEDVKLLSEMGVDAYRFSIAWPRLIPDGRGAVNPKGLQYYNNLINELLSHGIQPHVTIYHFDFPQALQDEYHGMLSRKFIDDYTAYADVCFKNFGDRVKYWSTLNEPNIEPIGGYDVGFLPPRRCSSPFGISCDNGNSTTEPYIVAHHLLLAHASAASLYKEKYQAMQGGKIGLTLLGWWSEPATQTPEDIAAAARMNDFHIGWYMHPLVHGDYPPVMRKNVGSRLPSFTAEELKRVLGSFDFVGFNHYGAAYMKADLSKLDQKLRDYMGDAAVKYDTLPFLNSKNQLLFGLKTGFGSSTPWSMRKILEHLQVEYKNPVVMIHENGAASIADPSSGNAPDDEFRLQYLQDYIEATLQSSRNGSNVQGYFVWSFLDVFEYLFGYRMGFGLYSVDFSSMERTRYQRHSAKWFAGFLHGGELRPVALPGKAYSQ

SEQ ID NO: 6113 - protein, 521 aa, Triticum aestivum
MMAAAKALSSVLLLLLLVAVATPEAAAATITKRDFPPGFIFGTGSSAYQIEGAVAEDGRKPSIWDTFTHSGHSVDGSNADVTADQYHKYKEDVKLLSDMGVDAYRFSIAWPRLIPDGRGAVNPKGLEYYNNLINELLAHGIQPHVTIYHFDFPQALQDEYNGMLSRKFIDDYTAYAEVCFKNFGDRVKYWSTVNEPNIEPIGGYDQGILPPRRCSFPFGALSCDNGNSTTEPYIVAHHLLLAHASAASLYKEKYQAKQGGKLGLTLLCWWFEPATQTPEDIAAAARMNDFHIGWYMHPLVHRDYPPVMRKNVGSRLPSFTAEELKRVRGSFDFVGFNHYGAAYVKADLSKLDQKLRDYMGDAAVKYDTVPFLNSKNQLLFGLKMGFMSSTAWSMRKMLEHLQVKYKNPVVMIHENGAASIADPSGGNAPDDEFRSQYLQDYIEATLQSSRNGSNVQGYFVWSFLDVFEYLFGYRMGYGLYGVDFSSKERTRYQKHSAKWFAGFLHGGELRPAALPGKAYSQ

SEQ ID NO: 6114 - protein, 517 aa, Avena sativa
MRSAALSCAALLLLLAVASPAAAAAAITRGDFPPGFVFGTGSSAYQIEGAFDEDGRKPSIWDTFTHAGYSSDGSNADVTADQYHKYKEDVKLLSKMGVDAYRFSIAWPRLIPDGRGAVNPKGLEYYNNLIDELLSHGIQPHVTIYHFDFPQALQDEYSGMLSRKFIDDYTAYAEVCFKNFGDRVKYWSTVNEPNIEPIGGYDQGILPPRRCSFPFGTLSCDDGNSTTEPYIVAHHLLLAHASAATLYKEKYQATQGGKIGLTLLGWWYEPATQTPEDVAAAARMNDFHIGWYMHPLVHGDYPPVMRKNVGSRLPSFTTEELKRVRGSFDYVGFNHYIAVYVKADLSKLDQNLRDYMGDAAVTYDMPFLNSKNKLLFGLKTDFMTSTPWALKKMLEHLQVKYKNPVVMIHENGAASIRDPSGEINNDDDFRSQYIQDYIEAALESSRNGSNVQGYFVWSFLDVFEYLFGYQMGFGLYGVDFNTEERTRYERNSAKWYASFLRGGELRPVALPGKAYSQ

SEQ ID NO: 6115 - protein, 179 aa, Pseudoroegneria spicata
MSDAPASPPGGGGGGGGGSDDGGGGFGGVREQDRFLPIANISRIMKKAIPANGKIAKDAKETVQECVSEFISFITSEASDKCQREKRKTINGDDLLWAMATLGFEEYIEPLKVYLQKYRETEGDSKLAGKSGDVSVKKDALGPHGGASGTSAQGMGQQVAYNPGMVYMQPQYHNGDISN

SEQ ID NO: 6116 - protein, 182 aa, Triticum aestivum
MSDEAASPPGGGGGGGGGGSDDGGGGGGFGGVREQDRFLPIANISRIMKKAIPANGKIAKDAKETVQECVSEFISFITSEASDKCQREKRKTINGDDLLWAMATLGFEEYIEPLKVYLQKYRETEGDSKLAGKSGDVSVKKDALGPHGGASGTSAQGMGQQVAYNPGMVYMQPQYHNGDISN

SEQ ID NO: 6117 - protein, 182 aa, Brachypodium distachyon
MADAPASPGGGGGGGGSHDSGGSPRGGGYGGVREQDRFLPIANISRIMKKAIPANGKIAKDAKETVQECVSEFISFITSEASDKCQREKRKTINGDDLLWAMATLGFEDYIEPLKVYLQKYREMEGDSKLTSKSGDGSVKKDTLGPHTGTSSSSAQGMGQQVAYNQGMGYMQPQYHNGDISN

SEQ ID NO: 6118 - protein, 125 aa, Brachypodium distachyon
MADAPASPGGGGGGGGSHDSGGSPRGGGYGGVREQDRFLPIANISRIMKKAIPANGKIAKDAKETVQECVSEFISFITSEASDKCQREKRKTINGDDLLWAMATLGFEDYIEPLKVYLQKYRETG

SEQ ID NO: 6119 - protein, 180 aa, Panicum virgatum
MADAPASPGGGGGSHESGSPRGGAGGGGGGVREQDRFLPIANISRIMKKAIPANGKIAKDAKETVQECVSEFISFITSEASDKCQREKRKTINGDDLLWAMATLGFEDYIEPLKVYLQKYREMEGDSKLTAKAGDGSIKKDALGHGGASSSATQGMGQQGAYNQGMGYMQPQYHNGDISN

SEQ ID NO: 6120 - protein, 180 aa, Cenchrus ciliaris
MADAPASPGGGGGSHESGSPRGGGGGGGGGVREQDRFLPIANISRIMKKAIPANGKIAKDAKETVQECVSEFISFITSEASDKCQREKRKTINGDDLLWAMATLGFEDYIEPLKVYLQKYREMEGDSKLTAKAGDGSIKKDALGHGGAGSSATQGMGQQGAYNQGMGYMQPQYHNGNISN

SEQ ID NO: 6121 - protein, 180 aa, Sorghum bicolor
MADAPASPGGGGGSHESGSPRGGGGGGGGSVREQDRFLPIANISRIMKKAIPANGKIAKDAKETVQECVSEFISFITSEASDKCQREKRKTINGDDLLWAMATLGFEDYIEPLKVYLQKYREMEGDSKLTAKTGDGSIKKDALGHVGGSSSAAQGMGQQGAYNQGMGYMQPQYHNGDISN

SEQ ID NO: 6122 - protein, 178 aa, Zea mays
MAEAPASPGGGGGSHESGSPRGGGGGGSVREQDRFLPIANISRIMKKAIPANGKIAKDAKETVQECVSEFISFITSEASDKCQREKRKTINGDDLLWAMATLGFEDYIEPLKVYLQKYREMEGDSKLTAKSSDGSIKKDALGHVGASSSAAQGMGQQGAYNQGMGYMQPQYHNGDISN

SEQ ID NO: 6123 - protein, 180 aa, Sorghum bicolor
MADAPASPGGGGGSHESGSPRGGGGGGGGSVREQDRFLPIANISRIMKKAIPANGKIAKDAKETVQECVSEFISFITSEASDKCQREKRKTINGDDLLWAMATLGFEDYIEPLKVYLQKYREVQGDSKLTAKTGDGSIKKDALGHVGGSSSAAQGMGQQGAYNQGMGYMQPQYHNGDISN

SEQ ID NO: 6124 - protein, 180 aa, Zea mays
MADAPASPGGGGGSHESGSPRGGGGGGGGSVREQDRFLPIANISRIMKKAIPANGKIAKDAKETVQECVSEFISFITSEASDKCQREKRKTINGDDLLWAMATLGFEDYIEPLKVYLQKYREMEGDSKLTSKSSDGSIKKDALGHVGASSSAVQGMGQQGTYNQGMGYMQPQYHNGDISN

SEQ ID NO: 6125 - protein, 129 aa, Oryza sativa
MADGPGSPGGGGGSHESGSPRGGGGGGGGGGGGGGVREQDRFLPIANISRIMKKAIPANGKIAKDAKETVQECVSEFISFITSEASDKCQREKRKTINGDDLLWAMATLGFEDYIEPLKVYLQKYREVR

SEQ ID NO: 6126 - protein, 294 aa, Leymus cinereus x Leymus triticoides
  misc_feature (2)..(2): Xaa can be any naturally occurring amino acid
  misc_feature (30)..(30): Xaa can be any naturally occurring amino acid
MXGWREEVVALSLEAHGPGDDRPEKPRRYXVTEMRSPCYSFRPAHHALQEILDNLGPFVDGLKFSGGSHSLMGKELIREITDLAHKHDMYVSTGDWAEHLLRQGPSSFKQYVEDCKELGFDTIELNAGSLKLPEEAILRLVRLIKNTGLRAKPLFSVKFDSSDILASGDRAFGAYIAPVKQSSERVEDVDLLIRRAERCLEAGADMIMIDADDVCQRADSLRADIIAKIVGRLGLEKTMFETSNVNTSEWFVKRYGPRVNLFVDHSEVMNLERLRCFDGRRSVRPLLPSPFFLM

SEQ ID NO: 6127 - protein, 298 aa, Triticum aestivum
ERTTMRGWREEVVALSLEAHGPGDDRPEKPRRYGVTEMRSPCYSFRPAHHALQEILDNIGPFVDGLKFSGGSHSLMGKELIREITDLAHKHDMYVSTGDWAEHLLRQGPSSFKQYVEECKELGFDTIELNAGSLKLPEEAILRLVRLIKNNGLRAKPLFSVKFDSSDIPAAGDRAFGAYIAPVKQSSERVEDIDLLIRRAERCLEAGADMIMIDTDDVCQRADSLRADVIAKIVGRLGLERTMFETSGANTSEWFVKRYGPRVNLFADHSEVMNLERLRGLDVRRSVRPLLPSPFFLM

SEQ ID NO: 6128 - protein, 289 aa, Pseudoroegneria spicata
  misc_feature (278)..(279): Xaa can be any naturally occurring amino acid
  misc_feature (282)..(283): Xaa can be any naturally occurring amino acid
WREEVVALSLEAHGPGDDRPEKPRRYGVTEMRSPCYSFRPAHHALQEILDNIGPFVDGLKFSGGSHSLMGKELIREITDLAHKHDMYVSTGDWAEHLLRQGPSSFKQYVEECKELGFDTIELNAGSLKLPEEAILRLVRLIKNTGLRAKPLFSVKFDSSDIPAAGDRAFGAYIAPVKQSSERVEDVDLLIRRAERCLEAGADMIMIDADDVCQRADSLRADIIAKIVGRLGLERTMFETSGANTSEWFVKRYGPRVNLFADHSEVMNLERLRGFDVRXXPLXXSPFFLM

SEQ ID NO: 6129 - protein, 302 aa, Triticum aestivum
KRERERETMRGWREEVVALSLEAHGPGDDRPEKPRRYGVTEMRSPCYTFRPAHHALQEILDNIGPFVDGLKFSGGSHSLMGKELIREITDLAHKHDMYVSTGDWAEHLLRQGPSSFKQYVEECKELGFDTIELNAGSLKLPEEAILRLVRLIKNTGLRAKPLFSVKFDSSDIPAAGDRAFGAYIAPVKQSSERVEDIDLLIRRAERCLEAGADMIMIDADDVCQHADSLRADLIAKIVGRLGLERTMFETSGANTSEWFVKRYGPRVNLFADHSEVMNLERLRGLDVRRSVRPLLPSPFFLM

SEQ ID NO: 6130 - protein, 316 aa, Triticum aestivum
  misc_feature (4)..(4): Xaa can be any naturally occurring amino acid
RNSXPAAEERERERERERRSTTMRGWREEVVALSLEAHGPGDDRPEKPRRYGVTEMRSPCYSFRPAHHALQEILDNIGPFVDGLKFSGGSHSLMGKELIREITNLAHKHDMYVSTGDWAEHLLRQGPSSFKQYVEECKELGFDTIELNAGSLKLPEEAILRLVRLIKNTGLRAKPLFSVKFDSSDIPAAGDRAFGAYIAPVKQSSERVEDIDLLIRRAERCLEAGADMIMIDADDVCQRADSLRADIIAKIVGRLGLERTMFETSGANTSEWFVKRYGPRVNLFVDHSEVMNLERLRGLDVRRSVRPLLPSPFFLM

SEQ ID NO: 6131 - protein, 299 aa, Brachypodium distachyon
MRRWREEVVALSLQGHGYGHGDEADDRPEKPRRYGVTEMRSPYYSFRSAHHALQEILDSIGPFVDGLKFSGGSHSLMGKELIREITDLAHKHDMYVSTGDWAEHLLRQGPSSFKQYVQECKELGFDTVELNAGSLKLPEEAILRLVRLIKNSGLRAKPLFSVKFDSSDIPASGDRAFGAYTVPVKQTSERVEDVDLLIRRAERCLEAGADMIMIDADDVCQRADSLRADVIAKIVGRLGLDKTMFETSNANTSEWFVKRYSPRVNLFVDHSEVMNLERLRGFDMRRSSPSLLTSPFFLM

SEQ ID NO: 6132 - protein, 299 aa, Brachypodium distachyon
MRRWREEVVALSLQGHGYGHGDEADDRPEKPRRYGVTEMRSPYYSFRSGHHALQEILDSIGPFVDGLKFSGGSHSLMGKELIREITDLAHKHDMYVSTGDWAEHLLRQGPSSFKQYVQECKELGFDTVELNAGSLKLPEEAILRLVRLIKNSGLRAKPLFSVKFDSSDIPASGDRAFGAYTVPVKQTSERVEDVDLLIRRAERCLEAGADMIMIDADDVCQRADSLRADVIAKIVGRLGLDKTMFETSNANTSEWFVKRYSPRVNLFVDHSEVMNLERLRGFDMRRSSPSLLTSPFFLM

SEQ ID NO: 6133 - protein, 297 aa, Panicum virgatum
MRGWREEVVALSLRGYGNEEDDRPEKPRRYGVTEMRSPFYSLRPANQALQEILDSLGPFVDSLKFSGGCYSLMGKELIREITDLAHKHDIYVSTGDWAEHLLRQGPSSFKQYVEECKALGFDTIELNAGSLKLPEESLLRLVRLIKSSGLRAKPLFSVKFDSSDIPASGDRAFGAYIAPVKERSSERIEDVDLLIRRAERCLEAGADMIMIDADDVCQHADSLRADIVAKIIGRLGLEKTMFEASNPSTSEWFVKRYGPRVNLFVDHSDVMNLERLRGFNMRRSNPSSRFASPFFLM

SEQ ID NO: 6134 - protein, 299 aa, Panicum virgatum
MRRWREEVVALSLRGYGYGNEDDDRPEKPRRYGVTEMRSPFYSFRPANQALQEILDSLGPFVDGLKFSGGCHSLMGKELVREITDLAHKHDIYVSTGDWAEHLLRQGPSSFKQYVEECKALGFDTIELNAGSLKLPEEALLRLVRLIKSSGLRAKPLFSVKFDSSDIPASGDRAFGAYIAPVKERTSERIEDVDLLIRRAERCLEAGADMIMIDADDVCQHADSLRADIVAKIIGRLGLEKTMFEASNPSTSEWFVKRYGPRVNLFVDHSDVMDLERLRGFNMLRSNPSSRFASPFFLM

SEQ ID NO: 6135 - protein, 299 aa, Zea mays
MMGWGEEVVALSLRGYGYGNEEDDRPEKPRRYGVTEMRSPFYSFRPANQALQEILDSLSPFVDGLKFSGGCHSLMGKELVREITDLAHRHDIYVSTGDWAEHLLRQGPSSFKQYVEECKALGFDTIELNAGSLNLPEEALLRLVRLIKSSGLRAKPMFSVKFDSSDIPASGDRAFGAYIAPVKGKTSERVEDVDLLIRRAERCLEAGADMIMIDADDVCQRAESLRTDIIAKIVGRLGLDKTMFEASNSNTSEWFVRRYGPRVNLFVEHSDVMNLERLRGFNMRRSNSASRFASPFFLI

SEQ ID NO: 6136 - protein, 301 aa, Sorghum bicolor
MRGWREEVEVVALSLRGYGYGNEEDDRPEKPRRYGVTEMRSPFYSFRPANQALQEILDSLGPFVDGLKFSGGCHSLMGKDLVREITDLAHKHDIYVSTGDWAEHLLRQGPSSFKQYVEECKALGFDTIELNPGSLNLPEEALLRLVRLIKSSGLRAKPMFSVKFDSSDIPASGDRAFGAYIAPVKEKTSERVEDVDLLIRRAERCLEAGADMIMIDADDVCQHAESLRTDIIAKIVGRLGLDKTMFEASNPKTSEWFVRRYGPRVNLFVDHSDVMNLERLRGFNMLRSNLGSHVASPFFLM

SEQ ID NO: 6137 - protein, 299 aa, Saccharum officinarum
MRGWREEVEVVALSLRGYGNEEDDRPEKPRRYGVTEMRSPFYSFRPANQALQEILDSVSPFVDGLKFSGGCHSLMGKELVREITDLAHKHDIYVSTGDWAEHLLRQGPSSFKQYVEECKALGFDTIELNAGSLNLPEEALLRLVRLIKSSGLRAKPMFSVKFDSSDIPASRDRAFGAYIAPVKEKTSERVEDVDLLIRRAERCLEAGADMIMIDADDVCQRADSLRTDIVAKIVGRLGLDKTMFEASNPNTSEWFVRQYGPRVNLFVDHSDVMNLEHLRGFNMGRSNLASRFASPFFLM

SEQ ID NO: 6138 - protein, 172 aa, Gossypium hirsutum
MAEALAPASPGGGSHESGEQSPKSNVREQDRFLPIANISRIMKKALPANGKIAKDAKETVQECVSEFISFITSEASDKCQREKRKTINGDDLLWAMATLGFEDYIDPLKIYLSRYREMEGDAKGSAKGGDASAKKDVQPGPNGQLVHQGSFSQGVNYGNSQAHLMLPMQGTD

SEQ ID NO: 6139 - protein, 170 aa, Trifolium pratense
  misc_feature (123)..(123): Xaa can be any naturally occurring amino acid
MSEAPASPGGGSHESGEHSPRSNIREQDRFLPIANISRIMKKALPANGKIAKDAKETVQECVSEFISFITSEASDKCQREKRKTINGDDLLWAMATLGFEDYIDPLKIYLTRYREMEGDTKGXAKGDTSAKKDVQQGSNPQLAHQGSFSQGVFYANAQGQHMMVPMQGPE

SEQ ID NO: 6140 - protein, 180 aa, Carica papaya
MAEQQAQGQGAPASPGGGSHESGDHSPRSNVREQDRYLPIANISRIMKKALPANGKIAKDAKETVQECVSEFISFITSEASDKCQREKRKTINGDDLLWAMVTLGFEDYIDPLKVYLTRYREMEGDTKGSAKGGDSSIKKDVQPSSNTQLAHQASFSQGVNYGNSQSQAQHLMVPMQGTE

SEQ ID NO: 6141 - protein, 171 aa, Phaseolus coccineus
MADGPSSPGGGSHESGEHSPRSNVREQDRYLPIANISRIMKKALPANGKIAKDAKETVQECVSEFISFITSEASDKCQREKRKTINGDDLLWAMATLGFEDYIDPLKIYLTRYREMEGDTKGSAKGGETSAKKDVQPNPNAQLAHQGSFSQGVSYTNSQGQHMMVPMQGPE

SEQ ID NO: 6142 - protein, 162 aa, Medicago truncatula
MSETPASPGGGSHESGEHSPRSNIREQDRFLPIANISRIMKKALPANGKIAKDAKETVQECVSEFISFITSEASDKCQREKRKTINGDDLLWAMATLGFEDYIDPLKIYLTRYREMRVILRALPRVETHLARKTFNKVLILSLFIKVLSHKVFPTQILRVNI

SEQ ID NO: 6143 - protein, 174 aa, Castanea mollissima
MAEVPTSPNGGSYDESGDQSPRSNVREQDRFLPIANISRIMKKALPANGKIAKDAKETVQECVSEFISFITSEASDKCQREKRKTINGDDLLWAMATLGFEDYIDPLKIYLARYREMEGDTKGSAKGGESSAKKDVQPSPNAQIAHQGSFSQGVNYATSQSQAQHLMIPMQGSD

SEQ ID NO: 6144 - protein, 173 aa, Cucumis melo
MADAPASPGGGSHESGEQSPRSNVREQDRFLPIANISRIMKKALPANGKIAKDAKETVQECVSEFISFITSEASDKCQREKRKTINGDDLLWAMATLGFEDYIDPLKTYLTKYRETEGDTKGSAKGGDGSAKKEAHPTPIPQMAHQGSFSQGVNYASSQSQAQHLMVPMQGTD

SEQ ID NO: 6145 - protein, 174 aa, Populus trichocarpa
MAAEAPASPGGGSHESGDQSPRSNSNVREQDRFLPIANISRIMKKALPANGKIAKDAKETVQECVSEFISFITSEASDKCQREKRKTINGDDLLWAMATLGFEDYIDPLKIYLSRYREGDTKGSAKTGDTSAKKDIHPGPNAQISHQGSFSQGVSYGNSNSQAPHMMVPMQSNE

SEQ ID NO: 6146 - protein, 172 aa, Cucumis sativus
MADAPASPGGGSHESGEQSPRSNVREQDRFLPIANISRIMKKALPANGKIAKDAKETVQECVSEFISFITSEASDKCQREKRKTINGDDLLWAMATLGFEDYIDPLKTYLTKYREVGDTKGSAKGGDGSAKKEAHPTPIPQMAHQGSFSQGVNYASSQSQAQHLMVPMQGTD

SEQ ID NO: 6147 - protein, 172 aa, Prunus persica
MAEAPGSPGGGSHESGGDQSPRSNVREQDRYLPIANISRIMKKALPANGKIAKDAKETVQECVSEFISFITSEASDKCQREKRKTINGDDLLWAMATLGFEDYIDPLKVYLTRYREMEGDTKGSGKGGDSSSKKDAQPSSNAQISRQGSFSQGGNYSNSQSQHMMVPMQGTE

SEQ ID NO: 6148 - protein, 176 aa, Populus trichocarpa
MAAEAPASPGGGSHESGDQSPRSNSNVREQDRFLPIANISRIMKKALPANGKIAKDAKETVQECVSEFISFITSEASDKCQREKRKTINGDDLLWAMATLGFEDYIDPLKIYLSRYREMEGDTKGSAKTGDTSAKKDIHPGPNAQISHQGSFSQGVSYGNSNSQAPHMMVPMQSNE

SEQ ID NO: 6149 - protein, 175 aa, Euphorbia esula
  misc_feature (3)..(3): Xaa can be any naturally occurring amino acid
MAXEAPPASPGGGSHDSGDLSPRSHGNVREQDRFLPIANISRIMKKALPANGKIAKDAKETVQECVSEFISFITSEASDKCQREKRKTINGDDLLWAMATLGFEDYIDPLKIYLTRYREMEGDTKGSAKGGETSLRKDVQQSPNVQMSYQGSFSQGVNHSNSQVQHMMVPMQGTE

SEQ ID NO: 6150 - protein, 172 aa, Lotus japonicus
MSDGPTSPGAGGSHDSGGDHSPRSNIREQDRYLPIANISRIMKKALPANGKIAKDAKETVQECVSEFISFITSEASDKCQREKRKTINGDDLLWAMATLGFEDYIDPLKIYLTRYREGDTKGSGAKGGDSSAKKDVQPSPNAQLAHQGSFSQSVSYTNSQGQHMMVQMQGPE

SEQ ID NO: 6151 - protein, 171 aa, Medicago truncatula
MSETPASPGGGSHESGEHSPRSNIREQDRFLPIANISRIMKKALPANGKIAKDAKETVQECVSEFISFITSEASDKCQREKRKTINGDDLLWAMATLGFEDYIDPLKIYLTRYREMEGDTKGSAKGGDTSGKKDVQQGSNPQLVHQGSFSQGVSYTNSQGQHMMVPMQGPE

SEQ ID NO: 6152 - protein, 171 aa, Glycine max
MADGPASPGGGSHESGDHSPRSNVREQDRYLPIANISRIMKKALPANGKIAKDAKETVQECVSEFISFITSEASDKCQREKRKTINGDDLLWAMATLGFEDYMDPLKIYLTRYREMEGDTKGSAKGGDSSAKRDVQPSPNAQLAHQGSFSQNVTYPNSQGQHMMVPMQGPE

SEQ ID NO: 6153 - protein, 169 aa, Glycine max
MADGPASPGGGSHESGEHSPRSNVREQDRYLPIANISRIMKKALPANGKIAKDAKETVQECVSEFISFITSEASDKCQREKRKTINGDDLLWAMATLGFEDYIDPLKIYLTRYREGDTKGSAKGGDSSSKKDVQPSPNAQLAHQGSFSQGVSYTISQGQHMMVPMQGPE

SEQ ID NO: 6154 - protein, 180 aa, Nicotiana tabacum
MADGQGSSRSPASPNGGGSHESGGDQSPRSNVREQDRFLPIANISRIMKKALPANGKIAKDAKETVQECVSEFISFITSEASDKCQREKRKTINGDDLLWAMATLGFEDYIEPLKVYLARYREMEGDTKGSAKTADGSAKRDGMQPSPSSQLAHQGSFSQGMNYGNSQGQHMMVPMQGTE

SEQ ID NO: 6155 - protein, 304 aa, Panicum virgatum
MLSAQTAASTSSSGVVVERERSVVVEQERRRQPVGEDEDEEEEEPEFRDIHALSPPPSQPPSYRRGRGESWGSAAGGSRHTSIRSVGSDTAPSEPFPTMSREFSAMVAAAATANAASANGAGSDAERDADAMGRIGEGEELEETNPLAIVPDSNPIPSPRRGPPTPGADAALAGTGAHGQGQAGVSVGQVKKEEVESKIAAWQIAEVAKVNNRFKREEVVINGWEGDQVEKASAWLKKYERKLEEKRAKAMEKAQNEVAKARRKAEEKRASAEARRGTKVARVLELANFMRAVGRAPSTKRSFF

SEQ ID NO: 6156 - protein, 302 aa, Saccharum officinarum
MGALDLHPEFASAQHGQAKLNVEEYAKGSLLSDGNYNTEKINGSNPDDYEKFEKGIMQYGCPHYRRRCRIRAPCCNEIFDCRHCHNETKNSIKIEKMKRHELPRHEVQQVVCSLCGTEQEVQQVCINCGVCMGKYFCGLCKLFDDDVSKQQYHCNGCGICRIGGQDNFFHCSKCGCCYSIALKNSHACVEGAMHHDCPICFEYLFESTNDVSVLPCGHTIHVKCLKEMEEHCQFACPLCSKSVCDMSKAWERLDMELATLSDSCDDKMVRILCNDCGAISEVQFHLIAHKCQNCKSYNTRQI

SEQ ID NO: 6157 - protein, 302 aa, Sorghum bicolor
MGALDLHLEFASAQHGQAKLNVEEYAKGSLLSDGNYNTEKINGSNPDEYEKFQKGIMQYGCPHYRRRCRIRAPCCNEVFDCRHCHNETKNSIKIDKMKRHELPRHEVQQVVCSLCGTEQEVQQVCINCGVCMGKYFCGLCKLFDDDVSKQQYHCNGCGICRIGGRENFFHCSKCGCCYSIALKNSHACVEGAMHHDCPICFEYLFESTNDVSVLPCGHTIHVKCLKEMEEHCQFACPLCSKSVCDMSKAWERLDMELATLSDSCDDKMVRILCNDCGAISDVQFHLIAHKCQNCKSYNTRQI

SEQ ID NO: 6158 - protein, 302 aa, Pennisetum glaucum
MVALDLHLESAAAQHGQAKFNVEEYAKGSCLSGGNYKEEKVDGPDADDYEKFEKGIMQYGCPHYRRRCRIRAPCCNEIFDCRHCHNEVKNSIKVDTMKRHELPRHEVQQVICSLCDTEQEVRQVCINCGVCMGKYFCGSCKLFDDDVSKQQYHCHGCGICRIGGRENFFHCSKCGCCYSVVLKNSHACVEGAMHHDCPICFEYLFESTNDVSVLPCGHTIHVKCLKEMEEHCQFACPLCSKSVCDMSKAWERLDMELATLSDSCDDKMVRILCNDCRAISEVQFHLIAHKCQNCKSYNTRQI

SEQ ID NO: 6159 - protein, 302 aa, Panicum virgatum
MGALDLHLESASAQHGQAKLNVEEYAKGSLESGGNYKKEKINGSDPDDFEKFEKGIMQYGCPHYRRRCRIRAPCCNEIFDCRHCHNEVKNSIKVDTMRRHELPRQEVQQVICSLCGTEQEVRQICINCGVCMGKYFCGLCKLFDDDVSKQQYHCNGCGICRIGGRENFFHCSKCGCCYSIVLKNSHACVEGAMHHDCPICFEYLFESTNDVSVLPCGHTIHVKCLKEMEEHCQFACPLCSKSVCDMSKAWERLDMELATLSDSYDDKMVRILCNDCGAISEVHFHLIAHKCQNCKSYNTRQI

SEQ ID NO: 6160 - protein, 302 aa, Panicum virgatum
MGALDLHLESASAQHGQAKLNVEEYTKGSLESGGNYKKEKINGSDPDDFEKFEKGIMQYGCRHYRRRCRIRAPCCNEIFDCRHCHNEVKNSIKVDTLRRHELPRQEVQQVICSLCGTEQEVRQVCINCGVCMGKYFCGLCKLFDDDVSKQQYHCNGCGICRIGGRENFFHCSKCGCCYSIVLKNSHACIEGAMHHDCPICFEYLFESTNDVSVLPCGHTIHVKCLKEMEEHCQFACPLCSKSVCDMSKAWERLDMELATLSDSYDDKMVRILCNDCGAISEVQFHLIAHKCQNCKSYNTRQI

SEQ ID NO: 6161 - protein, 300 aa, Zea mays
MGALDLHLDFASAQHGQAKLKEYAKSSLLSDGNYNTDKINGSNPDDYEKFEKGIMHYGCPHYRRRCRIRAPCCNEIFDCRHCHNETKNSIKIDKMKRHELPRHEVQQVVCSLCGTEQEVRQVCINCGVCMGKYFCGLCKLFDDDVSKQQYHCNGCGICRIGGRENFFHCSKCGCCYSIALKNSHACVEGAMHHDCPICFEYLFDSTNDVSVLPCGHTIHVKCLKEMEEHCQFACPLCSKSVCDMSKAWERLDMELATLSDSCDHKMVRILCNDCGAISDVQFHLIAHKCQNCKSYNTRQI

SEQ ID NO: 6162 - protein, 296 aa, Brachypodium distachyon
MGAMDVQLESVAKLNVEVLAQGSLLFDGNHTAQKINGFNTDDRERFEKGSMKYGCAHYRRRCRIRAPCCNEIFDCRHCHNEAKNSIGIDTMRRHEIPRHEVQQVICSLCGTEQEVRQICINCGVCMGKYFCEVCKLFDDDVSKQQYHCHGCGICRIGGRENFFHCSKCGCCYSTVLKNSHSCVEGAMHHDCPICFEYLFESTNDVSVLPCGHTIHENCLKEMEEHCQFSCPLCSKSVCDMSKAWERLDMELASLSDSCDNKMVRILCNDCGAVSEVQFHLIAHKCQNCKSYNTRQI

SEQ ID NO: 6163 - protein, 299 aa, Triticum aestivum
MGAVQLESVAAQHAQAKLNVESLPQGPSLFDGNDTARINGSESDEYEKFDKGLMQYGCAHYRRRCRIRAPCCNEIFDCRHCHNESKNSIKIDTPTRHELPRHELQQVICTLCGTEQEVRQVCINCGVCMGKYFCEVCKLFDDDVSKQQYHCHACGICRIGGRENFFHCSKCGCCYSKVLKNSHACVEGAMHHDCPICFEYLFESRNDVSVLPCGHTIHEKCLREMKEHCQFACPLCSKSVCDMSKAWERLDAELATLSNSFDDKMVRILCNDCGAVSEVQFHLIAHKCHNCKSYNTRQI

SEQ ID NO: 6164 - protein, 90 aa, Brachypodium distachyon
MGAMDVQLESVAKLNVEVLAQGSLCFGGNHTAQKINGFNTDDRERFEKGSMKYGCAHYRRRCRIRAHAVMRFLIAVTATMKRRIRLELIQ

SEQ ID NO: 6165 - protein, 299 aa, Triticum aestivum
MGAVQLESVAAQHAHAKLNVDSLPQGPSLFDGNDTARIDGSKSDEYERFEKGLMQYGCAHYRRRCRIRAPCCNEIFDCRHCHNESKNSIKIDTARRHELPRHELQQVICSLCGTEQEVQQTCISCGVCMGKYFCEVCKLFDDDVSKEQYHCHVCGICRIGGRENFFHCSKCGCCYSKVLKNSHACVEGAMHHDCPICFEYLFESRNDVSVLPCGHTIHEKCLKEMKEHCQFACPLCSKSVCDMSKAWERLDAELATLSNSFDDKMVRILCNDCGAVSEVQFHLIAHKCHNCKSYNTRQI

SEQ ID NO: 6166 - protein, 299 aa, Hordeum vulgare
MGAVQLESVAAQHAHAKLNMDSLPQGPSLFDGNDTARVNGSNSDEYERFEKGLMEYGCAHYRRRCRIRAPCCNDIFDCRHCHNESKNSIRIDTPRRHELPRHELQQVICSLCGTEQEVRQICISCGVCMGKYFCEVCKLFDDDVSKQQYHCHGCGICRIGGRENFFHCSKCGCCYSTVLKNSHACVEGAMHHDCPICFEYLFESRNDVSVLPCGHTIHEKCLKEMKEHCQFACPLCSKSVCDMSKAWERLDAELATLSNSFDDKMVRILCNDCGAVSEVQFHLIAHKCHSCKSYNTRQI

SEQ ID NO: 6167 - protein, 571 aa, Brachypodium distachyon
MNPYADNRYADPSSYRDRRSDLAAAPILAPPVPVAANPYAAYTPMPMPAPAGGDFSRFGQGGGRGYGGGMSYGGRGRGGFGGGPGGFRGGGRGGSNGRDGLDSLSLPKPDFRDLIPFEKSFYVECPAVQAMSDMEVAQYRQLRDITVEGREVPKPIRYFQEANFPDYCMQAILKSGFVEPTPIQSQGWPMALKGRDVIGIAETGSGKTLSYILPGLVHVGAQPRLEQGDGPIVLILAPTRELAVQIQEESTKFGSYSRTRSTCIYGGAPKGPQIRDLRRGVEIVIATPGRLIDMLEAGHTNLRRVTYLVLDEADRMLDMGFEPQIRKIVAQIRPDRQTLYWSATWPREVESLARQFLQNPYKVMIGTAELKANHSIQQIVEVISDHEKYPRLSKLLSDLMDGSRILIFFQTKKECDKVTRQLRMDGWPALSIHGDKAQSERDYVLSEFKSGKSPIMAATDVAARGLDVKDIKCVINFDFPTTIEDYIHRIGRTGRAGATGMAFTFFTHSNSKYSRNLVKILREAGQVVNPALEAMSKSANSMGGGSNFRSRGRGGFGNRSGSNSIPVRRRF

SEQ ID NO: 6168 - protein, 571 aa, Sorghum bicolor
MNPYDLRFADPSSYHDRRSDLAVAPTFAPPAPVAAVNPNPYAAAYPPVPVPVPAAPAGGDYQRYGQGGRGRGGGGRGGGGGYGGGGRGGGRGRDGLDSLALPKPDFRSLIPFEKNFYVECPSVQAMSEADVAQYRRLRDITVEGRDVPKPVRYFQEANFPDYCMQAIAKSGFVEPTPIQSQGWPMALKGRDLIGIAQTGSGKTLSYLLPGLVHVGAQPRLEQGDGPIVLILAPTRELAVQIQEESTKFGSYSRTRSTCVYGGAPKGPQIRDLRRGVEIVIATPGRLIDMLEAGHTNLRRVTYLVLDEADRMLDMGFEPQIRKIVAQIRPDRQTLYWSATWPREVEALARQFLQNPYKVTIGSPELKANHSIQQIVEVISDHEKYPRLSKLLSDLMDGSRILIFFQTKKDCDKITRQLRMDGWPALSIHGDKAQAERDYVLAEFKSGKSPIMAATDVAARGLDVKDIKCVINYDFPTTLEDYIHRIGRTGRAGASGTAFTFFTHANAKFSRNLVKILREAGQAVNPALESMSKSSNSGGGGNFRSRGRGGFGNRGHMSGSNTFPLGGGRRPY

SEQ ID NO: 6169 - protein, 571 aa, Zea mays
MNPYDLRFADPSSYHDRRSDLTVAPTFAPPAPVAAANLNPYAAAYPLPVPVPVPAAPAGGDYQRYGQGGRGRGGGGRGGGGGYGGGGRGGGRGRDGLDSLALPKPDFRSLIPFEKNFYVECPSVQAMSEADVAQYRRLRDITIEGRDVPKPVRYFQEANFPDYCMQAIAKSGFVEPTPIQSQGWPMALKGRDLIGIAQTGSGKTLSYLLPGLVHVGAQPRLEQGDGPIVLILAPTRELAVQIQEESTKFGSYSRTRSTCVYGGAPKGPQIRDLRRGVEIVIATPGRLIDMLEAGHTNLRRVTYLVLDEADRMLDMGFEPQIRKIVAQIRPDRQTLYWSATWPREVEALARQFLQNPYKVIIGSPELKANHSIQQIVEVISDHEKYPRLSKLLSDLMDGSRILIFFQTKKDCDKITRQLRMDGWPALSIHGDKAQAERDYVLAEFKSGKSPIMAATDVAARGLDVKDIKCVINYDFPTTLEDYIHRIGRTGRAGASGTAFTFFTHANAKFSRNLVKILREAGQVVNPALESMSRSSNSTGGGNFRSRGRGGFGNRGHMSGSNTFPLGGRRPY

SEQ ID NO: 6170 - protein, 356 aa, Panicum virgatum
MNPYDIRFADPSSYHDRRSDLAVAPIVAPPVLMPAVNNYAAAYPPVPAASAGVDYPRYGQGGRGRGGGGRGGGGFGGGGGGGYGGGRGARGRDGLDTLALPKPDFRSLIPFEKNFYVESPSVQAMSDAEVAQYRRLRDITVEGREVPKPVRYFQEANFPDYCMQAIAKSGFVEPTPIQSQGWPMALNGRDLIGIAQTGSGKTLSYLLPGLVHVGAQPRLEQGDGPIVLILAPTRELAVQIQEESTKFGSYSRTRSTCVYGGAPKGPQIRDLRRGVEIVIATPGRLIDLLEAGHTNLRRVTYLVLDEADRMLDMGFEPQIRKIVAQIRPDRQTLYWSATWPREVEALARQFLQNPSR

SEQ ID NO: 6171 - protein, 574 aa, Hordeum vulgare
MNPYADNRYADPSSYRDRRSDLAAAPILAPPVPVVAAQNPYAAPYTPMAAPVGGYGQGGGGYGGGMGYGGRGRGGGGGGPGGFRGGGGRGGSNGRDGLDSLSLPKPDFRGLIPFEKSFYVECPAVQAMSETEVAQYRQLRDITVEGREVPKPIRFFHEANFPDYCMQAIAKSGFVEPTPIQAQGWPMALKGRDVIGIAETGSGKTLSYILPGLVHVGAQPRLEQGDGPIVLILAPTRELAVQIQAEATKFGSYSRTRSTCIYGGAPKGPQIRDLRRGVEIVIATPGRLIDMLEAGHTNLRRVTYLVLDEADRMLDMGFEPQIRKILAQIRPDRQTLYWSATWPREVETLARQFLQNPYKVMIGTAELKANHSIQQIVEVISDHEKYPRLSKLLSDLMDGSRILIFFQTKKECDKVTRQLRMDGWPALSIHGDKAQSERDYVLAEFKNGKSPIMAATDVAARGLDVKDIKCVINFDFPTTIEDYIHRIGRTGRAGATGMAFTFFTHSNSKYSRNLVKILREAGQVVNPALEAMSKSAGSMGGGSNFRSRGRGGFGGGGYGGNRSGSNSIPVRRRY

SEQ ID NO: 6172 - protein, 573 aa, Avena sativa
MNPYADNRYADPSSYRDRRSDLAAAPILAPTVPVAAANPYAAPYTPIAASVGGYGGGGYGGGYSGGGYGGGTGYGGRGRGGGGGGPGGFRSGGRGGGNGRDGLDSISLQKPDFRGLIPFEKSFYVECPEVQAMSQMEVAQYRQLRDITVEGQDVPKPIRFFHEASFPDYCMQAIAKSGFVEPTPIQAQGWPMALKGRDVIGIAETGSGKTLSYILPGLVHVGAQPRLEQGDGPIVLILAPTRELAVQIQAEATKFGSYSRTRSTCIYGGAPKGPQIRDLRRGVEIVIATPGRLIDMLEAGHTNLRRVTYLVLDEADRMLDMGFEPQIRKILAQIRPDRQTLYWSATWPREVETLARQFLQNPYKVMIGTAELKANHSIQQNVEVISDHEKYPRLSKLLSDLMDGSRILIFFQTKKECDKVTRQLRMDGWPALSIHGDKAQSERDYVLAEFKSGKSPIMAATDVAARGLDVKDIKCVINFDFPTTIEDYIHRIGRTGRAGATGMAFTFFTHSNAKYSRNLVKILREAGQTVNPALESMSKNAGSMGGGGNFRSRGRGGFGNRSGSNSIPVRRRY

SEQ ID NO: 6173 - protein, 969 aa, Sorghum bicolor
MEQLRTIGRELAMGSQGGWGQSKEFLDLVKSIGEARSKAEEDRIIARELEHLKRRLADPDVPRRKMKELLLRLVYAEMLGHDASFGHIHAVKMTHDESLPLKRTGYLAVALFLDERHDLVILVVNTIQKDLRSDNYLVVCAALTAACRLIGEEAIPAVLPQVVELLAHPKEAVRKKAVMALHRFYQRSPSSVSHLVSNFRKRLCDNDPGVMGATLCPLYDLILEEPNSYKDLVVSFVNILKQVAERRLPTSYDYHQMPAPFIQIKLLKILAVLGSGDKQASGHMYTVLGDIFRKGDTASNIGNAILYECICCISSIFPNPKMLEAAAETTSKFLKSDSHNLKYMGIDALGRLIKINPDIAEEHQLAVIDCLEDPDDTLKRKTFELLYKMTKSTNVEVIVDRMIEYMINITDHHYKTEIASRCVELAEQFAPSNQWFIQTMNKVFEHAGDLVNIRVAHNLMRLIAEGFGEEDEGADSQLRSSAVDSYLRIVGEPKLPSSFLQIICWVLGEYGTADGKYSASYIIGKLCDVAEAHLTDDTVKAYAISAILKIFAFEIALGRKIDLLPECQTLVDELSASHSTDLQQRAYELQALLGLDKNAVESVMPADASCEDIEVDRNLSFLNSYVQQALENGASPYIPESERSGVISVGSYRSQEQQETSAHTLRFEAYEMPKPSLPLATSQTSISTPTTDLVPVPETGYYKEDHQTSRSQPPGDAVSGEFGVKLRLDGVQKKWGRPTYSSSTPSSSTSSQQTTNGTSHSDGGGSSSQPRESSYGSKRQQGTEVSAEKQRLAASLFGSAAAKADRKAQASRKTAKDSPSTEKVATTNVTAQPVKEQVIPAAPPPDLLDLGDEPVSSNPPLADPFSQLEGLLGPASAAPVLSGTPATGASKAPDLMSIFSDDVPTGVASGSTDPTLGDVNSTSSHKGATAVASKKGPSLQDALQKDATARQVGVTPTGNNPNLFKDLLG

SEQ ID NO: 6174 - protein, 971 aa, Brachypodium distachyon
MEQLRTIGRELAMGSQGGWGQSKEFLDLVKSIGEARSKAEEDRIISRELEHLKRRLADPDVPRRKMKELLLRLVYAEMLGHDASFGHIHAVKMTHDESLPLKRTGYLAVALFIDERHDLVILVVNTIQKDLRSDNYLVVCAALTAASRLIGEEAIPAVLPQVVDLLAHPKEAVRKKAVMALHRFYQRSPSSVSHLVSNFRKRLCDNDPGVMGATLCPLYDLILEDPSSYKDLVVSFVNILKQVAERRLPTSYDYHQMPAPFIQIKLLKILAVLGSGDKQASGHMYTVLGDIFRKGDTASNIGNAILYECICCISSIYPNSKIMDAAAETTSKFLKSDSHNLKYMGIDALGRLIKINPDIAEEHQLSVIDCLEDPDDTLKRKTFELLYKMTKSTNVEVIVDRMIEYMISITDHHYKAEIASRCVELAEQFAPSNQWFIQTMNKVFEHAGDLVNIRVAHNLMRLIAEGFGEEDEGADSQLRSSAVDSYLRILGEPKLPSSFLQIICWVLGEYGTADGKHPASYIIGKLCDVAEAHPTDDTVRGYAVSAILKIFAFEIAVGRKTDMLPEFQSLVDELSASHSTDLQQRAYEVQALLGLHKQAVESVMPSDASCEDIEVDRNLSFLNSYVQQALDKGAAPYIPESERSGVASVGNYRTHDQHETSAHTLRFEAYELPKPSLPTATSQTSISLPTTDLVPVPEQSYYKDDHQMSRPQPSGNALSGEFGTKLRLDGVQKKWGRESYSSSSTPSSSTSSQQAANGSTNSDGGGLVVSSQARESSYGSKRQQGTEVSAEKQRLAASLFGSSAAKADRKGHAGRKAAKESHSTDKVNVAHAAPQPAKDQVIPAVPPPDLLDLGEPVSSSAPSADPFSQLDGLLGPASASPVLSGTSAPSASSTPDLMSIFSDDVQTGSTSGSTDATVGDVHLKNSQKGATSVAAKKGHSLQDALQKDATARQVGVTPTGNNPNLFKDLLG

SEQ ID NO: 6175 - protein, 973 aa, Zea mays
MEQLRTIGRELAMGSQGGWGQSKEFLDLVKSIGEARSKAEEDRIIARELEHLKRRLADPDVPRRKMKELLLRLVYAEMLGHDASFGHIHAVKMTHDESLPLKRTGYLAVALFLDERHDLVILVVNTIQKDLRSDNYLVVCAALTAACRLIGEEAIPAVLPQVVELLAHPKEAVRKKAVMALHRFYQRSPSSVSHLVSNFRKRLCDNDPGVMGATLCPLYDLILEEPNSYKDLVVSFVNILKQVAERRLPTSYDYHQMPAPFCVCHLQIKLLKILAVLGSGDKQASGHMYTVLGDIFRKGDTASNIGNAILYECICCISFIFPNPKMLEAAAETTSKFLKSDSHNLKYMGIDALGRLIKINPDIAEEHQLAVIDCLEDPDDTLKRKTFELLYKMTKSTNVEVIVDRMIEYMINITDHHYKTEIASRCVELAEQFAPSNQWFIQTMNKVFEHAGDLVNIRVAHNLMRLIAEGFGEEDEGADSQLRSSAVDSYLRIVGEPKLPSSFLQIICWVLGEYGTADGKYSASYIIGKLCDVAEAHLTDDTVKAYAISAILKTFAFEITLGRKIDLLPECQTLVDELSASHSTDLQQRAYELQALLGLDKTAVESVMPADASCEDIEVDRSLSFLNSYVQQALENGASPYIPESERSGVISVGSYRSQEQQETSAHTLRFEAYEMPKPSLPLATSQTSMSTPPTDLVPVPEAGYYKEDNQTSMSQPPSDAISGEFGVKLRLDGVQKKWGRPTYSSSTPSSSISSQPTPNGASHSDGGGSSSQPRESSYGSKRQQGTEVSAEKQRLAASLFGSAAAKADRKAQASRKTAKDSPSTEKVATTNVTAQPVKEQVIPAAPPPDLLDLGDEPVSSSPPSADPFSQLEGLLGPASAAPVLSGTPATSTSKAPGLLSIFSDDVPTGVTSVSTDPTLGDVNSMGSRKGAAAVASMKGPSLQDALQKDAAARQVGVTPTVNNPNLFKDLLG

SEQ ID NO: 6176 - protein, 954 aa, Hordeum vulgare
MEQLRTIGRELAMGSQGGWGQSKEFLDLVKSIGEARSKAEEDRIISRELEHLKRRLADPDVPRRKMKELLLRLVYAEMLGHDASFGHIHAVKMTHDESLPLKRTGYLAVALFIDERHDLVILVVNTIQKDLRSDNYLVVCAALTAASRLIGEEAIPAVLPQVVDLLAHPKESVRKKAVMALHRFYQRSPSSVSHLVSNFRKRLCDNDPGVMGATLCPLYDLILEDPNAYKDLVVSFVNILKQVAERRLPTSYDYHQMPAPFIQIKLLKILAVLGSGDKSASGHMYTVLGDIFRKGDTASNIGNAILYECICCVSCIFPNSKMLDAAAETTSKFLKSDSHNLKYMGIDALGRLIKINADIAEQHQLAVIDCLEDPDDTLKRKTFELLYKMTKSTNVEVIVDRMIEYMISITDHHYKAEIASRCVELAEQFAPSNQWFIQTMNKVFEHAGDLVNIRVAHNLMRLIAEGFGEEDEGADSQLRSSAVNSYLRILGEPKLPSSFLQIICWVLGEYGTADGKHPASYIIGKLCDVAEAHPTDDTVRGYAVSAILKIFAFEIAVGRKSDMLPEFQSLVDELSSSHSTDLQQRAYEVQALLGLDKQAVESVMPIDASCEDIEVDRNLSFLNSYVQQALENGATPYIPGSERSGVVSVGNYRAQDQHETSAHALRFEAYELPKPSLPTATSQSSVSLPTTDLVPVPEPSHYREDHHQTRSQPSGNAVSGEFGAKLRLDGVQKKWGRESYASSSTPSSSASSQQPANGGSNSDGGGLVTSQARESSYGSKTQPGTEVSAEKQRLAASLFGSSAAKPNRKGHAGRKATKESSSTEKAAPQPAKEQVTPAAPPPDLLDLGEEPVSSSAPSADPFSQLDGLLGPASASPALAGTSAPSASNTPDLMSIFSDDVQTGATSASTEPAQKGATTKKGHSLQDALQKDATARQVGVTPTGNNPNLFKDLLG

SEQ ID NO: 6177 - protein, 374 aa, Brachypodium distachyon
MGSQGGWGQSKEFLDLVKSIGEARSKAEEDRIISRELEHLKRRLADPDVPRRKMKELLLRLVYAEMLGHDASFGHIHAVKMTHDESLPLKRTGYLAVALFIDERHDLVILVVNTIQKDLRSDNYLVVCAALTAASRLIGEEAIPAVLPQVVDLLAHPKEAVRKKAVMALHRFYQRSPSSVSHLVSNFRKRLCDNDPGVMGATLCPLYDLILEDPSSYKDLVVSFVNILKQVAERRLPTSYDYHQMPAPFIQIKLLKILAVLGSGDKQASGHMYTVLGDIFRKGDTASNIGNAILYECICCISSIYPNSKIMDAAAETTSKFLKSDSHNLKYMGIDALGRLIKINPDIAEEHQLSVIDCLEDPDDPSKRKSFDGF

SEQ ID NO: 6178 - protein, 973 aa, Zea mays
MEQLRTFGRELAMGSQGGWGQSKDFLDLVKSIGEARSKAEEDRIIARELEHLKRRLADPDVPRRKMKELLLRLVYAEMLGHDASFGHIHAVKMTHDESLPLKRTGYLAVALFLDERHDLVILVVNTIQKDLRSDNYLVVCAALTAACRLIGEEAIPAVLPQVVDLLVHPKEAVRKKAVMALHRFYQRSSSSVSHLVSNFRKRLCDNDPGVMGATLCPLYDLISEEPNSYKDLVVSFVNILKQVAERRLPTSYDYHQMPAPFIQIKLLKILAVLGSGDKQASGHMYTVLGDIFKKGDTASNIGNAILYECICCISSIFPNPKMLVAAAETTSKFLKSDSHNLKYMGIDALGRLIKINPDIAEEHQLAVIDCLEDPDDTLKRKTFELLYKMTKSTNVEVIVDRMIEYMINITDHHYKTEIASRCVELAEQFAPSNQWFIQTMNRVFEHAGDLVNIRVAHNLMRLIAEGFGDEDEGADSQLRSSAVDSYVRIVGEPKLPSSFLQIICWVLGEYGTADGKHSASYIIGKLCDVAEAHLTDDTVKAYAISAILKIFAFEIALGRRIDLLPECQTLVDELLASHSTDLQQRAYELHALLGLGKNDVESVMPADASCEDIEVDRNLSFLDSYVQQALENGASPYIPESERSGLTSVGSYRSQEQQETSARTLRFEAYEMPKPSLPLATSQTSMSTPNTDLVPVSEPGYYKEDHQTSRPQPPSDAVSGEFGVKLRLDGVHKKWGRPTYSSSTPSSSMSSQQTTNGASHSDGGGPSSQPRESSYGSKRQQGTEVSAEKQRLAASLFGSAAARADRKAQASRKTAKDSPSTEKVATTNVAAQSVKEQVIPAAAPPPDLLDLGDETVPSSRPSADPFSQLVGLLGPASAAPALSGTPATTTSTSKAPDLMSIFSDDVPTGVTSSGSTDPTPGDAISVSSHKGATAVAPKKGSSLQDALQKDSTARQVGVTPTGNNPNLFKDLLG

SEQ ID NO: 6179 - protein, 1803 aa, Brachypodium distachyon
MSPPLQAPDYKHVTEECLREWKGQPAAAAAFRVPDPVPMARFLYELCWAVVRGDLPPQKCRVALDSVEFVEEAQRGEVGSVLADIIAHLGQDVTISGEYRSRLVKMTKSFVESSLIAPRLLQERCEEEFLWEVELSKSKGQDLKAKEVRVNTRLLYQQTKFNLLREESEGYAKLVTLLCQIGSDLACQNSSSVTMSIIKSLIGHFDLDPNRVFDIVLECFELYPDNTIFCQLIPLFPKSHAAQILGFKFQYYQRLDVNSTVPPGLFRIAALLVKSGFIDLDSLYAHLLPNDDEAFEHFDSFVTRKIDEASNIGKINLAATGKDLMDDEKQEITIDLYTALEMENDIIDERAPEIEKNQKLGLLLGFLSVHDWDHAQLLFERLARLNPVEHVEICDSLFRLIERSISSVYDIIFQTHYKMPRNPVYMMDTSPSSSQSFSVDPPKEFFQMLSACGPYLHRNTQLFQKVCRVLKAYHLSAKESIRTAGVMSPDSRIEEALGSCLLPSLQLIPANPAVDMEIWGVLSLLPYETRYRLYGEWEKDTEQNPIVLAARQTAKLDTRRLLKRLAKENLKQLGRMVAKLAHANPMTVLRTIIQQVEAYRDMITPVVDAFKYLTQLEFDILQYIVIERLAQGGREKLKDDGLNLSDWLQCLASFWGHLCKKHLCMELKCLFQYIVNQLKKGLGTELVVLEELIQQMANVQYTENMTDEQVDAMAGSETLRLQASSLFGSTRNSKVLTKSTNKLRDSLLPKEEPKLAIPLLLLIAQHRSKIIINADATYIKMVSEQFDRCHGILLQYVEFLSTAVTPTTYVQLIPPLEDLINKYHIEPDVAFLIYRPVMRLFKSTNGGDTYWPLDDNEEGESVSCDDLILHPDTSHKSIISVDIIRMKKVKARQWMTLGSLEGWWSDLLSTVRNTFPAKTWNGLSPDLYATFWGLTLYDLHFPKDRYDAEIKKLHENLKQLEDNSDNSSIAISRRKKDKERIQDLLDKLNNESHKHQQHIASVLQRLGREKVKWLNSSPDALKINMEFFQRCIFPRCVFSMQDAVYCAMFVQTLHSLETPFFNTVNHIDVFICKTLQPMICCCTEYEAGRLGRFLHETLKMAYRWKSDESLYERECGNKPGFAVYIRYPNSQRVSYSQFVRVHWKWSGRITKVLNQCMESKEYMEIRNALIVLTKISSIFPVIRKSGVNLEKRVAKLKGDEREDLKVLATGVAAALAARKSSWLSEEEFGMGLLDLKQGPAKIVPGNQSADPLTAKDQSVRAKSIEGRHERSEAAMKPDAQQKKNALAANGSDNQMPSSSAQGKVSGIIRGSDEPPKLLSDEGVKVSKPTAESETRVPQKRVAHNAGKVSKHDMVKEDTKSGKSTNRGVTQQGSSVPVDKEVLSQAADGVQDTTSNSLAASNGNLHTAPRKVSASSQKSTLLATHTGGAANSSGESTDLIDSNMKQQKRFVPTEEQDRGTKWRKGESEGRDGDFTEHTDKDRNLDSRLVDKFRPMDHDKSASEEQILSRPEKSKEKADDKYDRDPREKADRTERRRGEDIERPTDKSLERRERSIERMQERGTDRAPDKGREDRNKEERNKVKHAEPSIDRAHPSDERFRGQSLPPPPPLPASFVPQSVGNRRDEDTDRRGGSTRHNQRSSPRRDDKEKWHLEDNAASLQDDGKHRREEDIRDRKREDRDVSSSKVDDRDRDKSSIVKDESDPNSASKRRKIKRDQSGLEAGEYAPSAPQLPSHGTSSSQVFETRERERKGAISQHRISHADDLPRIHGKDSSKTSRREADQVHEREWEEEKRSRTETKRKHRK

SEQ ID NO: 6180 - protein, 1774 aa, Brachypodium distachyon
MSPPLQAPDYKYVTEECLREWKSQSAAGFRLPDPVPMARFLYELCWAIVRGDLPPQKCRVALDSVVFVEEAWHEESGSVLADIVAHLGQDITISGEYRNRLVKMTKSFVESSLIVPRLLQERCEEEFLWEVEQSKSKGQDLKAKEVRVNTRLLYQQTKFNLLREESEGYAKLVTLLCQVGSDLACQNASSATISIIKSLIGHFDLDPNRVFDIVLECFELYPDNSTFYQLIPLFPKSHAAQILGFKFQYYQQLDVNSPVPSGLFRIAALLVKSGLIDLDNLYAHLLPNDDEAFEHFGSFVSRRIDEATKIGKINLAATGKDLMDDEKQEITIDLYTALEMENDIIEERAPEIEKNQKLGLLLGFLSVHDWDHAQLLFERLAQLNPVEHIEICDGLFRVIEKTISSAYTIYCQAHHKIPGNIDTHMVEASSVSSPSYLVDLPKEFFQMLAACGPYLHRDTQLFQKVCRVLKVYHVRSKDSARTAGVMSSESRVEEALGSCLLPSLQLIPANPAVDMEIWGVLSLLPYEVRYRLYGEWEKDTEQNPIVLAARQTAKLDTRRLLKRLAKENLKQLGRMVAKLAHANPMTVLRTIVTQVEAYRDMINPVVDAFKYLTQLEYDILQYIVIERLAQGGREKVKDDGLNLSDWLQCLASFWGHLCKKHLSMELKCLFQYIVNQLKKGLGTELVVLEELIQQMANVQYTENMTDEQVDAMAGSETLRLQSSLFGSTRNYKVLNKSMNKLRDSLLPKDEPTLAIPLLLLIAQHRSKIIINADATYIKMVSEQFDRCHGILLQYAEFLSSAVTPAIYIQLIPPLEDLVYKYHIEPDVAFLIYRPVMRLFKSANGGDTCWPLDDNEEGESVSCDDMILHGDSSQKLIMWSDLLNTIRTILPTKAWIALSPELYATFWGLTLYDLHFPKDRYDAEIKKLHDNLKQLEDNSDNSSIAISRRKKDKERIQDLLDKLNNESEKHQQHVVSVFQRLTREKDKWLSSSPDALKINMEFLQRCVYPRCVLSMQDAVYCATFVQTMHSLGTPFFNTVNHIDVFICKTLQPMICCCTEYEAGRLGRFLHETLKMAYHWKSDESVYERECGNKPGFAVYFRFPNSQRVSYTQFIKVHWKWSGRITKVLNQCMESKEYMEIRNALIVLTKITSIFPVIRKSGVNIEKRVAKLKGDEREDLKVLATGVAAALAARKSSWLSEEEFGMGHLDTKPVPAKPIPGNHSSDPSTAKDQIVRAKSTEGRHERTENAMKPDAQHKNNPLPANGSDSQIPSSVAQGKVSGVARGSDEPPKLLSDEGVKVLKPTTESETRVSQKRATHNAAKVSKHDAVKEHAKSGKSTSRGLNQQASSLPIDRQVLSQAADGVLDTNPTSSFVGTNGNVHLVPRKVSASSQRSTVLAAHSGGTANPTGEGESTDLIDSTVKQQKRSVPAEEQERISKRRKGDIQGRDGELTEQHTDKERKLDTRSADRFRSADHERGASEEQNIIRTDKLKEKFDDKHDRDPREKADQLERRRGEDVIERPLDRASDRRERSIDRMQDMAPEKGREDRNKEDRNKAKHAEPSVDRAHSSDERFPGQSLPPPPPLPASFVPQSVGSNRRDEDSGRRGGSTRHTQRLSPRRDEKERWHLEENASLLQDDGKHRREEDLRDRKREDRDVSSSKVDDRDRDKVSTMKEDSDPNSASKRRKIKREQSALEAGEYAPSAPQPPSLGAGGLQLEIRERERKGVISQHRPSHADDLPRITSKTSRREVDQTLEREWEEEKRPRTEAKRKHWK

SEQ ID NO: 6181 - protein, 1548 aa, Brachypodium distachyon
MMMRHLSILGPLFQGELMRLVNLLISSVLKKDLMFFHRVLKENCMHATKIGKINLAATGKDLMDDEKQEITIDLYTALEMENDIIEERAPEIEKNQKLGLLLGFLSVHDWDHAQILFERLAQLNPVEHIEICDGLFRVIEKTISSAYTIYCQTHHKIPRNIDTHMIEASSVSSPSYLVDLPKEFFQMLAACGPYLHRDTQLFQKVCRVLKVYHVSSKDSARTAGVMSTESRVEEALGSCLLPSLQLIPANPAVDMEIWGVLSLLPYEARYRLYGEWEKDTEQNPIVLAARQTAKLDTRRLLKRLAKENLKQLGRMVAKLAHANPMTVLRTIVTQVEAYRDMINPVVDAFKYLTQLEYDILQYIVIERLAQGGREKVKDDGLNLSDWLQCLASFWGHLCKKHLSMELKCLFQYIVNQLKKGLGTELVVLEELIQQMANVQYTENMTDEQVDAMAGSETLRLQSSLFGSTRNYKVLNKSTNKLRDSLLPKDEPKLAIPLLLLIAQHRSNIIINADATYIKMVSEQFDRCHGILLQYAEFLSSAVTPVTYVQLIPPLEDLVYKYHIEPDVAFLIYRPVMRLFKSANGGDTCWPLDDNEEGESVSCDDMILYGDSSQKLIINSTSFTCPWYFRFSIAIVCILFCYRWSDLLNTIRTILPAKAWNALSPELYATFWGLTLYDLHFPKDRYDAEIKKLHDNLKQLEDNSDNSSIAISRRKKDKERIQDLLDKLNNESEKHQQHVTSVFQRLAREKDKWLSSSPDALKINMEFLQRCIYPRCVLSMQDAVYCATFVQMMHSLGTPFFNTVNHIDVFICKTLQPMICCCTEYEAGRLGRFLHETLKMAYHWKSDESVYERECGNKPGFAVYFRFPNSQRVSYTQFVKVHWKWSGRITKVLNQCMESKEYMEIRNALIVLTKITSIFPVIRKSGVNIEKRVAKLKGDEREDLKVLATGVAAALAARKSSWLSEEEFGMGHLDTKPVPAKPIPGNQSSDPSTAKDRSVRAKSTEVRHERTENAMKSDAQHKKNPLPANGSDSQIPSSSAQGKVSGVARGADEPPKLLSDEGVKVLKPTTEFETRVPQKRATHNAAKVSKHDAVKEDAKSGKSTSRGLNQQASAVPIDREVSSQAADGVLDTNPTNSLVGTNGNVHPAPRKVSAPSQRSTVLAAHSGGTANPTGEGESTDLIDSTVKQQKRSVPAEEQERISKRRKGEIESRDGELTEHHTDKEKKLDSRSADRFRSADHEKGASEEQNIIRTDKLKEKFDDKHDRDPREKAERIERRRGEDVVERSMDRASDRRERSIDRMQDRVTDRAPEKGREDRNKEDRNKAKHAEPSVDRAHSSDERFRGQSLPPPPPLPASFVPQSVGSNRRDEDSDRRGGSTRHTQRLSPRRDEKERWHLEENASSLQDDGKHRREEDLRDRKREDRDVSSSKVDDRDRDKVSTMKEDSDPNGASKRRKIKREQSALEAGEYAPSAPQPPSLGAGGSQLEIRERERKGVISQHRPSHADDLPRTHAKDSTSKTSRREADQIHEREWEEEKRPRTEPKRKHRK

SEQ ID NO: 6182 - protein, 1771 aa, Sorghum bicolor
MSPPLQAPNYKHITEECLREWKGQSAGASRLPDPVPMARFLYELCWAIVLGDLPPQKSRVAVESVVFMEEARREEELGSVLADIIAHLGQDITISGEYRSRLVKMTKSFLESSITVPRLLQERCEEDFLWEVEQSKLKGQDLKSKEVRVNTRLLYQQTKFNLLREESEGYAKLVTLLCQVGSDLACQNSSSVTISIIKSLIGHFDLDPNRVFDIVLECFELYQDSNIFHQLIPLFPKSHAAQILGFKFQYYQRLDVNSPVPSGLFRTAALLIKSGFIDLDNVYSHLLPNDDEAFEHFDSFISRRIDEANKIGKINLAATGKDLMDDEKQEITIDMYTALEMENDIVGERAPEMEKNQKLGLLLGFLSVHDWYHAHLLFERLAHLNPVEHIEICDGLFRMIEKTMSSAYHIGCHLYYYLPPRNDADQTGTSALSLSSFDLPKEFFQMLTACGPYLHRDTQLLQKVCRVLKAYYHSSKESTRAANVVSPESRMEEALGSCLFPSLQLIPANPAVDIEIWGVLSLLPYEARYRLYGEWEKETEQNPIVLAARQTAKLDTRRLLKRLAKENLKPLGRMVAKLAHANPMTVLRTIVQQVEAYRDMITPVVDAFKYLTQLEYDILQYIVIERLAQGGRAKLKDDGLNLSDWLQCLASFWGHLCKKHNAVELKNLLQYLVNQLKKGVGIELVVLEELIQQMANVQYTENMTEEQVDAMAGSETLRQQASLFGATRNYKVLSKSTNRLRDSLLPKEGPKLAVPMLLLIAQHRSKIIINADATYIKMVSEQFDRCHGILLQYVEFLSSAVTPTAYAQLIPPLQDLVHKYHIEPEVAFLIYRPVMRLFKSSNGGDTCWPLDDNEEGESVSSDDLILHLDSSQEPIMWSDLLNTVQSILPAKAWNSLSPDLYATFWGLTLYDLHFPKDRYDTEIKKLHDNLKQLEDNSDNSSIAISRRKKDKERIQDLLDKLNSESQKHQQHIASVVQRLAREKDKWLSSSPDAMKINMEFLQRCIFPRCVFSMQDAVYCATFVQTLHSLGTPFFNTVNHIDVLVCKTLQPMICCCTEFEAGRLGRFFHDTLKMAYYWKSDESVYERECANKPGFAVYFRYPNSQRVSYSQFVRVHWKWSSRITKALNQCMESKEYMEIRNALIVLTKISSVFPVIRKSGVNLEKRVAKLKGDEREDLKVLATGVAAALAARKSSWLSEEEFGMGHIDLKPATARSVLGNQSADPSMPKDQNARAKSIENRHERSEGAMKPDVQQKKSSVAANGSDIQISSSSIQGKSSVVVRAVDEPPKPVSDEGVKVSTKPTSESETRATQKRAHNAGKVMKNDVAKEDAKAGKSTSWNVNQQVSTVDREAMPHGADAAQETNTTISNGNLHPVQRKVSSSSQRNAVLVTHNGAANPSGESIDLIDSTVRQQKRSALIEEQDRSGKRRKGENEPDLSEHHVDKEKSLDSRGGDKFRSVDHEKSANEEHNLSRADRMKEKSDDKYDRDPREKLDRAERRRGEDAIERSTDRLSERRERSIERMQERVTDKASEKGREDRNKDERNKVKYAEPSVDRTHSSDERFRGQSLPPPPPLPASFVPQSVGANRREEDGDRRGGSSRHVQRSSPRRDEKERKQSEENTSSFQDDGKHRREEDIRDRKREDRDILSNKVDDRDREKGTSLKEDSDPSNASKRRKIKRDQTSLEAGEYAPSAPQPPSHGSGSSQLSDVRERERKGLISQHRTSHADDLPRTHGKDTASKSSRRESDQMHEREWEEEKRPRTETKRKHRK

SEQ ID NO: 6183 - protein, 439 aa, Avena sativa
MDEAGRASAPAVVTVTASAAAPSPPPPPPPPPAPIATADTDTPSPDPDALYQEGMWHQMTMSSGATMQPGPYPERSGEPDCTYYLRTGLCRFGMSCRFNHPPDRNMAIASARMKGEYPERVGQPECQYYLKTGTCKFGPTCKFHHPREKAGIQGMAQLNTMGYPLRPNERECAYYLKTGQCKYGNTCKFNHPELFNAVASSRGSPIYPSVHTSPSTGPHSYTGTTMASWTYPRGSFVPSPRWQNPSNYAPMIVPQGLVQVPGWNSYHGQMLPVSSSESRLQSPGAQQYYGTSRQGEGSAGNQGMVSPYRSSSFPVAQYALQRENVFPERPDQPECIYYIKTGDCKFGAVCKFHHPRVRSQPPPDCVLSPMGLPLRPGEELCKFYSRYGICKFGVNCKFDHPMAAPVGVYAYGYSASASPNGAPMGRRLLESPSGSAYAS

SEQ ID NO: 6184 - protein, 435 aa, Triticum aestivum
MDEAGRASAPAVVTVTASAAAPSPPPPPPPATATAAAADPPSPDPDALYEEGMWQQMAMSSGATMQSGPYPVRPGEPDCTYYLRTGLCRFGMSCRFNHPQDRNTAIASARMKGEYPERVGQPECQYYLKTGTCKFGPTCKFHHPREKAGIAGMVQLNTLGYPLRPNERECAYYLKTGQCKYGNTCKFNHPEIFNAVASSRGSPIYPPVHNSGSTGPHSYTGTMASWTYPRGSFIPSPRWQSPSNYTPMIVPQGLVQVPSWNSYPGQMVPVSSPESRLQSPGAQQYYGTSRQGEASAGNQGMQSSYRSSSFPAPQYALQRENVFPERPDQPECIYYIKTGDCKFGAVCKFHHPRVRSQPPPDCILSPMGLPLRPGEELCKFYSRYGICKFGVNCKFDHPMAAPMGVYAYGYSASASPNAPMARRLLESPSGSAYAS

SEQ ID NO: 6185 - protein, 435 aa, Hordeum vulgare
MDEAGRASAPAVVTVTASAAAPSPPPPPPPATAAAAAADPPSPDPDALYEEGMWQQMTMNSGVTMQSGPYPVRPGEPDCTYYLRTGLCRFGMSCRFNHPQDRNTAIASARMKGEYPERVGQPECQYYLKTGTCKFGPTCKFHHPREKAGIAGMVQLNALGYPLRPNERECAYYLKTGQCKYGNTCKFNHPEIFNAVASSRGSPIYPPVHTSGSTGPHSYTGTMASWTYPRGSFIPSPRWQSPSNYTPMIVPQGLVQVPSWNSYPGQMVPVSSPESRLQSPGAQQYYGTSRQGEGSAGNQGMQSPYRSSSFPVPQYALQRENVFPERPDQPECIYYIKTGDCKFGAVCKFHHPRVRSQPPPDCILSPMGLPLRPGEELCKFYSRYGICKFGVNCKFDHPMAAPMGVYAYGYSASASPNAPMARRLLESPSGSAYAS

SEQ ID NO: 6186 - protein, 422 aa, Panicum virgatum
MDDAGRASAPAAVTVSATAAPVHPPPSATAADTPSPDPSALYGEGMWEQMAMNSGATMQPGPYPERQGEPDCTYYLRTGLCRFGMSCRFNHPPDRNLAIASARMKGEYPERLGQPECQYYLKTGTCKFGPTCKFHHPREKAGIAGRVQLNTLGYPLRPNEKECAYYLKTGQCKYANTCKFHHPELFNVVPSSRGSPIYPSVHSSASTGPQSYTGTMASWAFPRASFIPSPRWQSPSNYAPMIVPQGLVQVPSWNSYPGQMQSPGAQQTYGTSQQGEASTGNQGMLSPYRSSSFPVPQYALQRENVFPEKPDQPECQYYMKTGDCKFGAVCKFHHPRVRSLPPPDCVLSPMGLPIRPGEELCKFYSRYGICKFGANCKFDHPMATPMGVYAYGFSASASASASTNVPMARRLLGSPPGSGYTS

SEQ ID NO: 6187 - protein, 442 aa, Brachypodium distachyon
MDEAGRAPAPAAAVTVTASSSAANASDPSPPPPPAPATANAAADTDAPSPDPDALYDEGMWQEMTMSSGAPMQPGPYPERPGEPDCTYYLRTGLCRFGISCRFNHPPDRNLAIASARMKGEYPERVGQPECQYYLKTGTCKFGPTCKFHHPREKAGIAGMVQLNTLGYPLRLNEKECAYYLKTGQCKYGNTCKFNHPELFNAVASSRGSPIYPSLHTSASAGPHSYAGTISNWTYPRGSFIPSPRWQSPSNYAPMIVQQGLVQVPSWNSYPGQMLPVSSSESRLQSPGAQQNYGTYRQGEASSGNQGMLSPYRPSSFPVPQYALQRENVFPERPDQPECIYYIKTGDCKFGAVCKFHHPRVRSLPPPDCVLSPMGLPLRPGEELCKFYSRYGICKFGINCKFDHPMASPMGVYAYGFSASASTNAPMARCLLESPSGSAYTP

SEQ ID NO: 6188 - protein, 427 aa, Sorghum bicolor
MDDAGRAPPPAPAAVTVSATAAPAPPPPSATAAADKSSPDPEALYEEGMWQQMAMNSGATMQPGSYPERPGEPDCTYYLRTGLCRFGMSCRFNHPPDRNLAIASARMKGEYPERVGQPECQYYLKTGTCKFGPTCKFHHPREKAGIAGRVQLNTLGYPLRPNEKECAYYLKTGQCKYANTCKFHHPELFNVVPSSRGSPIYTSVHSSASAGPQSYTGTMPSWAFPRASFIPSPRWQSPSNYAPMIVPQGLVQVPSWNSYPGQLQSPGAQQTYGSSQQGESSAGNQGMLSPYRSSSFPVPQYALQRDNVFPERPDEPECQYYMKTGDCKFGAVCKFHHPRVRSLPPPDCVLSPMGLPIRPGEELCKFYSRYGICKFGANCKFDHPTMAAPMGVYAYGFSASGSPASASTNVPMARRLLGSPSASGYTS

SEQ ID NO: 6189 - protein, 427 aa, Saccharum officinarum
MDDAGRAPPPAPAAVTVSATAAPAPPPPSATAAADKSSTDPDALYEEGMWQQMAMNSGAAMQPGSYPERPGEPDCTYYLRTGLCRFGMSCRFNHPPDRNLAIASARMKGEYPERVGQPECQYYLKTGTCKFGPTCKFHHPREKAGIAGRVQLNTLGYPLRPSEKECGYYLKTGQCKYANTCKFHHPELFNVVPSSRGSPIYTSVHSSASAGPQSYTGTMPSWAFPRASFIPSPRWQSPSNYAPMIVPQGLVQVPSWNSYPGQLQSPGAQQTYGSSQQGESSAGNQGMLSPYRSSSLPVPQYALQRDNVFPERPDEPECQYYMKTGDCKFGAVCKFHHPRVRALPPPDCVLSPMGLPIRPGEELCKFYSRYGICKFGANCKFDHPTMAAPMGVYAYGFSASGSPASASTNLPMARRLLGSPSGSGYAS

SEQ ID NO: 6190 - protein, 427 aa, Saccharum officinarum
  misc_feature (296)..(296): Xaa can be any naturally occurring amino acid
MDDAGRAPPPAPAAVTVSATAAPAPPPPSATAAADKSSTDPDALYEEGMWQQMAMNSGAAMQPGSYPERPGEPDCTYYLRTGLCRFGMSCRFNHPPDRNLAIASARMKGEYPERVGQPECQYYLKTGTCKFGPTCKFHHPREKAGIAGRVQLNTLGYPLRPSEKECGYYLKTGQCKYANTCKFHHPELFNVVPSSRGSPIYTSVHSSASAGPQSYTGTMPSWAFPRASFIPSPRWQSPSNYAPMIVPQGLVQVPSWNSYPGQLQSPGAQQTYGSSQQGESSAGNQGMLSPYRSSSXPVPQYALQRDNVFPERPDEPECQYYMKTGDCKFGAVCKFHHPRVRALPPPDCVLSPMGLPIRPGEELCKFYSRYGICKFGANCKFDHPTMAAPMGVYAYGFSASGSPASASTNLPMARRLLGSPSGSGYAS

SEQ ID NO: 6191 - protein, 427 aa, Zea mays
MDDAGRAPPPAPAAVTVSATAAPAPTPPSATAAADKSSLDPDALYEEGMWQQMAMNSGATMQPGSYPERPGEPDCTYYLRTGLCRFGMSCRFNHPPDRNLAIASARMKGEYPERVGQPECQYYLKTGTCKFGPTCKFHHPREKAGIAGRVQLNTLGYPLLPNEKECAYYLKTGQCKYANTCKFHHPELFNVVPSSRGSPIYTSVHSSASAGPQSYTGTMSSWTFPRASFIPSPRWQSPSNYAPMVVPHGLVQVPSWNSYPGQLQSPGAQQTYGSSQQGEASAGNQGMLSPYRSSSFPVPQYALQRDNVFPERPDEPECQYYMKTGDCKFGAVCKFHHPRVRSQPPPDCVLSPMGLPIRPGEELCKFYSRYGICKFGANCKFDHPTMAAPMGVYAYGFSGSASVAPASTNAPMTRHLLGSPSGSGYMS

SEQ ID NO: 6192 - protein, 944 aa, Brachypodium distachyon
MEVCCCSTSSSVLAGDRVGRRFAPPAARYWGAVGGGGGRAVVLAHPLRPAAARPAQAQPHARRVRRGGAVIRSVFERFTERAVKAVVLSQREAKGLGAGAVAPRHMLLGLVAEDRSAGGFLSSGISIERAREECRSIGAQDAGAPPPPPAGSGLETDVPFSGTCKRVFEVAVEFSKNMGCSFISPEHLALALFTLDDPTTNTLLRSLGADPSQLASVALARLQGELAKDGRDPAGASSFKVPEKSPAGAGRSAFTKSLSKKKEKGALDQFCLDLTTQASGGFIDPIIGREEEIERVVQIICRRTKNNPILLGEAGVGKTAIAEGLALRIANGDVPIYLVAKRIMSLDVGLLIAGAKERGELESRVTNLIREVREAGDVILFIDEVHNLIGSGTVGKSKGAGLDISNLLKPPLARGELQCIAATTLDEHRMHFEKDKALARRFQPVLVEEPSQEDAVKILLGLRENYETYHKCKFTLEAINAAVYLSARYIPDRQLPDKAIDLLDEAGSRARIESFQRKKEGQSSVLLKAPDEYWQEIKAVKAMHEVVLSNKTKYSPNENAQENDSSNTEKQCQEKAGSTSTSSPSVEEPVVVGTEEIARVASLWSGIPVQQLTADDKKILVGLDDELRKRVIGQDDAVVAISRAVKRSRVGLSDPDRPIATLLFCGPTGVGKTELTKALAASYFGSESAMLRLDMSEYMERHTVSKLIGSPPGYIGYGETGTLTEAVRRKPFTVVLLDEIEKAHPDIFNILLQIFEDGHLADSQGRRVSFKNTLIVMTSNVGSTSISSGRRSIGFSTDDTESSTYIAMKSLVMEELKGFFRPELLNRIDEMVVFRPLEKTQMLAILDIILQELKGRLLALGIGLEVSDAMKGLICQEGYDKSYGARPLRRAVTHLMEDVISEAILFGEYKPGDTILVDTDDEGKPCLSHLNKQIVQLSDPTRTF

SEQ ID NO: 6193 - protein, 957 aa, Sorghum bicolor
MEVCCCSTSSSSSVLTVGHGGAARMLAAPAGRWGAAAGFGRAMVLAHQLPLPLPLPLPRPAARARARPAPRRRRGGGVVRAVFERFTERAVKAVVLSQREARGLGEPAVAPRHLFLGLVAEDRSSGGFLSSGINIERAREECRGIAAARDDADSTAAPSSRPGSGGLDTDVPFSATAKQVFDVAVVLSKNMGASFISPEHLAIALFTLDDPTTNNLLRSLGADPSHLASVAVDRLQAELAKDGREPAEPSSFKVPKKAPAGAGRSAFSHSLTKKKDKGALDQFCLDLTTQASGGFIDPIIGREDEIERVVQIICRRTKNNPILLGEAGVGKTAIAEGLALRIANGDVPIYLVAKRILSLDVGLLIAGAKERGELESRVTNIIREVREAGDVILFIDEVHNLIGSGTVGKGKGSGLDIGNLLKPALARGELQCIAATTLDEHRMHFEKDKALARRFQPVLVDEPSQEDAVKILLGLREKYETYHKCKFTLEAINAAVYLSARYIPDRQLPDKAIDLIDEAGSRARMESFNKKKEGQSSILLKSPDEYWQEIRAAQAMHEVVLSNKAKYSPNENAQESGSATVEAPSRDNIESTSGSSLSADEPIVVGTEEIARVASLWSGIPVQQLTADDKKLLVGLDDELRKRVIGQDDAVVAISRAVKRSRVGLNDPDRPIATLLFCGPTGVGKTELTKALAASYFGSESAMLRLDMSEYMERHTVSKLIGSPPGYIGYGETGTLTEAVRRKPFTVVLMDEIEKAHPDIFNILLQIFEDGHLTDSQGRKVSFKNTLIVMTSNVGSTTISKGRQSIGFLKEDTESSSYFAMKSLVMEELKAFFRPELLNRIDEMVVFRPLEKTQMLAILDIILKEVKGRLLALGIGLEVSEAMKHLICQEGYDKSYGARPLRRAVAHIIEDVISEAILFGEFKPGDTILMDIDAEGKPCMNHLDRQIVQVSDPTRTF

SEQ ID NO: 6194 - protein, 899 aa, Zea mays
MEVCCCSTSSSVLTAGGRGAAARRLAAPAARWGAAGFGRAVREARGLGEPAVAPRHLLLGLVAEDRSSGGFLSSGINIERAREECRGIAASARDADSATAASRPGSSGLDTDVPFAAPTKQVFDVAVVLSKNMGSSFVSPEHLAIALFSLDDPTTNNLLRSLGADPSHLASVAVDRLQAELAKDGRDPAEPSSFKVPKKAPAAAGRSAFSQSLTKKKDKGALDQFCLDLTTQASGGFIDPIIGREEEIERVVQIVCRRTKNNPILLGEAGVGKTAIAEGLALRIANGDVPIYLVAKRILSLDVGLLIAGAKERGELESRVTNIIREVREAGDVILFIDEVHNLIGSGTVGKSKGSGLDIGNLLKPALARGELQCIAATTLDEHRMHFEKDKALARRFQPVLVDEPSQEDAVKILLGLREKYETYHKCKFTLEAINAAVYLSARYIPDRQLPDKAIDLIDEAGSRARMESFNRKKEGQSSILLKSPDEYWQEIRAAQAMHEVVLSNKEKYSPNENAEESGSANVEALHRDNIESTSTSSLSADEPVVVGTEEIARVASLWSGIPVQQLTADDKKLLVGLDDELRKRVIGQDDAVVAISRAVKRSRVGLNDPDRPIATLLFCGPTGVGKTELTKALAASYFGSESAMLRLDMSEYMERHTVSKLIGSPPGYIGYGETGTLTEAVRRKPFTVVLLDEIEKAHPDIFNILLQIFEDGHLTDSQGRRVSFKNTLIVMTSNVGSTSISKGRQSIGFLKEDTESGSYFAMKSLVMEELKAFFRPELLNRIDEMVVFRPLEKTQMLAILDIILKEVKGRLLALGIGLEVSDAMKDLICQEGYDKSYGARPLRRAVTHIIEDVISEAILFGEFKPGDTILMDIDAEGKPCMGHLDQQIVQVSDPTRAI

SEQ ID NO: 6195 - protein, 902 aa, Sorghum bicolor
MEVCCCSTSSSSSVLTVGHGGAARMLAAPAGRWGAAAGFGRAMREARGLGEPAVAPRHLFLGLVAEDRSSGGFLSSGINIERAREECRGIAAARDDADSTAAPSSRPGSGGLDTDVPFSATAKQVFDVAVVLSKNMGASFISPEHLAIALFTLDDPTTNNLLRSLGADPSHLASVAVDRLQAELAKDGREPAEPSSFKVPKKAPAGAGRSAFSHSLTKKKDKGALDQFCLDLTTQASGGFIDPIIGREDEIERVVQIICRRTKNNPILLGEAGVGKTAIAEGLALRIANGDVPIYLVAKRILSLDVGLLIAGAKERGELESRVTNIIREVREAGDVILFIDEVHNLIGSGTVGKGKGSGLDIGNLLKPALARGELQCIAATTLDEHRMHFEKDKALARRFQPVLVDEPSQEDAVKILLGLREKYETYHKCKFTLEAINAAVYLSARYIPDRQLPDKAIDLIDEAGSRARMESFNKKKEGQSSILLKSPDEYWQEIRAAQAMHEVVLSNKAKYSPNENAQESGSATVEAPSRDNIESTSGSSLSADEPIVVGTEEIARVASLWSGIPVQQLTADDKKLLVGLDDELRKRVIGQDDAVVAISRAVKRSRVGLNDPDRPIATLLFCGPTGVGKTELTKALAASYFGSESAMLRLDMSEYMERHTVSKLIGSPPGYIGYGETGTLTEAVRRKPFTVVLMDEIEKAHPDIFNILLQIFEDGHLTDSQGRKVSFKNTLIVMTSNVGSTTISKGRQSIGFLKEDTESSSYFAMKSLVMEELKAFFRPELLNRIDEMVVFRPLEKTQMLAILDIILKEVKGRLLALGIGLEVSEAMKHLICQEGYDKSYGARPLRRAVAHIIEDVISEAILFGEFKPGDTILMDIDAEGKPCMNHLDRQIVQVSDPTRTF

SEQ ID NO: 6196 - protein, 885 aa, Avena sativa
APTRRPRRRAGVIRAVFERFTERAVKAVVLSQREAKGLREGAVAPRHMLLGLIAEDRSAGGFLSSGISIERAREECRSIGAQDAGASPPPPTSGLDTDVPFSGGCKRVFEVALELSRNMGCSFISPEHLAIALFTLDDPTTSNLLRSLGADPSQLASVALIRLQGELAKDGRDPAGASSFKVPEKSPAGAGRSAFTKSLSNKKEKGALDQFCLDLTTQASGGFVDPIIGREEEIERVVQIICRRTKNNPILLGEAGVGKTAIAEGLALRIANGNVPIYLVAKRIMSLDVGLLIAGAKERGELESRVTSLIREVREAGDVILFIDEVHNLIGSGTVGKGKGSGLDISNLLKPPLARGELQCIAATTLDEHRMHFEKDKALARRFQPVFVDEPSQEDAVEILLGLRENYEIYHKCKFTLEAINAAVYLSARYIPDRQLPDKAIDLIDEAGSRARIETFQKRKEGQSSVLLKAPDEYWQEIKAVQAMHEVVLSNKMKYSPNENDQHSDNGNNEAPNQDKAGSASTSPVSIEEPVVVGREEIARVTSLWSGIPVQQLTADDRKILVGLDDELKMRVIGQDDAVVAISRAVKRSRVGLSDPDRPIATFLFCGPTGVGKTELTKALAASYFGSESAMLRLDMSEYMERHTVSKLIGSPPGYIGYGETGTLTEAVRRKPFTVVLLDEIEKAHPDIFNILLQIFEDGHLADSQGRRVSFKNTLIVMTSNVGSTSISDGRRSIGFSTDETESSTYIAMKSLVMEELKAFFRPELLNRIDEMVVFRPLEKTQMLAILDIILQELKGKLLALGIGLEVSDAMKSLICQEGYDKSYGARPLRRAVTQLMEDVISEAILFGEYKPGDTILVDTDKDGKPCLSRLNQQIVQLSDPTRTL

SEQ ID NO: 6197 - protein, 315 aa, Brachypodium distachyon
MATLSVPAAVPPVAEDCEQLRKAFQGWGTNERLIISILAHRDAAQRRAIRAAYAEQYGEELLRALGDEIHGKFERAVIQWTLDPAERDAVLASEEARKWHPGGRALVEIACARTPAQLFAARQAYHERFKRSLEEDVAAHATGDFRKLLVPLVSAYRYDGPEVNTSLAHSEAKILHEKINDGAYGDDEIIRILTTRSKAQLLATFNSYNDQFSHPITKDLKADPKDEFQATLRAIIRCFTCPDRYFEKIIRLALGGVGTDENSLTRIITTRAEVDLKLIKEAYQKRNSVPLEKAVSKDTTRDYEDMLLALLGAEY

SEQ ID NO: 6198 - protein, 315 aa, Festuca arundinacea
MATLTVPAGVPPVAEDCEQLRKAFTGWGTNEKLIIDILAHRDAAQRRAIRAAYAETYGEELLRALNDEIHGKFERAVIQWTLDPAERDAVLANEEAKKWHAGGRALVEIACTRTPAQLWAAKQAYHERFKRSLEEDVAAHVTGEFRKLLVPLVSAYRYDGPEVNTSLAHSEAKILQGKIHDKAYGDEEIIRILTTRSKAQLLATFNSYNDQFSHPINKDLKEDPKDEYLATLRAIIRCFTCPDRYFEKIIRLAIGSMGTDENSLTRIITTRAEVDLKLIKEAYQKRNSVPLEKAVSKDTTRDYEDMLLALLGAEY

SEQ ID NO: 6199 - protein, 315 aa, Leymus cinereus x Leymus triticoides
MATLSVPAAVPPVAEDCEQLRKAFTGWGTNERLIISILAHRDAAQRRAIRHAYAEAYGEELLRALNDEIHGKFERAVIQWTLDPAERDAVLANEEAKKWHPGGRALVEIACARTPAQLFAAKQAYHDRFKHSLEEDVAAHVTGDFRKLLVPLVSSYRYDGPEVNTSLAHSEAKLLHGKISDKAYSDDEIVRILTTRSKAQLLATFNSYNDQFSHPITKDLKEDPKDEFLATLRAIIRCFTCPDRYFEKVIRLALGGVGTDEDTLTRVITTRAEVDLKVIKEAYQKRNSVPLEKAVSKETTRDYEDMMLALLGAEY

SEQ ID NO: 6200 - protein, 314 aa, Zea mays
MATLTVPSSVPAVAEDCEQLHKAFEGWGTNEKLIISILAHRNAAQRRAIRRGYAEAYGKELLRALGDEIHGKFERAVILWTLDPAERDAVLANEEAKKSHPGGRALVEIACARTPAQLFAVKQAYHDRFKRSLEEDVAAHVTGDFRKLLVPLVSAYRYDGPEVNTSLAHSEAKILHEKIHKKAYSDEEIIRILTTRSKAQLLATFNSYKDQFTHAINKDLKADPKDEFLSTLRAIIRCFTCPDRYFEKVIRLALGGMGTDEDDLTRVVTTRAEVDLKLIKEAYQKRNSVPLERAVAKDTTRDYEDIMLALLGAE

SEQ ID NO: 6201 - protein, 314 aa, Saccharum officinarum
MATLTVPSSVPAVAEDCEQLHKAFEGWGTNEKLIISILAHRNAAQRRAIRRAYAEAYGKELLRALGDEIHGKFERAVILWTLDPAERDAVLANEEAKKWHPGGCALVEIACARTPAQLFAAKQAYHDRFKRSLEEDVASHVTGDFRKLLVPLVSAYRYDGPEVNTSLAHSEAKILHEKIDKKAYSDEEIIRILTTRSKAQLLATFNNYKDQFGHAINKHLKADPKDEFLATLRAIIRCFTCPDRYFEKVIRLALGGVGTDEDALTRVITTRAEVDLKLIKEAYQKRNSVPLERAVAKDTTRDYEDILLALLGAE

SEQ ID NO: 6202 - protein, 314 aa, Sorghum bicolor
MATLTVPSSVPAVAEDAEQLHKAFEGWGTNEKLIISILAHRNAAQRRAIRRAYAEAYGKELLRALGDEIHGKFERTVILWTLDPAERDAVLANEEAKKWHPGGRALVEIACARTPAQLFAAKQAYHDRFKRSLEEDVAAHVTGDFRKLLVPLVSAYRYDGPEVNTSLAHSEAKILHEKIDKKAYSDEEIIRILTTRSKAQLLATFNNYKDQFGHAINKDLKADPKDEFLSTLRAIIRCFTCPDRYFEKVIRLALGGVGTDEDALTRVITTRAEVDLKLIGEAYQKRNSVPLDRAVAKDTTRDYEDILLALLGAE

SEQ ID NO: 6203 - protein, 314 aa, Saccharum officinarum
  misc_feature (290)..(290): Xaa can be any naturally occurring amino acid
MATLTVPSSVPAVAEDCEQLHKAFEGWGTNEKLIISILAHRNAAQRRAIRRAYAEAYGKELLRALGDEIHGKFERAVILWTLDPAERDAVLANEEAKKWHPGGCALVEIACARTPAQLFAAKQAYHDRFKRSLEEDVASHVTGDFRKLLVPLVSAYRYDGPEVNTSLAHSEAKILHEKIDKKAYSDEEIIRILTTRSKAQLLATFNNYKDQFGHAINKHLKADPKDEFLATLRAIIRCFTCPDRYFEKVIRLALGGVGTDEDALTRVITTRAEVDLKLIKEAYQKRNSVXLERAVAKDTTRDYEDILLALLGAE

SEQ ID NO: 6204 - protein, 315 aa, Pseudoroegneria spicata
MATLSVPAAVPAVAEDCEQLRKAFAGWGTNERLIISILAHRDAAQRRAIRRAYAEAYGEELLRAIGDEIHGKFERAVIQWTLDPAERDAVLANEEAKKWQPGGRALVEIACARTPAQLFAAKQAYHDRFKHSLEEDVAAHVTGDFRKLLVPLVSAYRYDGPEVNTSLAHSEAKILHGKISEKAYSDDEVVRILTTRSKAQLLATFNSYNDQFSHPITKDLKEDPKDEFLSTLRAIIRCFTCPDRYFEKVIRLALGGVGTDEDTLTRVITTRAEVDLKVIKEAYQKRNSVPLEKAVSKETTREYEDLMLALLGAEY

SEQ ID NO: 6205 - protein, 315 aa, Hordeum vulgare
MATLSVPAAVPAVAEDCEQLRKAFAGWGTNERLIISILAHRDAAQRRAIRKHYADAYGEELLRSITDEIHGKFERAVIQWTLDPAERDAVLANEEAKKWNPGGRALVEIACARTPAHLFAAKQAYHDRFKRSLEEDVAAHVTGDFRKLLVPLVSAYRYDGPEVNTSLAHSEAKILHAKISEKAYSDDEVVRILTTRSKAQLLATFNSYNDQFSHPITKDLKEDPKDEFLSTLRAIIRCFTCPDRYFEKVIRLALGGVGTDEHTLTRVITTRAEVDLKVIKEAYQKRNSVPLEKAVSKDTTRDYEDMMLALLGAEY

SEQ ID NO: 6206 - protein, 315 aa, Avena sativa
MATLTVPAGVPPVAEDCEQLHKAFGGWGTNERLIISILAHRDAAQRRAIRHAYAEAYGEELLRAINDEIHGKFERAVIQWTLDPAERDAVLANEEAKKWHAGGRALIEIACTRTPAQLFAAKQAYHDRFKRSLEEDVAAHVTGDFRKLLVPLVSAYRYDGPEVNTSVAHSEAKLLHGKIQEKAYGDEEIIRILTTRSKSQLLATFNSYNDQFSHPITKDLKEDPKDEFLATLRAIIRCFACPDRYFEKIVRLALGGVGTDENSLTRIITTRAEVDLKVIKEAYLRRNSVLLEKAVSKDTTRDYEDMMLALLGAEY

SEQ ID NO: 6207 - protein, 315 aa, Triticum aestivum
MATLSVPAAVPAVAEDCEQLRKAFAGWGTNERLIVSILAHRDAAQRRAIRRAYAEAYGEELLRAIGDEIHGKFERAVTQWTLDPAERDAELAGEEAKKWQPGGRALVEIACARTPAQLFAAKQAYHDRFKRSLEEDVAAHVTGDFRKLLVPLVSAYRYDGPEVNTSLAHSEAKILNGKINEKAYSDDEIVRILTTRSKAQLLATFNSYNDQFSHPITKDLKEDPKNEFLSTLRAIIRCFTCPDRYFEKVVRLALGGVGTDENTLTRVITTRAEVDLKVIKEAYQKRNSVPLEKAVSKETSRDYEDMMLALLGAEY

SEQ ID NO: 6208 - protein, 315 aa, Triticum aestivum
MATLSVPAAVPAVAEDCEQLRKAFAGWGTNERLIVSILAHRDAAQRRAIRRAYAEAYGEELLRAIGDEIHGKFERAVAQWTLDPAERDAELAGEEAKKWQPGGRALVEIACARTPAQLFAARQAYHDRFKRSLEEDVAAHVTGEFRKLLVPLVSAYRYDGPEVNTSLAHSEAKILNGKINEKAYSDDEIIRILTTRSKAQLLATFNSYNDQFSHPITKDLKEDPKNEFLSTLRAIIRCFTCPDRYFEKIIRLALGGVGTDENTLTRVITTRAEVDLKVIKEAYQKRNSVPLDKAVSKETSRDYEDMMLALLGAEY

SEQ ID NO: 6209 - protein, 152 aa, Hordeum vulgare
MATLSVPAAVPAVAEDCEQLRKAFAGWGTNERLIISILAHRDAAQRRAIRKHYADAYGEELLRSITDEIHGKFERAVIQWTLDPAERDAVLANEEAKKWNPGGRALVEIACARTPAHLFAAKQAYHDRFKRSLEEDVAAHVTGDFRSFWCLL

SEQ ID NO: 6210 - protein, 314 aa, Brachypodium distachyon
MATLTVPSSVPAITDDCEQLRKAFQGWGTNEALIISILGHRDAAQRRAIRRAYAETYGEELLRSITDEISGDFERAVILWTLDPAERDAVLANEGAKKWHPGSPVLVEIACARGSGQLFAVRQAYHERFKRSLEEDVAAHVTGAFRKLLVPLVSSYRYEGPEVNTRLAHSEAKILHEKIEHKAYGDDEIIRILTTRSKAQLLATFNHYNDAFGHPITKDLKADPKDEFLKTLRAVIRCFTCPDRYFEKVIRLAIAGTGTDENSLTRIITTRAEVDLKLIKEAYQKRNSVPLERAVAGDTSGDYESMLLALLGKE

SEQ ID NO: 6211 - protein, 314 aa, Saccharum officinarum
MATLKVPATVPPVADDCEQLRKAFQGWGTNEALIISILGHRDAAQRRAIRRAYAEAHGEELLRSITDEISGDFERAVILWTLDPAERDAVLANEAARKWQPGNRVLVEIACTRTSAQIFAARQAYHERFKRSLEEDIAAHVTGDFRKLLVPLVSTYRYDGPEVNTRLAHSEAKLLHEKIHHKAYSDDEIIRILTTRSKPQLLATFNHYNDAFGHRINKDLKADPKDEYLKTLRAIIRCFSCPDRYFEKVARQAIAGLGTDENALTRVITTRAEVDLKLIKEAYQKRNSVPLERAVAGDTAGDYESMLLALLGQE

SEQ ID NO: 6212 - protein, 314 aa, Sorghum bicolor
MATLKVPATVPPVADDCEQLRKAFQGWGTNEALIISILGHRDAAQRRAIRRAYAEAHGEELLRSITDEISGDFERAVILWTLDPAERDAVLANEAARKWQPGNRVLVEIACTRTSAQVFAARQAYHERFKRSLEEDIAAHVTGDFRKLLVPLVSTYRYDGPEVNTRLAHSEAKLLHEKIHHKAYSDDEIIRILTTRSKPQLLATFNHYNDAFGHRINKDLKADPKDEYLKTLRAIIRCFSCPDRYFEKVARQAIAGLGTDENALTRVITTRAEVDLKLIKEAYQKRNSVPLERAVAGDTSGDYESMLLALLGQE

SEQ ID NO: 6213 - protein, 317 aa, Oryza sativa
MATLTVPSAVPPVADDCDQLRKAFQGWGTNEALIISILAHRDAAQRRAIRRAYADTYGEELLRSITDEISGDFERAVILWTLDPAERDAVLANEVARKWYPGSGSRVLVEIACARGPAQLFAVRQAYHERFKRSLEEDVAAHATGDFRKLLVPLISAYRYEGPEVNTKLAHSEAKILHEKIQHKAYGDDEIIRILTTRSKAQLIATFNRYNDEYGHPINKDLKADPKDEFLSTLRAIIRCFCCPDRYFEKVIRLAIAGMGTDENSLTRIITTRAEVDLKLITEAYQKRNSVPLERAVAGDTSGDYERMLLALLGQEQ

SEQ ID NO: 6214 - protein, 314 aa, Sorghum bicolor
MATLKVPATVPPVADDCEQLRKAFQGWGTNEALIVSILGHRDAAQRRAIRRAYAEAHGEELLRSITDEISGDFERAVILWTLDPAERDAVLANEAARKWQPGNRVLVEIACTRTSAQVFAARQAYHERFKRSLEEDIAAHVTGDFRKLLVPLVSTYRYDGPEVNTRLAHSEAKLLHEKIHHKAYSDDEIIRILTTRSKPQLLATFNHYNDAFGHRINKDLKADPKDEYLKTLRAIIRCFSCPDRYFEKVARQAIAGLGTDENALTRVITTRAEVDLKLIKEAYQKRNSVPLERAVAGDTSGDYESMLLALLGQE

SEQ ID NO: 6215 - protein, 314 aa, Zea mays
MATLKVPATVPPVADDCDQLRKAFQGWGTNEALIISILGHRDAAQRRAIRRAYAEAYGEELLRSITDEISGDFERAVILWTLDPAERDAVLANEAARKWKPGNRVLVEIACTRTSAQIFATRQAYHERFKRSLEEDIAAHVTGDFRKLLVPLVSTYRYDGPEVNTRLAHSEAKLLHEKIHHKAYSDDEIIRILTTRSKPQLIATFNHYNDAFGHRINKDLKADPQDEYLRTLRAIIRCFSCPDRYFEKVARQAIAGLGTDENSLTRVITTRAEVDLKLIKEAYQKRNSVPLERAVAGDTSGDYESMLLALLGQE

SEQ ID NO: 6216 - protein, 314 aa, Panicum virgatum
MATLKVPATVPTASDDCEQLRKAFQGWGTNEALIISILGHRDAAQRRAIRRAYAETYGEELLRSITDEISGDFERAVILWTLDPAERDAVLANEAARKWQPGNRVLVEIACTRGSAQLFAVRQAYHERFKRSLEEDIAAHVKGDFRKLLVPLVTAYRYDGPEVNTRLAHSEAKILHEKIQHKSYSDDEIIRILTTRSKAQLLATFNYYNDAFGHPINKDLKADPKDEYLKTLRAIIRCFTCPDRYFEKVVRQAIAGLGTDESSLTRVITTRAEVDLKLIKEAYQKRNSVPLDRAVAGDTSGDYENMLLALLGQE

SEQ ID NO: 6217 - protein, 314 aa, Avena sativa
MATLTVPASVPAIADDCEQLRKAFQGWGTNEALIISILGHRDAAQRRAIRKAYADTYGEELLRSITDEISGDFERAVILWTLDPAERDAVLANEGAKKWQPGSPVLVEIACARGSGQLFAVRQAYHDRFKRSLEEDVAAHVTGDFRKLLVPLVSAYRYEGPEVNTRLAHSEAKILHEKIEHKAYGDDEIIRILTTRSKAQLLATFNNYNDSFGHPITKDLKADPKDEFLKTLRAVIRCLTCPDRYFEKVLRLAIAGNGTDESSLNRVITTRAEVDLKHIKEAYQKRNSVPLEKAIAGDTSGDYESMLLALLGKE

SEQ ID NO: 6218 - protein, 314 aa, Hordeum vulgare
MATLKVPSNVPALADDCDNLRKAFQGWGTNEALIISILGHRDAAQRRAIRKHYADTYGEELLRSITDEISGDFERAVILWTLDPAERDAVLANETAKKWHPGNPVLVEIACSRGSAQLFAVRQAYHDRFKRSLEEDVAAHVTGDFRKLLVPLVSSYRYEGPEVNTRLAHSEAKILHEKIEHKAYGDDEIIRILTTRSKAQLLATLNNYNDTFGHPITKDLKADPKDEFLKTLRAVIRCFTCPDRYFEKVARLAIAGNGTDENSLTRVITTRAEVDLKLIKEAYQKRNSVPLEKAVAGDTSGDYETMLLALLGKE

SEQ ID NO: 6219 - protein, 314 aa, Pseudoroegneria spicata
  misc_feature (56)..(56): Xaa can be any naturally occurring amino acid
MATLKVPSSVPALADDCDNLRKAFQGWGTNEALIISILGHRDAAQRRAIRKHYADXYGEELLRSITDEISGDFERAVILWTLDPAERDAVLANETAKKWHPGNPVLVEIACARGSAQLFAVRQAYHDRFKRSLEEDVAAHVTGDFRKLLVPLVSSYRYEGPEVNTRLAHSEAKILHEKIEHKAYGDDEIIRILTTRSKAQLLATLNHYNDTFGHPITKDLKADPKDEFLKTLRAVIRCFTCPDRYFEKVARLAIAGNGTDENSLTRVITTRAEVDLKLIKEAYQKRNSVPLEKAVAGDTCGDYEIMLLALLGKE

SEQ ID NO: 6220 - protein, 314 aa, Leymus cinereus x Leymus triticoides
MATLKVPSNVPALADDCDNLRKAFQGWGTNEALIISILGHRDASQRRAIRKHYNDTYGEELLRSITDEISGDFERAVILWTLDPAERDAVLANEAAKKWHPGNPVLVEIACARGSAQLFAVRQAYHDRFKRSLEEDVAAHVTGDFRKLLVPLVSSYRYEGPEVNTRLAHSEAKILHEKIEHKAYGDDEIIRILTTRSKAQLLATLNHYNDTFGHPITKDLKADPKDEFLKTLRAVIRCFTCPDRYFEKVVRLAIAGNGTDENSLTRVITTRAEVDLKLIKEAYQKRNSVPLEKAVTGDTSGDYESMLLALLGKE

SEQ ID NO: 6221 - protein, 561 aa, Panicum virgatum
MALNLAHQTGAAAAVTAAPAAPRSAVVAAASTVAPSATAPSPAPALQAQTVTVDPAPAQAADSVKPDLAMVCQALVDGKPEAEHADVAAEVRSKEGVPVFVMMPLDTVRKDGNSLNRRRAVEASLAALKSAGVEGIMVDVWWGIAEAEGPGQYNFNGYMELMEMARKNGLKVQAVMSFHQCGGNVGDSVTIPLPKWVLEEMDKDQDLAYTDRSGRRNYEYVSLGCDALPVLKGRTPIQCYADFMRAFRDHFATYMGNTIVEIQVGMGPAGELRYPSYPESNGTWCFPGIGEFQCYDRYMLSSLKAAAEAVGKPEWGNAGPSDSGSYKNWPEDTPFFRREGGWNTEYGQFFMSWYSQMLLEHGERILSAATGVFTASPGVKISVKVAGIHWHYGTRSHAAELTAGYYNTRHHDGYQPIARMLGRHGAVLNFTCVEMRDHEQPQDAQCRPEGLVQQVAAAAREAGIGLAGENALPRYDETAHDQVVATAAEKAEEDRMVAFTYLRMGPDLFQPDNWRRFAAFVKRMSGAGKRDMCREQVEREASGVAHATQPLVHEAAVALTN

SEQ ID NO: 6222 - protein, 563 aa, Sorghum bicolor
MALNLAHQTGAAVTAAPTAPRSAVVAAAATVSAPSASASAAPAPALQMQTMTVDAAPAQAPDAVKPDLAMACQALVEGSTPDEAQHADVAAELKTKAGVPVFVMMPLDTVRKDGNSLNRRKAVEASLAALKSAGVEGIMVDVWWGIAEADGPGQYNFNGYMELMEMARKTGLKVQAVMSFHQCGGNVGDSVTIPLPRWVVEEMDKDQDLAYTDRSGRRNYEYVSLGCDTLPVLKGRTPIQCYADFMRAFRDHFATFMGNTIVEIQVGMGPAGELRYPSYPESDGTWSFPGIGEFQCYDRYMLSSLKAAAESVGKPEWGNGGPGDAGGYKNWPEDTGFFRREGGWSNEYGQFFMSWYSQMLLEHGERILSAATGVYTGSPGVKISVKVAGIHWHYGTRSHAAELTAGYYNTRHHDGYAPIARMLARHGAVLNFTCVEMRDHEQPQDAQCRPEALVQQVAAAAREAGVGLAGENALPRYDETAHDQVVATAADRAAEDRMVAFTYLRMGPDLFQPDNWRRFAAFVKRMSQPGARDACREQVEREADGVAHATQPLVHEAAVALTN

SEQ ID NO: 6223 - protein, 572 aa, Zea mays
MALNLSHQTGAAVAAAPAAPRAAVVAAAATAPRSAVVAAAATVAPPPASAPAPAPALQLQTMTVDPAPAQAPDAVKPDLAMACQALVEAAPEAEHADVAAELRSRAGVPVFVMMPLDTVRKDGNSLNRRKAVEASLAALKSAGVEGIMVDVWWGIAEADGPGQYNFNGYMELMEMAKKTGLKVQAVMSFHQCGGNVGDSVTIPLPGWVLEEMDKDQDLAYTDRSGRRNYEYVSLGCDAMPVLKGRTPIQCYADFMRAFRDHFATFMGNTIVEIQVGMGPAGELRYPSYPESDGTWSFPGIGEFQCYDRFMLSSLKAAAEAVGKPEWGNAGPGDSGSYKDWPEDTGFFRREGGWSTEYGEFFMSWYSQMLLEHGERILSAATGVFTGSPGVKISVKVAGIHWHYGTRSHAAELTAGYYNTRSHDGYAPIARMLARHGAVLNFTCVEMRDHEQPQDAQCRPEALVQQVAAAAREAGVGLAGENALPRYDDTAHDQVVATAADRAAEDRMVAFTYLRMGPDLFQPDNWRRFAAFVKRMTEPGAREACREQVEREAEGVAHATQPLVHEAAVALTN

SEQ ID NO: 6224 - protein, 560 aa, Triticum aestivum
MALNLTHQTGAAAIAATPAPGARASVFAAASPAAAAAAGSAVAPAQATSLRMQTQLVEPAQPQAPEMFQAMAPDQQQQGEAAHPDAGGEEARKVGVPVFVMMPLDTVRKDGSALNRRKAVQASLAALKSAGTAGIMVDVWWGIAESEGPGQYNFAGYIELMEMAKKAGLKVQAVMSFHQCGGNVGDSVNIPLPKWVTEEMDQDQDLAYTDRCGRRNYEYISLGADALPALKGRTPIQCYADFMRAFRDHLAPYMGNTICEIQVGMGPAGELRYPSYPESNGTWSFPGIGEFQCYDRYMRASLKAAAEAVGRPEWGNAGPEDSGSYNQWPEDTGFFRREGGWNTDYGQFFMSWYSQMLIEHGERILSACSSVFTGTPGVKVSVKVAGIHWHYGTRSHAPELTAGYYNTRNHDGYLPIARMIGRHGAVLNFTCVEMRNHEQPQDAQCMPEALVSQVASAAKEAGVGLAGENALPRYDETAHDQVLATAAEKAEEDRMVAFTYLRMGPDLFQPDNWRRFAAFVKRMTETGVRDVSREQVEREAQGVAHATQGVIQEAAVALCN

SEQ ID NO: 6225 - protein, 711 aa, Brachypodium distachyon
MSVPTMAVYTSPPGGLYASSELETSSRGSAPCATAAPPSPASSHRHSSFSGGLSCLFSSPTAAPRSSALDELGALWHDRSDEPAVAGRGGGYSCPQPSSSLKWRDHLHHSPVSLFHSPASSPASRSPSASWLASRERERLFSSFVRNALGSCVDYAPVTSPALGVTAAAGVDAAELAFELDENLSGAEPSCEPYARDLLAGAQARHRIFHDELVVKAFFEAEKAHRGQTRASGDPYLQHCVETAVLLAKIGANATVVSAGLLHDTIDDSFMDYDHIFRMFGAGVADLVEGVSKLSHLSKLARDNNTASRTVEADRLHTMFLAMADARAVLIKLADRLHNMKTIEALPFVKQQRFAKETMEIFVPLANRLGIASWKEQLENICFKHLNPEEHKELSSKLVISFDEALLTSTLDKLDKGLRDEGISYHSVSGRHKSLYSIYSKMIKKNLTMDDVHDIHGLRLVVETEKDCYRALDIVHKLWPGVSGRFKDYILHPKVNGYRSLHTVILCEGVHPFEVQIRTKEMHLQAEFGFAAHWRYKEGGCRHAFVLQMVEWARWVLTWQCEAMSKERPSGLVSSDSVKSSCPFPLHSEECPYSYTRQCNHDGPIFVIMLEHDKMSVQELPANSTIVNLMERVSASSPRWSPYSFPLKEELRPRVNHQPISDPNRTLCMGDVVELTPALPHKSLTEYREEIQRMYERGGFALATTRGAPAS

SEQ ID NO: 6226 - protein, 711 aa, Brachypodium distachyon
MSVPTMAVYTSPPGGLYASSELETSSRGSAPCATAAPPSPASSHRHSSFSGGLSCLFSSPTAAPRSSALDELGALWHDRSDEPASPAGAAATHAPSRPRRSSGGTTSTTAPSRCSTARPPRQLPGARRRLGSPARERERLFSSFVRNALGSCVDYAPVTSPALGVTAAAGVDAAELAFELDENLSGAEPSCEPYARDLLAGAQARHRIFHDELVVKAFFEAEKAHRGQTRASGDPYLQHCVETAVLLAKIGANATVVSAGLLHDTIDDSFMDYDHIFRMFGAGVADLVEGVSKLSHLSKLARDNNTASRTVEADRLHTMFLAMADARAVLIKLADRLHNMKTIEALPFVKQQRFAKETMEIFVPLANRLGIASWKEQLENICFKHLNPEEHKELSSKLVISFDEALLTSTLDKLDKGLRDEGISYHSVSGRHKSLYSIYSKMIKKNLTMDDVHDIHGLRLVVETEKDCYRALDIVHKLWPGVSGRFKDYILHPKVNGYRSLHTVILCEGVHPFEVQIRTKEMHLQAEFGFAAHWRYKEGGCRHAFVLQMVEWARWVLTWQCEAMSKERPSGLVSSDSVKSSCPFPLHSEECPYSYTRQCNHDGPIFVIMLEHDKMSVQELPANSTIVNLMERVSASSPRWSPYSFPLKEELRPRVNHQPISDPNRTLCMGDVVELTPALPHKSLTEYREEIQRMYERGGFALATTRGAPAS

SEQ ID NO: 6227 - protein, 139 aa, Brachypodium distachyon
MQIFVKTLTGKTITLEVESSDTIDNIKAKIQDREGIPPDQQRLIFAGKQLEDGRTLADYNIQKESTLHLVLRLRGGSRGHYIIKEPSLLQLALKYNEKKMVCRKCYARLPFRATNCRKKKCGHTDQIRLKKKFINQLSM

SEQ ID NO: 6228 - protein, 140 aa, Oryza sativa
MQIFVKTLTGKTITLEVESSDTIDNVKAKIQDKEGIPPDQQRLIFAGKQLEDGRTLADYNIQKESTLHLVLRLRGGSRGGYPKGIEPNLRELAQKYNENKLVCRRCYARLPLRSTNCRKKKCGHSNEIRAKKRFMSKLSK

SEQ ID NO: 6229 - protein, 148 aa, Hordeum vulgare
EWVRGGRKEQIFVKTLTGKTITLEVESSDTIDNVKAKIQDKEGIPPDQQRLIFAGKELEDGRTLADYNIQKESTLHLVLRLRGGSRGQYIILDPNLLQLALKYREKKMICRKCYARLPHGSSNCRKKKCGHSNELRKKKRFIDKTTMI

SEQ ID NO: 6230 - protein, 139 aa, Triticum aestivum
MQIFLKTLTGKTITLEVESSDTIDNVKAKIQDKEGIPPDQQRLIFAEKQLEEGRTLANYNIQKESTLHLVLRLRGGTRGGYLNVEPNLLQLALKYNEKKMVCRKCYARLPLRSTNCRKKKCGHSNQIRPKKRFINKLSN

SEQ ID NO: 6231 - protein, 148 aa, Hordeum vulgare
SRCGGPRKEQIFVKTLTGKTITLEVESSDTIDNVKAKIQDKEGIPPDQQRLIFAGKQLEDGRTLADYNIQKESTLHLVLRLRGGSRGQYIILDPNLLQLALKYREKKMICRKCYARLPHGSSNCRKKKCGHSNELPKKNRFIDQTTMI

SEQ ID NO: 6232 - protein, 142 aa, Hordeum vulgare
RKEQIFVKTLTGKTITLEVESSDTIDNVKAKIQDKEGIPPDQQRLIFAGKELEDGRTLADYNIQKESTLHLVLRLRGGSRGQYIILDPNLLQLALKYREKKMICRKCYARLPHGSSNCRKKKCGHSNELRKKKRFIDKTTMI

SEQ ID NO: 6233 - protein, 218 aa, Brachypodium distachyon
MQIFVKTLTGKTITLEVESRDTIDSVKAKIQDKEGIPPDQQRLIFAGKQLDDGRTLADYNIQKESTLHLVLRLRAKMQIFVKTLTGKTITLEVESSDTIDNVKAKIHDKEGIPPDQQRLIFAGKQLEDGRTLADYNIQKESTLHLVLRLRGGSRGQYPKNLEPNLRILAQKYNENKMVCRKCYARLPLRATHCRKKKCGHSNQLREKKRFMSKFGSDS

SEQ ID NO: 6234 - protein, 143 aa, Sorghum bicolor
MQIFVKTLTGKTITLEVESSDTIDNVKAKIQDKEGIPPDQQRLIFAGKQLDDGRTLADYNIQKESTLHLVLRLRGGSRGGYPTTISPSLRELAQKYNENKMVCRKCYARLPPRATNCRKKKCGHTNALRSKKRFMSKIGGTNK

SEQ ID NO: 6235 - protein, 135 aa, Triticum aestivum
MQIFVKTLTGKTITLEVESSDTIDNVKAKIQDKEGIPPVQQRLIFAGKQLDEGRTLADYNVQKESTLHLVLRLRGGSRGGRPTSIPPNLLQLALKHNEKRMVCRKCYARLPPRATNCRKKKCGHTNELRPKKKFV

SEQ ID NO: 6236 - protein, 139 aa, Oryza sativa
MQIFVKTLTGKTITLEVESSDTIDNVKAKIQDKEGIPPDQQRLIFAGKQLEDGRTLADYNIQKESTLHLVLRLRGGGRPGYPMIEPNLLALARSKMEKKMICRKCYARLPYKATNCRKKKCGHTNELRPKKKLVSKLSV

SEQ ID NO: 6237 - protein, 284 aa, Panicum virgatum
MAEHLASIFGTEKDRVNCPFYFKIGACRHGDRCSRLHNKPSISPTLLLCNMYQRPDMITPGVDAQGNPIDPERIQEDFEDFYEDIFEELSKHGEIESLHVCDNLADHMIGNVYVQFREEEQAARALQALQGRYYSGRPIIAEFSPVTDFREATCRQFEEHSCNRGGYCNFMHVKQVGRDLRRKLFGHLHRTRRSRSRSSRSPSPYRYRRSSSRSRDRDDDYDYYYHYRSGSGSRRSSERHRSHDSDGSRRRRGRSRSRSPVREGSEERRARIEQWNREREAAQV

SEQ ID NO: 6238 - protein, 287 aa, Zea mays
MAEHLASIFGTEKDRVNCPFYFKIGACRHGDRCSRLHNKPSISPTLLLCNMYQRPDMITPGVDAQGNPIDPERIQEDFEDFYEDIFVELSKHGEIESLHVCDNLADHMIGNVYVEFREEEQAARALQALQGRYYSGRPIIAEFSPVTDFREATCRQFEEHSCNRGGYCNFMHVKQVGRDLRRKLFGHLHRSLRSHSRGSRSPSPYRRRGSSSRSRDRDDYHDYYYHYYRSGSGSRRSSERHRSHDSDGSRRRRGRSRSRSRSPVREGSEERRAKIEQWNREREAAQV

SEQ ID NO: 6239 - protein, 284 aa, Panicum virgatum
MAEHLASIFGTEKDRVNCPFYFKIGACRHGDRCSRLHNKPSISPTLLLCNMYQRPDMITPGVDAQGNPIDPERIQEDFEDFYEDIFEELSKHGEIDSLHVCDNLADHMIGNVYVQFREEEQAARALQGLQGRYYSGRPIIAEFSPVTDFREATCRQFEEHSCNRGGYCNFMHVKQVGRDLRRKLFGHLHRSRRSHSRSSRSPSPYRHRRSSSRSRDRDDDYDYYYHYRSGSGSRRSSERHRSHDNDGSRRRRGRSRSRSPVREGSEERRARIEQWNREREAAQV

SEQ ID NO: 6240 - protein, 295 aa, Brachypodium distachyon
MAEHLASIFGTEKDRVNCPFYFKIGACRHGDRCSRLHNKPSVSPTLLLCNMYQRPDMITPGVDAQGNPIDPVKIQGDFEDFYEDIFDELSKHGVVESLHVCDNLADHLIGNVYVQFREEDQAARALQALQGRFYSGRPIIAEFSPVTDFREATCRQFEEHNCNRGGYCNFMHVKEIGRDLRKRLYGHLHRSRRSHSRSPSPYHRHPRDRDRRSSSRSRDNRGGDYYGGSLDRGDYGDYYHHSRRRSSERHRNYDSDDGSRRRRHRSRTRSPVREGSEERRAKIEQWNREREAAQA

SEQ ID NO: 6241 - protein, 292 aa, Brachypodium distachyon
MAEHLASIFGTEKDRVNCPFYFKIGACRHGDRCSRLHNKPSVSPTLLLCNMYQRPDMITPGVDAQGNPIDPVKIQGDFEDFYEDIFDELSKHGVVESLHVCDNLADHLIGNVYVQFREEDQAARALQALQGRFYSGRPIIAEFSPVTDFREATCRQFEEHNCNRGGYCNFMHVKEIGRDLRKRLYGHLHRSRRSHSRSPSPYHRHPRDRDRRSSSRSRDNRGGDYYGGSLDRGDYGDYYHHSRRRSSERHRNYDSDDGSRRRRHRSRTRSPVREGSEERRAKIEQWNREREA

SEQ ID NO: 6242 - protein, 284 aa, Cenchrus ciliaris
  misc_feature (117)..(117): Xaa can be any naturally occurring amino acid
  misc_feature (195)..(195): Xaa can be any naturally occurring amino acid
  misc_feature (243)..(243): Xaa can be any naturally occurring amino acid
  misc_feature (255)..(255): Xaa can be any naturally occurring amino acid
MAEHLASIFGTEKDRVNCPFYFKIGACRHGDRCSRVHNKPSISPTLLLCNMYQRPDMITPGVDAQGNPIDPEQIQEDFEDFYEDIFEELSKHGEIESLHVCDNLADHMIGNVYVQFXEEEQAARALQALQGRYYSGRPIIAEFSPVTDFREATCRQFEEHSCNRGGYCNFMHVKQIGRDLRRKLFGHLHRYRRSXSRSSRSPSPYRHRRSSSRSRDRDDDYDYYYQYRSGSASRRSSERHRSXDSDGSRRRRGRXRSRSPVREGSEERRARIEQWNREREAAQV

SEQ ID NO: 6243 - protein, 293 aa, Pseudoroegneria spicata
MAEHLASIFGTEKDRVNCPFYFKIGACRHGDRCSRLHNKPSVSPTLLLCNMYQRPDMITPGVDAQGNPIDPVKIQGDFEDFYEDIFDELSKHGEVENLHVCDNLADHLIGNVYVQFREEDQAAKALQALQGRFYSGRPIIAEFSPVTDFREATCRQFEEHNCNRGGYCNFMHVKEIGRDLRKRLYGHLHRSRRSHSRSSRSLSPYRHHARDHDRSSRSRDRGDYYGGSLDRGDYGDYYHHSRRSSERNRNYDSDGSRRRRRHRSRTRSPVREGSEERRAKIEQWNREREMAQA

SEQ ID NO: 6244 - protein, 286 aa, Sorghum bicolor
MAEHLASIFGTEKDRVNCPFYFKIGACRHGDRCSRLHNKPSISPTLLLCNMYQRPDMITPGVDAQGNPIDPERIQEDFEDFYEDIFEELSKHGEIESLHVCDNLADHMIGNVYVQFREEEQAARALQALQGRYYSGRPIIAEFSPVTDFREATCRQFEEHSCNRGGYCNFMHVKQVGRDLRRKLFGHLHRSHRSHSRGSRSPSPYRRHGSSSRSRDRDDDHDYYYHYRSGSGSRRSSERHRSHDSDGSRRRRGRSRSRSKSPWREGSEERRAKIEQWNREREAAQV

SEQ ID NO: 6245 - protein, 314 aa, Triticum aestivum
MAEHLASIFGTEKDRVNCPFYFKIGACRHGDRCSRLHNKPSVSPTLLLCNMYQRPDMITPGVDAQGNPIDPVKIQGDFEDFYEDIFDELSKHGEVENLHVCDNLADHLIGNVYVQFREEDQAAKALQALQGRFYSGRPIIAEFSPVTDFREATCRQFEEHNCNRGGYCNFMHVKEIGRDLRKRLYGHLHRSGRSHSRSSRSPSPYRHHARDRDRSSRSRDRGDYYGGSLDRGDYGDYYHHSRRSSERNRNYDSDGSRCRRHRSRTRSPVREGSEERRAKIEQWNREREAPARQGSEERRAKIDQWNRERETAQA

SEQ ID NO: 6246 - protein, 145 aa, Saccharum officinarum
MAEHLASIFGTEKDRVNCPFYFKIGACRHGDRCSRLHNKPSISPTLLLCNMYQRPDMITPGVDAQGNPIDPERIQEDFEDFYEDIFEELSKHGEIESLHVCDNLADHIIGNVYVQFREEEQAAAPCRRCRAATTRAAPSSPSFRR

SEQ ID NO: 6247 - protein, 312 aa, Triticum aestivum
MAEHLASIFGTEKDRVNCPFYFKIGACRHGDRCSRLHNKPSVSPTLLLCNMYQRPDMITPGVDAQGNPIDPVKIQGDFEDFYEDIFDELSKHGEVENLHVCDNLADHLIGNVYVQFREEDQAAKALQALQGRFYSGRPIIAEFSPVTDFREATCRQFEEHNCNRGGYCNFMHVKEIGRDLRKRLYGHLHRSRRSHSRSPSPYRHHARDRDRSSRSRDRGDYYGGSLDRGDYGDYYHHSRRSSERNRNYDSDGSRRRRRHRSRTRSPVREGSEERRAKIEQWNREREAPARQGSEERRAKIEQWNRERETAQA

SEQ ID NO: 6248 - protein, 292 aa, Avena sativa
MAEHLASIFGTEKDRVNCPFYFKIGACRHGDRCSRLHNRPSVSPTLLLCNMYQRPDMITPGFDPQGNPIEPSKIQGDFEDFYEDIFDELSKYGEVENLHVCDNLADHLIGNVYVSFREEDQAAKALQALQGRFYSGRPIIAEFSPVTDFREATCRQFEEHNCNRGGYCNFMHVKEIGRDLRKRLYGHLHRSRRSHSRSSRSPSPYHYHSRDRDRSSRLSRDRGDYYGGSLDRGDYGDYHHHSRRSSERNRNYDSDGSRRRRHRSRTRSPVREGSEERRAKIEQWNREREAQA

SEQ ID NO: 6249 - protein, 314 aa, Hordeum vulgare
MAEHLASIFGTEKDRVNCPFYFKIGACRHGDRCSRLHNKPSVSPTLLLCNMYQRPDMITPGVDAQGNPINPVKIQGDFEDFYEDIFDELSKHGEVENLHVCDNLADHLIGNVYVQFREEDQAAKALQALQGRFYSGRPIIAEFSPVTDFREATCRQFEEHNCNRGGYCNFMHVKQIGRDLRKRLYGHLHSSRRSHSRSSRSPSPYRHHARDRDRSSRSKDRGDYYGGSLDRGDYGDYYHHSRRSSERNRNYDSDGSRRRRHRSRTRSPVREGSEERRAKIEQWNRERDAPARQGSEERRAKIEQWNRERETAQA

SEQ ID NO: 6250 - protein, 380 aa, Sorghum bicolor
MGSGEKTVTAYGEYTYAELEREPYWPSEKLRISITGAGGFIGSHIARRLKSEGHYIIASDWKKNEHMTEDMFCHEFHLVDLRVMDNCLKVTQGVDHVFNLAADMGGMGFIQSNHSVIMYNNTMISFNMLEAARINGVKRFFYASSACIYPEFKQLDTNVSLKESDAWPAEPQDAYGLEKLATEELCKHYTKDFGIECRVGRFHNIYGPFGTWKGGREKAPAAFCRKAQTSTERFEMWGDGLQTRSFTFIDECVEGVLRLTKSDFREPVNIGSDEMVSMNEMAEIVLSFEDRKLPIHHIPGPEGVRGRNSDNTLIKEKLGWAPTMKLKDGLRFTYFWIKEQIEKEKTQGVDIAAYGSSKVVSTQAPVQLGSLRAADGKEGL

SEQ ID NO: 6251 - protein, 380 aa, Zea mays
MGSSEKTVTAYGEYTYAELEREPYWPSEKLRISITGAGGFIGSHIARRLKNEGHYIIASDWKKNEHMTEDMFCHEFHLVDLRVMDNCLKVTHGVDHVFNLAADMGGMGFIQSNHSVIMYNNTMISFNMLEAARINGVKRFFYASSACIYPEFKQLDTNVSLKESDAWPAEPQDAYGLEKLATEELCKHYTKDFGIECRVGRFHNIYGPFGTWKGGREKAPAAFCRKAQTSTERFEMWGDGLQTRSFTFIDECVEGVLRLTKSDFREPVNIGSDEMVSMNEMAEIVLGFEDRKLPIHHIPGPEGVRGRNSDNTLIKEKLGWAPTMKLKDGLRFTYFWIKEQIEKEKTQGVDIAAYGSSKVVSTQAPVQLGSLRAADGKEGL

SEQ ID NO: 6252 - protein, 380 aa, Saccharum officinarum
MGSSEKTATAYGEYTYAELEREPYWPTEKLRISITGAGGFIGSHIARRLKSEGHYIIASDWKKNEHMTEDMFCHEFHLVDLRVMDNCLKVTQGVDHVFNLAADMGGMGFIQSNHSVIMYNNTMISFNMLEAARINGVKRFFYASSACIYPEFKQLDTNVSLKESDAWPAEPQDAYGLEKLATEELCKHYTKDFGIECRVGRFHNIYGPFGTWKGGREKAPAAFCRKAQTSTERFEMWGDGLQTRSFTFIDECVEGVLRLTKSDFREPVNIGSDEMVSMNEMAEIVLSFEDRKLPIHHIPGPEGVRGRNSDNTLIKEKLGWAPTMKLKDGLRFTYFWIKEQIEKEKTLGVDIAAYGSSKVVSTQAPVQLGSLRAADGKEGL

SEQ ID NO: 6253 - protein, 380 aa, Saccharum officinarum
  misc_feature (10)..(10): Xaa can be any naturally occurring amino acid
MGSSEKTATXYGEYTYAELEREPYWPTEKLRISITGAGGFIGSHIARRLKSEGHYIIASDWKKNEHMTEDMFCHEFHLVDLRVMDNCLKVTQGVDHVFNLAADMGGMGFIQSNHSVIMYNNTMISFNMLEAARINGVKRFFYASSACIYPEFKQLDTNVSLKESDAWPAEPQDAYGLEKLATEELCKHYTKDFGIECRVGRFHNIYGPFGTWKGGREKAPAAFCRKAQTSTERFEMWGDGLQTRSFTFIDECVEGVLRLTKSDFREPVNIGSDEMVSMNEMAEIVLSFEDRKLPIHHIPGPEGVRGRNSDNTLIKEKLGWAPTMKLKDGLRFTYFWIKEQIEKEKTLGVDIAAYGSSKVVSTQAPVQLGSLRAADGKEGL

SEQ ID NO: 6254 - protein, 380 aa, Panicum virgatum
MGSSEKTVTAYGEYTYAELEREPYWPSEKLRISITGAGGFIGSHIARRLKSEGHYIIASDWKKNEHMTEDMFCHEFHLVDLRVMDNCLKVTQGVDHVFNLAADMGGMGFIQSNHSVIMYNNTMISFNMLEAARINGVKRFFYASSACIYPEFKQLDTNVSLKESDAWPAEPQDAYGLEKLATEELCKHYTKDFGIECRIGRFHNIYGPFGTWKGGREKAPAAFCRKAQTSTERFEMWGDGLQTRSFTFIDECVEGVLRLTKSDFREPVNIGSDEMVSMNEMAEIVLSFEDRKLPIHHIPGPEGVRGRNSDNTLIKEKLGWAPTMKLKDGLRFTYFWIKEQIEKEKIQGIDIAAYGSSKVVSTQAPVQLGSLRAADGKEGL

SEQ ID NO: 6255 - protein, 380 aa, Panicum virgatum
MGSSEKTVSAYGEYTYAELEREPYWPSEKLRISITGAGGFIGSHIARRLKSEGHYIIASDWKKNEHMTEDMFCHEFHLVDLRVMDNCLKVTQGVDHVFNLAADMGGMGFIQSNHSVIMYNNTMISFNMLEAARINGVKRFFYASSACIYPEFKQLDTNVSLKESDAWPAEPQDAYGLEKLATEELCKHYTKDFGIECRIGRFHNIYGPFGTWKGGREKAPAAFCRKAQTSTERFEMWGDGLQTRSFTFIDECVEGVLRLTKSDFCEPVNIGSDEMVSMNEMAEIVLSFEDRKLPIHHIPGPEGVRGRNSDNTLIKEKLGWAPTMKLKDGLRFTYFWIKEQIEKEKTQGVDVAAYGSSKVVSTQAPVQLGSLRAADGKEGL

SEQ ID NO: 6256 - protein, 375 aa, Pennisetum glaucum
MGSSVYGEYTYAELEREPYWPSEKLRISITGAGGFIGSHIARRLKSEGHYIIASDWKKNEHMTEDMFCHEFHLVDLRVMDNCLKVTQGVDHVFNLAADMGGMGFIQSNHSVIMYNNTMISFNMLEAARINGVKRFFYASSACIYPEFKQLDTNVSLKESDAWPAEPQDAYGLEKLATEELCKHYTKDFGIECRIGRFHNIYGPFGTWKGGREKAPAAFCRKAQTSTERFEMWGDGLQTRSFTFIDECVEGVLRLTKSDFREPVNIGSDEMVSMNEMAEIVLSFEDRKLPIHHIPGPEGVRGRNSDNTLIKEKLGWAPTMKLKDGLRFTYFWIKEQIEKEKTQGIDIAAYGSSKVVSTQAPVQLGSLRAADGNEGL

SEQ ID NO: 6257 - protein, 378 aa, Brachypodium distachyon
MGSTDKTGTPYGEYTYAELERELYWPSEKLRISITGAGGFIGSHIARRLKSEGHYIIASDWKKNEHMTEDMFCHEFHLVDLRVMDNCLKVTNGVDHVFNLAADMGGMGFIQSNHSVIMYNNTMISFNILEAGRINGVKRFFYASSACIYPEFKQLETNVSLKEADAWPAEPQDAYGLEKLATEELCKHYTKDFAIECRVGRFHNIYGPFGTWKGGREKAPAAFCRKAQTSTERFEMWGDGLQTRSFTFIDECVEGVLRLTKSDFREPVNIGSDEMVSMNEMAEIVLGFEDKKLPIHHIPGPEGVRGRNSDNTLIKEKLGWAPTMRLKDGLRFTYFWIKEQIEKERTEGMDVARYGSSKVVSTQAPVQLGSLRAADGKE

SEQ ID NO: 6258 - protein, 376 aa, Quercus alba
MGSTGEAKYGAYTYENLEREPYWPSEKLRISITGAGGFIASHIARRLKSEGHYIIASDWKKNEHMTEDMFCHEFHLVDLRVMDNCLKVTNGVDHVFNLAADMGGMGFIQSNHSVIMYNNTMISFNMLEAGRINGVKRFFYASSACIYPEFKQLETNVSLKESDAWPAEPQDAYGLEKLATEELCKHYTKDFGIECRVGRFHNIYGPFGTWKGGREKAPAAFCRKAQTSTDKFEMWGDGLQTRSFTFIDECVEGVLRLTKSDFREPVNIGSDEMVSMNEMAEIVLSFENKQLPIHHIPGPEGVRGRNSDNTLIKEKLGWAPTMKLKDGLRFTYFWIKEQIEKEKAQGVDLSTYGSSKVVGTQAPVQLGSLRAADGKE

SEQ ID NO: 6259 - protein, 381 aa, Cenchrus ciliaris
  misc_feature (93)..(93): Xaa can be any naturally occurring amino acid
  misc_feature (156)..(156): Xaa can be any naturally occurring amino acid
  misc_feature (185)..(185): Xaa can be any naturally occurring amino acid
  misc_feature (199)..(199): Xaa can be any naturally occurring amino acid
  misc_feature (309)..(309): Xaa can be any naturally occurring amino acid
  misc_feature (330)..(331): Xaa can be any naturally occurring amino acid
  misc_feature (349)..(349): Xaa can be any naturally occurring amino acid
  misc_feature (351)..(351): Xaa can be any naturally occurring amino acid
  misc_feature (360)..(361): Xaa can be any naturally occurring amino acid
  misc_feature (377)..(377): Xaa can be any naturally occurring amino acid
  misc_feature (381)..(381): Xaa can be any naturally occurring amino acid
MGSSEKTVTAYGEYTYAELEREPYWPSEKLRISITGAGGFIGSHIARRLKSEGHYIIASDWKKNEHMTEDMFCHEFHLVDLRVMDNCLKVTQXVDHVFNLAADMGGMGFIQSNHSVIMYNNTMISFNMLEAARINGVKRFFYASSACIYPEFKQLXTNVSLKESDAWPAEPQDAYGLEKLATEEXCKHYTKDFGIECRXGRFHNIYGPFGTWKGGREKAPAAFCRKAQTSTERFEMWGDGLQTRSFTFIDECVEGVLRLTKSDFREPVNIGSDEMVSMNEMAEIVLSFEDRKLPIHHIPGPEGVRGRNXDNTLIKEKLGWAPTMKLKDGXXFTYFWIKEQIEKEKTQGXDXAAYGSSKVXXTQAPVQLGSLRAADGXEGLX

SEQ ID NO: 6260 - protein, 376 aa, Castanea mollissima
MGSTGEAKYGAYTYENLEREPYWPSEKLRISITGAGGFIASHIARRLKSEGHYIIASDWKKNEHMTEDMFCHEFHLVDLRVMDNCLKVTKGVDHVFNLAADMGGMGFIQSNHSVIMYNNTMISFNMLEAGRINGVKRFFYASSACIYPEFKQLETNVSLKESDAWPAEPQDAYGLEKLATEELCKHYTKDFGIECRIGRFHNIYGPFGTWKGGREKAPAAFCRKAQTSTDKFEMWGDGLQTRSFTFIDECVEGVLRLTKSDFREPVNIGSDEMVSMNEMAEIVLSFENKQLPIHHIPGPEGVRGRNSDNTLIKEKLGWAPTMKLKDGLRFTYFWIKEQIEKEKAQGVDLAAYGSSKVVGTQAPVQLGSLRAADGKE

SEQ ID NO: 6261 - protein, 376 aa, Ricinus communis
MGSSEGTNYGAYTYENLEREPYWPSEKLRISITGAGGFIASHIARRLKSEGHYIIASDWKKNEHMTEDMFCHEFHLVDLRVMDNCLKVTKGVDHVFNLAADMGGMGFIQSNHSVIMYNNTMISFNMLEASRINGVKRLFYASSACIYPEFKQLDTNVSLKESDAWPAEPQDAYGLEKLATEELCKHYTKDFGIECRIGRFHNIYGPFGTWKGGREKAPAAFCRKALTSTDKFEMWGDGLQTRSFTFIDECVEGVLRLTKSDFREPVNIGSDEMVSMNEMAEIVLSFEDRKLPIHHIPGPEGVRGRNSDNTLIKEKLGWAPTMRLKDGLRITYFWIKEQIEKEKSQGVDLSIYGSSKVVGTQAPVQLGSLRAADGKE

SEQ ID NO: 6262 - protein, 375 aa, Citrus sinensis
MGSSEGTYGAYTYEELEREPYWPSEKLRISVTGAGGFIASHIARRLKSEGHYIIASDWKKNEHMTEDMFCHEFHLVDLRVMDNCLKVTKGVDHVFNLAADMGGMGFIQSNHSVIMYNNTMISFNMLEASRISGVKRFFYASSACIYPEFKQLETNVSLKESDAWPAEPQDAYGLEKLASEELCKHYTKDFGIECRVGRFHNIYGPFGTWKGGREKAPAAFCRKALTSTDKFEMWGDGLQTRSFTFIDECVEGVLRLTKSDFREPVNIGSDEMVSMNEMAEIVLSFEDKKLPIHHIPGPEGVRGRNSDNTLIKEKLGWAPSMKLKDGLRITYFWIKEQIEKEKTQGIDLSVYGSSKVVGTQAPVQLGSLRAADGKE

SEQ ID NO: 6263 - protein, 378 aa, Hordeum vulgare
MGSTDETGTPYGEYTYAELERELYWPSEKLRISVTGAGGFIGSHIARRLKSEGHYIIASDWKKNEHMTEDMFCHEFHLADLRVMDNCLKVTTNVDHVFNLAADMGGMGFIQSNHSVIMYNNTMISFNMLEAGRINGVKRFFYASSACIYPEFKQLETNVSLKEADAWPAEPQDAYGLEKLATEELCKHYTKDFDIECRIGRFHNIYGPFGTWKGGREKAPAAFCRKAQTSTERFEMWGDGLQTRSFTFIDECVEGVLRLTKSDFCEPVNIGSDEMVSMNEMAEIVLGFEDKKLPIHHIPGPEGVRGRNSDNTLIKEKLGWAPTMKLKDGLRFTYFWIKEQIEKERTEGKDVARYGSSKVVSTQAPVQLGSLRAADGKE

SEQ ID NO: 6264 - protein, 376 aa, Theobroma cacao
MGSADGTNYGAYTYEALEREPYWPSEKLRISITGAGGFIASHIARRLKSEGHYIIASDWKKNEHMTEDMFCHEFHLADLRVMDNCLKVTNGVDHVFNLAADMGGMGFIQSNHSVIMYNNTMISFNMLEAARINGVKRFFYASSACIYPEFKQLETNVSLKESDAWPAEPQDAYGLEKLATEELCKHYTKDFGIECRIGRFHNIYGPFGTWKGGREKAPAAFCRKAITSTDKFEMWGDGLQTRSFTFIDECVEGVLRLTKSDFREPVNIGSDEMVSMNEMAEIVLSFEDKKLPIHHIPGPEGVRGRNSDNTLIKEKLGWAPTMRLKDGLRITYFWIKEQIEKEKSQGIDLTIYGSSKVVGTQAPVQLGSLRAADGKE

SEQ ID NO: 6265 - protein, 375 aa, Eschscholzia californica
MGSTGGDYGEYTYAELVREPYWPSEKLKISITGAGGFIASHIARRLKSEGHYIIASDWKKNEHMTEDMFCHEFHLVDLRVMDNCLKVTSGVDHVFNLAADMGGMGFIQSNHSVIMYNNTMISFNMLEAGRINGVKRFFYASSACIYPEFKQLETNVSLKEADAWPAEPQDAYGLEKLATEELCKHYTKDFGIECRIGRFHNIYGPFGTWKGGREKAPAAFCRKAQTSTDKFEMWGDGLQTRSFTFIDECVEGVLRLTKSDFREPVNIGSDEMVSMNEMAEIVLGFEDKNLPIHHIPGPEGVRGRNSDNTLIKEKLGWAPTMRLKDGLRFTYFWIKEQIEKEKNQGIDLSVYGSSKVVGTQAPVQLGSLRAADGKE

SEQ ID NO: 6266 - protein, 376 aa, Petunia hybrida
MGSSGGIDYGAYTYENLEREPYWPSEKLRISITGAGGFIASHIARRLKSEGHYIIASDWKKNEHMTEDMFCHEFHLADLRVMDNCLKVTKGVDHVFNLAADMGGMGFIQSNHSVIFYNNTMISFNMMEAARINGVKRFFYASSACIYPEFKQLETNVSLKESDAWPAEPQDAYGLEKLATEELCKHYNKDFGIECRIGRFHNIYGPFGTWKGGREKAPAAFCRKAQTATDKFEMWGDGLQTRSFTFIDECVEGVLRLTKSDFREPVNIGSDEMVSMNEMAEIVLSFEDKKLPIHHIPGPEGVRGRNSDNTLIKEKLGWAPTMRLKDGLRFTYFWIKEQIEKEKSQGVDIGTYGSSKVVGTQAPVQLGSLRAADGKE

SEQ ID NO: 6267 - protein, 376 aa, Cleome gynandra
MGSNNGTEYGAYTYKELEREPYWPSEKLRISITGAGGFIASHIARRLKNEGHYIIASDWKKNEHMTEDMFCHEFHLVDLRVMDNCLKVTKGVDHVFNLAADMGGMGFIQSNHSVIMYNNTMISFNMIEAARINGVKRFFYASSACIYPEFKQLDTNVSLKESDAWPAEPQDAYGLEKLATEELCKHYNKDFGIECRIGRFHNIYGPFGTWKGGREKAPAAFCRKALTSTDRFEMWGDGLQTRSFTFIDECVEGVLRLTKSDFREPVNIGSDEMVSMNEMAEMVLSFEDKKLPIHHIPGPEGVRGRNSDNTLIKEKLGWAPTMRLKDGLRITYFWIKEQIEKEKSQGGDVSAYGSSKVVGTQAPVQLGSLRAADGKE

SEQ ID NO: 6268 - protein, 376 aa, Gossypium hirsutum
MGSTDGTSYGAYTYDALEREPYWPSEKLRISITGAGGFIASHIARRLKSEGHYIIASDWKKNEHMTEDMFCHEFHLVDLRVMENCLKVTNGVDHVFNLAADMGGMGFIQSNHSVIMYNNTMISFNMLEAARISGVKRFFYASSACIYPEFKQLETNVSLKESDAWPAEPQDAYGLEKLATEELCKHYTKDFGIECRIGRFHNIYGPFGTWKGGREKAPAAFCRKAITSIDKFEMWGDGLQTRSFTFIDECVEGVLRLTKSDFREPVNIGSDEMVSMNEMAEIVLSFEDKKLPIHHIPGPEGVRGRNSDNTLIKEKLGWAPTMRLKDGLRITYFWIKEQIEKEKAQGIDLSVYGSSKVVGTQAPVQLGSLRAADGKE

SEQ ID NO: 6269 - protein, 376 aa, Vitis vinifera
MGSNDGTTYGAYTYGELEREPYWQSEKLRISITGAGGFIASHIARRLKTEGHYIIASDWKKNEHMTEDMFCHEFHLVDLRVMDNCLKVTTGVDHVFNLAADMGGMGFIQSNHSVIMYNNTMISFNMLEASRINGVKRFFYASSACIYPEFKQLETNVSLKESDAWPAEPQDAYGLEKLATEELCKHYTKDFGIECRIGRFHNIYGPFGTWKGGREKAPAAFCRKALTSTDKFEMWGDGLQTRSFTFIDECVEGVLRLTKSDFREPVNIGSDEMVSMNEMAEIVLSFENKNLPIHHIPGPEGVRGRNSDNTLIKEKLGWAPTMKLKDGLRITYFWIKEQIEKEKVQGIDLSIYGSSKVVGTQAPVQLGSLRAADGKE

SEQ ID NO: 6270 - protein, 376 aa, Carica papaya
MGSNDGTDYGAYTYKELEREPYWPSEKLRISITGAGGFIASHIARRLKSEGHYIIASDWKKNEHMTEDMFCHEFHLVDLRVMDNCLKVTKGVDHVFNLAADMGGMGFIQSNHSVIMYNNTMISFNMLEASRINGVKRFFYASSACIYPEFKQLETNVSLKESDAWPAEPQDAYGLEKLATEELCKHYTKDFGIECRIGRFHNIYGPFGTWKGGREKAPAAFCRKAITSTDKFEMWGDGIQTRSFTFIDECVEGVLRLTKSDFREPVNIGSDEMVSMNEMAEIVLSFENKKLPIQHIPGPEGVRGRNSDNTLIKEKLGWAPTMKLKDGLRITYFWIKEQIEKEKSQGIDLSIYGSSKVVGTQAPVQLGSLRAADGKE

SEQ ID NO: 6271 - protein, 378 aa, Triticum aestivum
MGSTDETGTPYGEYTYAELERELYWPSEKLRISVTGAGGFIGSHIARRLKSEGHYIIASDWKKNEHMTEDMFCHEFHLADLRVMDNCLKVTTNVDHVFNLAADMGGMGFIQSNHSVIMYNNTMISFNMLEAGRINGVKRFFYASSACIYPEFKQLETNVSLKEADAWPAEPQDAYGLEKLATEELCKHYTKDFDIECRIGRFHNIYGPFGTWKGGREKAPAAFCRKAQTSTEQFEMWGDGLQTRSFTFIDECVEGVLRLTKSDFCEPVNIGSDEMVSMNEMAEIVLGFEDKKLPIHHIPGPEGVRGRNSDNTLIKEKLGWAPTMRLKDGLRFTYFWIKEQIEKERTEGKDVALYGSSKVVSTQAPVQLGSLRAADGKE

SEQ ID NO: 6272 - protein, 376 aa, Vitis vinifera
MGSTEGTTYGEYTYENLEREPYWPSEKLRISITGAGGFIASHIARRLKTEGHYIIASDWKKNEHMPEDMFCHEFHLVDLRVMDNCLKVTTGVDHVFNLAADMGGMGFIQSNHSVIMYNNTMISFNMLEASRINGVKRFFYASSACIYPEFKQLETNVSLKESDAWPAEPQDAYGLEKLATEELCKHYTKDFGIECRIGRFHNIYGPFGTWKGGREKAPAAFCRKAITSTDKFEMWGDGLQTRSFTFIDECVEGVLRLTKSDFREPVNIGSDEMVSMNEMAEIVLSFENKNLPIHHIPGPEGVRGRNSDNNLIKEKLGWAPTMRLKDGLRITYFWIKEQIEKEKVQGIDLSVYGSSKVVGTQAPVQLGSLRAADGKE

SEQ ID NO: 6273 - protein, 376 aa, Manihot esculenta
MGSTDGTSYGAFTYENLEREPYWSSEKLRISITGAGGFIASHIARRLKSEGHYIIASDWKKNEHMTEDMFCHEFHLVDLRVMDNCLKVTKDVDHVFNLAADMGGMGFIQSNHSVIMYNNTMISFNMLEAARINGVKRFFYASSACIYPEFKQLDTNVSLKESDAWPAEPQDAYGLEKLATEELCKHYTKDFGIECRIGRFHNIYGPFGTWKGGREKAPAAFCRKAITSTDKFEMWGDGLQTRSFTFIDECVEGVLRLTKSDFREPVNIGSDEMVSMNEMAEIVLSFENKKLPIHHIPGPEGVRGRNSDNTLIKEKLGWAPTMKLKDGLRITYFWIKEQIEKEKAQGIDLSIYGSSKVVGTQAPVQLGSLRAADGKE

SEQ ID NO: 6274 - protein, 378 aa, Cycas rumphii
MGSAGNDGVVYGAYTYENLERELYWPSEKLRISITGAGGFIASHIARRLKSEGHYIIASDWKKNEHMTEDMFCHEFHLVDLRVMDNCLAVTKGVDHVFNLAADMGGMGFIQSNHSVIMYNNTMISFNMLEAARINGVKRFFYASSACIYPEFKQLETNVSLKESDAWPAEPQDAYGLEKLATEELCKHYTKDFGIECRIGRFHNIYGPFGTWKGGREKAPAAFCRKAITSTDKFEMWGDGVQTRSFTFIDECVEGVLRLTKSDFREPVNIGSDEMVSMNEMAEIVLSFENKKLPIHHIPGPEGVRGRNSDNTLIKEKLGWAPTMRLKDGLRITYFWIKEQIEKEKAQGIDLSIYGSSKVVGTQAPVQLGSLRAADGKE

SEQ ID NO: 6275 - protein, 376 aa, Actinidia deliciosa
MGSTSESNYGSYTYENLEREPYWPEAKLRISITGAGGFIASHIARRLKGEGHYIIASDWKKNEHMTEDMFCHEFHLVDLRVMDNCLKVTTGVDHVFNLAADMGGMGFIQSNHSVIMYNNTMISFNMLEAARVNGVKRFFYASSACIYPEFKQLDTNVSLKESDAWPAEPQDAYGLEKLATEELCKHYTKDFGIECRIGRFHNIYGPFGTWKGGREKAPAAFCRKTLTSTDRFEMWGDGLQTRSFTFIDECVEGVLRLTKSDFREPVNIGSDEMVSMNEMAEIVLSFEDKKLPIHHIPGPEGVRGRNSDNTLIKEKLGWAPTMKLKDGLRFTYFWIKEQLEKEKAQGIDLSTYGSSKVVGTQAPVQLGSLRAADGKE

SEQ ID NO: 6276 - protein, 376 aa, Cucumis sativus
MGSAGETTYGSYTYQELEREAYWPSEKLRISITGAGGFIASHIARRLKSEGHYIIASDWKKNEHMTEDMFCHEFHLVDLRVMDNCMKVTENVDHVFNLAADMGGMGFIQSNHSVIMYNNTMISFNMLEAARINGVKRFFYASSACIYPEFKQLETNVSLKESDAWPAEPQDAYGLEKLATEELCKHYTKDFGIECRIGRFHNIYGPFGTWKGGREKAPAAFCRKALTSVDKFEMWGDGLQTRSFTFIDECVEGVLRLTKSDFREPVNIGSDEMVSMNEMAEIVLSFDDKKLPIHHIPGPEGVRGRNSDNTLIKEKLGWAPTMKLKDGLRITYMWIKEQIEKEKSKGIDLTVYGSSKVVGTQAPVQLGSLRAADGKE

SEQ ID NO: 6277 - protein, 376 aa, Manihot esculenta
MGSTEGTNYGAFTYENLEREPYWPSEKLRISITGAGGFIASHIARRLKSEGHYIIASDWKKNEHMTEDMFCHEFHLVDLRVMDNCLKVTKDVDHVFNLAADMGGMGFIQSNHSVIMYNNTMISFNMLEAARISGVKRFFYASSACIYPEFKQLDTNVSLKESDAWPAEPQDAYGLEKLATEELCKHYTKDFGIECRIGRFHNIYGPFGTWKGGREKAPAAFCRKAITSIDKFEMWGDGLQTRSFTFIDECVEGVLRLTKSDFREPVNIGSDEMVSMNEMADIVLSFENKKLPIHHIPGPEGVRGRNSDNTLIKEKLGWAPTMKLKDGLRITYFWIKEQIEKEKAQGIDLSIYGSSKVVGTQAPVQLGSLRAADGKE

SEQ ID NO: 6278 - protein, 376 aa, Phaseolus coccineus
MGSAGKTDYGEYTYENLEREPYWPSEKLKISITGAGGFIASHIARRLKREGHYIIASDWKKNEHMTEDMFCDEFHLVDLRVMDNCLKVTKGVDHVFNLAADMGGMGFIQSNHSVIMYNNTMISFNMIEAARINGIKRFFYASSACIYPEFKQLETNVSLKESDAWPAEPQDAYGLEKLATEELCKHYNKDFGIECRIGRFHNIYGPFGTWKGGREKAPAAFCRKVITSTDRFEMWGDGLQTRSFTFIDECVEGVLRLTKSDFREPVNIGSDEMVSMNEMAQIILGFESKNIPIHHIPGPEGVRGRNSENTLIKEKLGWAPTMKLKDGLRITYFWIKEQIEKEKTQGIDISVYGSSKVVQTQAPVQLGSLRAADGKE

SEQ ID NO: 6279 - protein, 376 aa, Arachis hypogaea
MGSSGTTDYGAYTYQELEREPYWPSEKLRISITGAGGFIASHIARRLKTEGHYIIASDWKKNEHMTEDMFCHEFHLVDLRVMDNCLTVTKGVDHVFNLAADMGGMGFIQSNHSVIMYNNTMISFNMIEAARINGVKRFFYASSACIYPEFKQLETNVSLKESDAWPAEPQDAYGLEKLATEELCKHYNKDFGIECRIGRFHNIYGPFGTWKGGREKAPAAFCRKAITSADRFEMWGDGLQTRSFTFIDECVEGVLRLTKSDFRDPVNIGSDEMVSMNEMAEIVLSFENKKIPIHHIPGPEGVRGRNSDNTLIKEKLGWAPTMKLKDGLRITYFWIKEQLEKEKAQGIDLSSYGSSKVVQTQAPVQLGSLRAADGKE

SEQ ID NO: 6280 - protein, 375 aa, Populus trichocarpa
MGSVDGSYGAYTYEALEREPYWPSENLKISITGAGGFIASHIARRLKSEGHYIIASDWKKNEHMTEDMFCHEFHLVDLRVMDNCLKVTKGVDHVFNLAADMGGMGFIQSNHSVIMYNNTMISFNMLEASRINGVKRLFYASSACIYPEFKQLETNVSLKESDAWPAEPQDAYGLEKLATEELCKHYTKDFGIECRIGRFHNIYGPFGTWKGGREKAPAAFCRKTMTSIDKFEMWGDGLQTRSFTFIDECVEGVLRLTKSDFREPVNIGSDEMVSMNEMAEIVLSFENKNLPIHHIPGPEGVRGRNSDNTLIKEKLGWAPTMKLKDGLRFTYFWIKEQIEKEKSQGMDLSIYGSSKVVGTQAPVQLGSLRAADGKE

SEQ ID NO: 6281 - protein, 376 aa, Prunus persica
MGSTGGHDYGAYTYENLEREPYWPSEKLRISITGAGGFIASHIARRLKNEGHYIIASDWKKNEHMTEDMFCHEFHLVDLRVMDNCLKVTKNVDHVFNLAADMGGMGFIQSNHSVIFYNNTMISFNMVEAARINGVKRFFYASSACIYPEFKQLETNVSLKESDAWPAEPQDAYGLEKLATEELCKHYTKDFGIECRIGRFHNIYGPFGTWKGGREKAPAAFCRKTLTSTDKFEMWGDGLQTRSFTFIDECVEGVLRLTKSDFREPVNIGSDEMVSMNEMAEIVLSFEDKKLPIQHIPGPEGVRGRNSDNTLIKEKLGWAPTMKLKDGLRITYFWIKEQIEKEKAQGTDLSIYGSSKVVGTQAPVQLGSLRAADGKE

SEQ ID NO: 6282 - protein, 376 aa, Nicotiana tabacum
MGSSGGMDYGAYTYENLEREPYWPTEKLRISITGAGGFIASHIARRLKSEGHYIIASDWKKNEHMTEDMFCHEFHLVDLRVMDNCLKVTKDVDHVFNLAADMGGMGFIQSNHSVIFYNNTMISFNMMEAARINGVKRFFYASSACIYPEFKQLETNVSLKESDAWPAEPQDAYGLEKLATEELCKHYNKDFGIECRIGRFHNIYGPFGTWKGGREKAPAAFCRKAQTAVDKFEMWGDGLQTRSFTFIDECVEGVLRLTKSDFREPVNIGSDEMVSMNEMAEMVLSFEDKKLPIHHIPGPEGVRGRNSDNTLIKEKLGWAPTMRLKDGLRITYFWIKEQIEKEKSQGVNIANYGSSKVVGTQAPVELGSLRAADGKE

SEQ ID NO: 6283 - protein, 376 aa, Gossypium hirsutum
MGSTDGTSYGAYTYDALEREPYWPSQKLRISITGAGGFIASHIARRLKSEGHYIIASDWKKNEHMTEDMFCNEFHLVDLRVMENCLKVSKGVDHVFNLAADMGGMGFIQSNHSVIMYNNTMISFNMLEAARISGVKRFFYASSACIYPEFKQLDTNVSLKESDAWPAEPQDAYGLEKLATEELCKHYTKDFGIECRIGRFHNIYGPFGTWKGGREKAPAAFCRKAITSIDKFEMWGDGLQTRSFTFIDECVEGVLRLTKSDFREPVNIGSDEMVSMNEMAEIVLSFEDKNLPIHHIPGPEGVRGRNSDNTLIKEKLGWAPTMRLKDGLRITYFWIKEQIEKEKAQGIDLSVYGSSKVVGTQAPVQLGSLRAADGKE

SEQ ID NO: 6284 - protein, 376 aa, Vigna unguiculata
MGSAGKTDYGEYTYESLEREPYWPAEKLKISITGAGGFIASHIARRLKTEGHYIIASDWKKNEHMTEDMFCDEFHLVDLRVMDNCLKVTKGVDHVFNLAADMGGMGFIQSNHSVIMYNNTMISFNMIEAARINGIKRFFYASSACIYPEFKQLETNVSLKESDAWPAEPQDAYGLEKLATEELCKHYNKDFGIECRIGRFHNIYGPFGTWKGGREKAPAAFCRKVITSTDRFEMWGDGLQTRSFTFIDECVEGVLRLTKSDFREPVNIGSDEMVSMNEMAEIILGFENKNIPIHHIPGPEGVRGRNSDNTLIKEKLGWAPTMKLKDGLRITYFWIKEQIEKEKGEGIDISVYGSSKVVQTQAPVQLGSLRAADGKE

SEQ ID NO: 6285 - protein, 375 aa, Capsicum annuum
MGSSGIDYGSYTYENLEREPYWPSEKLRISITGAGGFIASHIARRLKSEGHYIIASDWKKNEHMTEDMFCHEFHLVDLRVMANCLKVTKGVDHVFNLAADMGGMGFIQSNHSVIFYNNTMISFNMMEAARINGIKRFFYASSACIYPEFKQLETNVSLKEADAWPAEPQDAYGLEKLATEELCKHYNKDFGIECRIGRFHNIYGPFGTWKGGREKAPAAFCRKAQTATDKFEMWGDGLQTRSFTFIDECVEGVLRLTKSDFREPVNIGSDEMVSMNEMAEMVLSFEDKKLPVHHIPGPEGVRGRNSDNMLIKEKLGWAPTMKLKDGLRITYFWIKEQIEKEKSQGVDTATYGSSKVVGTQAPVELGSLRAADGKE

SEQ ID NO: 6286 - protein, 378 aa, Pinus taeda
MGSTGADGLAYGAYTYEDLEREPYWPSEKVRISITGAGGFIASHIARRLKSEGHYIIASDWKKNEHMTEDMFCHEFHLVDLRVMDNCLAVTKGVDHVFNLAADMGGMGFIQSNHSVIMYNNTMISFNMIEAARINGVKRFFYASSACIYPEFKQLETNVSLKESDAWPAEPQDAYGLEKLATEELCKHYNKDFGIECRIGRFHNIYGPFGTWKGGREKAPAAFCRKTLTSTDRFEMWGDGKQTRSFTFIDECVEGVLRLTKSDFREPVNIGSDEMVSMNEMAEMVLSFENKKLPIHHIPGPEGVRGRNSDNTLIKEKLGWAPTMKLKDGLRITYFWIKEQIEKEMVQGIDLSIYGSSKVVGTQAPVQLGSLRAADGKE

SEQ ID NO: 6287 - protein, 375 aa, Populus trichocarpa
MGSADGSYGAYTYEALEREPYWPSENLKISITGAGGFIASHIARRLKSEGHYIIASDWKKNEHMTEDMFCHEFHLVDLRVMDNCLKVTKGVDHVFNLAADMGGMGFIQSNHSVIMYNNTMISFNMLEASRINGVKRLFYASSACIYPEFKQLETNVSLKESDAWPAEPQDAYGLEKLATEELCKHYTKDFGIECRIGRFHNIYGPFGTWKGGREKAPAAFCRKTMTSIDKFEMWGDGLQTRSFTFIDECVEGVLRLTKSDFREPVNIGSDEMVSMNEMAEIVLSFENKNLPIHHIPGPEGVRGRNSDNTLIKEKLGWAPTMKLKDGLRITYFWIKEQIEKEKSQGMDLSIYGSSKVVGTQAPVQLGSLRAADGKE

SEQ ID NO: 6288 - protein, 376 aa, Fragaria vesca
MGSAGESGYGAYTYEALEREPYWPSEKLRISITGAGGFIASHIARRLKNEGHYIIASDWKKNEHMTEDMFCDEFHLVDLRVMDNCLKVTKDVDHVFNLAADMGGMGFIQSNHSVIMYNNTMISFNMLEAARITGVKRFFYASSACIYPEFKQLETNVSLKEADAWPAEPQDAYGLEKLATEELCKHYTKDFGIECRIGRFHNIYGPFGTWKGGREKAPAAFCRKALTSTDKFEMWGDGLQTRSFTFIDECVEGVLRLTKSDFREPVNIGSDEMVSMNEMAEIVLSFENKKLPIQHIPGPEGVRGRNSDNTLIKEKLGWAPTMRLKDGLRFTYFWIKEQIEKEKAQGTDLSVYGSSKVVGTQAPVQLGSLRAADGKE

SEQ ID NO: 6289 - protein, 376 aa, Nicotiana tabacum
MGSSGGMDYGAYTYENLEREPYWPTEKLRISITGAGGFIASHIARRLKSEGHYIIASDWKKNEHMTEDMFCHEFHLVDLRVMDNCLKVTKDVDHVFNLAADMGGMGFIQSNHSVIFYNNTMISFNMMEAARINGVKRFFYASSACIYPEFKQLETNVSLKESDAWPAEPQDAYGLEKLATEELCKHYNKDFGIECRIGRFHNIYGPFGTWKGGREKAPAAFCRKAQTAVDKFEMWGDGLQTRSFTFIDECVEGVLRLTKSDFREPVNIGSDEMVSMNEMAEMVLSFEDKKLPVHHIPGPEGVRGRNSDNTLIKEKLGWAPTMRLKDGLRITYFWIKEQIEKEKSQGVNIANYGSSKVVGTQAPVELGSLRAADGKE

SEQ ID NO: 6290 - protein, 376 aa, Nicotiana tabacum
MGSSGGTSYGEYTYENLEREPYWPSEKLRISITGAGGFIASHIARRLKTEGHYVIASDWKKNEHMSEDMFCHEFHLVDLRVMDNCLKVTKGVDHVFNLAADMGGMGFIQSNHSVIMYNNTMISFNMMEASRITGVKRFFYASSACIYPEFKQLETNVSLKESDAWPAEPQDAYGLEKLATEELCKHYNKDFGIECRIGRFHNIYGPFGTWKGGREKAPAAFCRKAQTSTDKFEMWGDGKQTRSFTFIDECVEGVLRLTKSDFREPVNIGSDEMVSMNEMAEMVLSFEQKMLPIHHIPGPEGVRGRNSDNTLVKEKLGWAPTMKLKDGLRITYFWIKEQIEKEKVQGADVSVYGSSKVVGTQAPVQLGSLRAADGKE

SEQ ID NO: 6291 - protein, 376 aa, Ipomoea nil
MGSSGGIDYGAYTYENLEREPYWPSEKLRISITGAGGFIASHIARRLKSEGHYVIASDWKKNEHMTEDMFCHEFHLADLRVMDNCLKVTQGVDHVFNLAADMGGMGFIQSNHSVIMYNNTMISFNMMEASRINGVKRFFYASSACIYPEFKQLETNVSLKESDAWPAEPQDAYGLEKLATEELCKHYNKDFGIECRIGRFHNIYGPFGTWKGGREKAPAAFCRKALTSTDKFEMWGDGLQTRSFTFIDECVEGVLRLTKSDFREPVNIGSDEMVSMNEMAEMVLSFDEKRLPIHHIPGPEGVRGRNSDNTLIKEKLGWAPTMRLKDGLRITYFWIKEQLEKEKAQGVDLSTYGSSKVVGTQAPVQLGSLRAADGKE

SEQ ID NO: 6292 - protein, 376 aa, Glycine max
MGSSGTTDYGAYTYQNLEREPYWPSEKLRISITGAGGFIASHIARRLKTEGHYIIASDWKKNEHMTEDMFCHEFHLVDLRVMDNCLTVTKGVDHVFNLAADMGGMGFIQSNHSVIMYNNTMISFNMIEAARINGVKRFFYASSACIYPEFKQLETNVSLKEADAWPAEPQDAYGLEKLATEELCKHYNKDFGIECRIGRFHNIYGPYGTWKGGREKAPAAFCRKTLTSKDRFEMWGDGLQTRSFTFIDECVEGVLRLTKSDFREPVNIGSDEMVSMNEMAEIVLSFEDKNIPIYHIPGPEGVRGRNSDNTLIKEKLGWAPTMKLKDGLRITYFWIKEQLEKEKAEGVDLSGYGSSKVVQTQAPVQLGSLRAADGKE

SEQ ID NO: 6293 - protein, 376 aa, Solanum lycopersicum
MGSSGGIDYGSYTYENLEREPYWPSEKLRISITGAGGFIASHIARRLKSEGHYIIASDWKKNEHMTEDMFCHEFHLADLRVMDNCLKVTKGVDHVFNLAADMGGMGFIQSNHSVIFYNNTMISFNMMEAARINSVKRFFYASSACIYPEFKQLETNVSLKEADAWPAEPQDAYGLEKLATEELCKHYNKDFGIECRIGRFHNIYGPFGTWKGGREKAPAAFCRKAQTATDKFEMWGDGLQTRSFTFIDECVEGVLRLTKSDFREPVNIGSDEMVSMNEMAEMVLSFEDKKLPVQHIPGPEGVRGRNSDNTLIKEKLGWAPTMRLKDGLRITYFWIKEQIEKEKSQGVDTATYGSSKVVGTQAPVELGSLRAADGKE

SEQ ID NO: 6294 - protein, 377 aa, Triphysaria pusilla
  misc_feature (211)..(211): Xaa can be any naturally occurring amino acid
MGSTGEPVYGAYTYESLEREPYWPSEKLRISITGAGGFIASHIARRLKSEGHYIIASDWKKNEHMTEDMFCHEFHLVDLRVMDNCLKVTDGVDHVFNLAADMGGMGFIQSNHSVIMYNNTMISFNMIEAARINAVKRFFYASSACIYPEFKQLETNVSSLKESDAWPAEPQDAYGLEKLATEELCKHYNKDFGIECRIGRFHNIYGPFGTXKGGREKAPAAFCRKALTSTDKFEMWGDGLQTRSFTFIDECVEGVLRLTKSDFREPVNIGSDEMVSMNEMAEIVLSFDNKKLPIHHIPGPEGVRGRNSDNTLIKEKLGWAPTMKLKDGLRITYFWIKEQLEKEKTKGVDLSNYGSSKVVGTQAPVQLGSLRAADGKE

SEQ ID NO: 6295 - protein, 371 aa, Unknown
  Sequence found in Organisms: Pennisetum glaucum, Panicum virgatum
MALNKEYTYAELEKEPYWPFEKLRISITGAGGFIASHIARRLKSEGHYIIASDWKKNEHMTEDMFCHEFHLVDLRVMDNCLKVTTGVDHVFNLAADMGGMGFIQSNHSVIMYNNTMISFNMLEAARINGVKRFFYASSACIYPEFKQLETVVSLKESDAWPAEPQDAYGLEKLATEELCKHYTKDFGIECRIGRFHNIYGPFGTWKGGREKAPAAFCRKALTSTGRFEMWGDGLQTRSFTFIDECVEGVLRLTKSDFREPVNIGSDEMVSMNEMAEIVLSFENKQLPIHHIPGPEGVRGRNSDNTLIKEKLGWAPTMKLKDGLRITYFWIKEQLEKEKAEGMDLSVYGSSKVVQTQAPVQLGSLRAADGKE

SEQ ID NO: 6296 - protein, 376 aa, Tropaeolum majus
MERTDGTDYGEYTYKELEREPYWPSEKLRISITGAGGFIASHIARRLKNEGHYIIASDWKKNEHMTEDMFCHEFHLADLRVMNNCLKVTKDVDHVFNLAADMGGMGFIQSNHSVIMYNNTMISFNMLEAARINGVKRFFYASSACIYPEFKQLETNVSLKEADAWPAEPQDAYGLEKLATEELCKHYTKDFGIECRIGRFHNIYGPFGTWKGGREKAPAAFCRKALTSTHKFEMWGDGLQTRSFTFIDECVEGVLRLTKSDFREPVNIGSDEMVSMNEMAEIVLGFDNKKLPIEHIPGPEGVRGRNSDNTLIKEKLGWAPTMKLKDGLRFTYFWIKEQIEKEKVQGIDLSVYGSSKVVGTQAPVQLGSLRAADGKE

SEQ ID NO: 6297 - protein, 376 aa, Unknown
  Sequence found in Organisms: Solanum tuberosum, Solanum phureja
MGSSGGINYGSYTYENLEREPYWPSEKLRISITGAGGFIASHIARRLKSEGHYIIASDWKKNEHMTEDMFCHEFHLADLRVMDNCLKVTKGVDHVFNLAADMGGMGFIQSNHSVIFYNNTMISFNMMEAARINSVKRFFYASSACIYPEFKQLETNVSLKEADAWPAEPQDAYGLEKLATEELCKHYNKDFGIECRIGRFHNIYGPFGTWKGGREKAPAAFCRKAQTATDKFEMWGDGLQTRSFTFIDECVEGVLRLTKSDFREPVNIGSDEMVSMNEMAEMVLSFEDKKLAVQHIPGPEGVRGRNSDNTLIKEKLGWAPTMRLKDGLRITYFWIKEQIEKEKSQGVDTATYGSSKVVGTQAPVELGSLRAADGKE

SEQ ID NO: 6298 - protein, 378 aa, Pinus taeda
MGSIGADGMTYGEYTYENLDRELYWPSEKLKISITGAGGFIASHIARRLKSEGHYIIASDWKKNEHMTEDMFCNEFHLVDLRVMDNCLAVTKGVDHVFNLAADMGGMGFIQSNHSVIMYNNTMISFNMLEAGRINGVKRLFYASSACIYPEFKQLETNVSLKESDAWPAEPQDAYGLEKLATEELCKHYTKDFGIECRIGRFHNIYGPFGTWKGGREKAPAAFCRKTITSTDRFEMWGDGEQTRSFTFIDECVEGVLRLTKSDFREPVNIGSDEMVSMNEMAEMVSSFENKKLPIHHIPGPEGVRGRNSDNTLIKEKLGWAPTMKLKDGLRITYFWIKEQIEKEKAQGIDLSIYGSSKVVGTQAPVQLGSLRAADGKE

SEQ ID NO: 6299 - protein, 375 aa, Populus trichocarpa
MGTADGSYGSYTYEALEREPYWPSEKLRISITGAGGFIASHIARRLKAEGHYIIASDWKKNEHMTEDMFCHEFHLVDLRVMDNCLKVTKDVDHVFNLAADMGGMGFIQSNHSVIMYNNTMISFNMLEASRINGVKRLFYASSACIYPEFKQLETNVSLKESDAWPAEPQDAYGLEKLATEELCKHYTKDFGIECRIGRFHNIYGPFGTWKGGREKAPAAFCRKAITSIDKFEMWGDGLQTRSFTFIDECVEGVLRLTKSDFREPVNIGSDEMVSMNEMAEIVLSFENKNLPIHHIPGPEGVRGRNSDNTLIKEKLGWAPTMRLKDGLRITYFWIKEQIEKEKSKGIDLSIYGSSKVVGTQAPVQLGSLRAADGKE

SEQ ID NO: 6300 - protein, 371 aa, Oryza sativa
MALNEEYTYVELEKEPYWPFEKLRISITGAGGFIASHIARRLKSEGHYIIASDWKKNEHMTEDMFCHEFHLVDLRVMDNCLKVTTGVDHVFNLAADMGGMGFIQSNHSVIMYNNTMISFNMLEAARINGVKRFFYASSACIYPEFKQLDTVVSLKESDAWPAEPQDAYGLEKLATEELCKHYTKDFGIECRVGRFHNIYGPFGTWKGGREKAPAAFCRKALTSTDRFEMWGDGLQTRSFTFIDECVEGVLRLTKSDFREPVNIGSDEMVSMNEMAEIVLSFENKQLPIHHIPGPEGVRGRNSDNTLIKEKLGWAPTMRLKDGLRITYFWIKEQLEKEKAEGVDLSAYGSSKVVQTQAPVQLGSLRAADGKE

SEQ ID NO: 6301 - protein, 378 aa, Picea glauca
MGSIGADGVTFGEYTYENLDRELYWPSEKLKISITGAGGFIASHIARRLKSEGHYIIASDWKKNEHMTEDMFCNEFHLVDLRVMDNCLAVTKGVDHVFNLAADMGGMGFIQSNHSVIMYNNTMISFNMLEAARINGVKRFFYASSACIYPEFKQLETNVSLKESDAWPAEPQDAYGLEKLATEELCKHYTKDFGIECRIGRFHNIYGPFGTWKGGREKAPAAFCRKTITSTDRFEMWGDGEQTRSFTFIDECVEGVLRLTKSDFREPVNIGSDEMVSMNEMAEMVSSFENKKLPIHHIPGPEGVRGRNSENTLIKEKLGWAPTMKLKDGLRITYFWIKEQIEKEKAQGIDLSIYGSSKVVGTQAPVQLGSLRAADGKE

SEQ ID NO: 6302 - protein, 377 aa, Triphysaria pusilla
MGSTGEPVYGAYTYESLEREPYWPSEKLRISITGAGGFIASHIARRLKSEGHYIIASDWKKNEHMSEDMFCHEFHLVDLRVMDNCLKVTESVDHVFNLAADMGGMGFIQSNHSVIMYNNTMISFNMIEAARINAVKRFFYASSACIYPEFKQLETNVSSLKESDAWPAEPQDAYGLEKLATEELCKHYNKDFGIECRIGRFHNIYGPFGTWKGGREKAPAAFCRKALTSTDKFEMWGDGLQTRSFTFIDECVEGVLRLTKSDFREPVNIGSDEMVSMNEMAEIVLSFDNKKLPIHHIPGPEGVRGRNSDNTLIKEKLGWAPTMKLKDGLRITYFWIKEQLEKEKTKGVDLSNYGSSKVVGTQAPVQLGSLRAADGKE

SEQ ID NO: 6303 - protein, 378 aa, Aquilegia formosa
MGSTDAATKYGEYTYEQLERELYWPSEKLRISITGAGGFIASHIARRLKTEGHYIIASDWKKNEHMPEDMFCHEFHLADLRVMDNCMKVTSGVDHVFNLAADMGGMGFIQSNHSVIMYNNTMISFNMLEAARINGVKRFFYASSACIYPEFKQLETSNVSLKEADAWPAEPQDAYGLEKLATEELCKHYTKDFGIECRIGRFHNIYGPFGTWKGGREKAPAAFCRKALTAIDKFEMWGDGLQTRSFTFIDECVEGVLRLTKSDFREPVNIGSDEMVSMNEMAEIVLGFEDKKLPIQHIPGPEGVRGRNSDNTLIKEKLGWAPTMRLKDGLRITYFWIKEQIEKEKTRGIDLSVYGSSKVVGTQAPVQLGSLRAADGKE

SEQ ID NO: 6304 - protein, 371 aa, Saccharum officinarum
MALNKEYTYAELEKEPYWPFEKLRISITGAGGFIASHIARRLKSEGHYIIASDWKKNEHMSEDMFCHEFHLVDLRVMDNCLKVTTGVDHVFNLAADMGGMGFIQSNHSVIMYNNTMISFNMLEAARINGVKRFFYASSACIYPEFKQLETVVSLKESDAWPAEPQDAYGLEKLATEELCKHYTKDFGIECRVGRFHNIYGPFGTWKGGREKAPAAFCRKALTSTGRFEMWGDGLQTRSFTFIDECVEGVLRLTKSDFREPVNIGSDEMVSMNEMAEIVLSFENKQLPIHHIPGPEGVRGRNSDNTLIKEKLGWAPTMRLKDGLRITYFWIKEQLEKEKADGMDLSVYGSSKVVQTQAPVQLGSLRAADGKE

SEQ ID NO: 6305 - protein, 376 aa, Solanum melongena
MGTSVETTYGEYTYENLEREPYWPSEKLRISITGAGGFIASHIARRLKTEGHYIIASDWKKNEHMSEDMFCHEFHLVDLRVMDNCLKVTKGVDHVFNLAADMGGMGFIQSNHSVIMYNNTMISFNMMEASRINGIKRFFYASSACIYPEFKQLETNVSLKESDAWPAEPQDAYGLEKLATEELCKHYNKDFGIECRIGRFHNIYGPFGTWKGGREKAPAAFCRKALTSTDKFEMWGDGKQTRSFTFIDECVEGVLRLTKSDFREPVNIGSDEMVSMNEMAEIVLSFDGKNLPIHHIPGPEGVRGRNSDNTLIKEKLGWAPTMKLKDGLRFTYLWIKEQIEKEKVKGADVSIYGSSKVVGTQAPVELGSLRAADGKE

SEQ ID NO: 6306 - protein, 376 aa, Mimulus guttatus
MGSTGENLYKAYTYENLETEPYWPSEKLRISITGAGGFIASHIARRLKSEGHYIIASDWKKNEHMPEDMFCHEFHLVDLRVMDNCLKVTEGVDHVFNLAADMGGMGFIQSNHSVIMYNNTMISFNMIEAGRINGVKRFFYASSACIYPEFKQLETNVSLKESDAWPAEPQDAYGLEKLATEELCKHYNKDFGIECRIGRFHNIYGPFGTWKGGREKAPAAFCRKTLTSTDKFEMWGDGLQTRSFTFIDECVEGVLRLTKSDFREPVNIGSDEEVSMNGMAEIISSFEDKKLPIHHIPGPEGVRGRNSDNTLIKEKLGWAPSMKLKDGLRITYFWIKEQLEKEKTLGVDLSNYGSSKVVGTQAPVQLGSLRAADGKE

SEQ ID NO: 6307 - protein, 376 aa, Mimulus guttatus
MASSDETNYGSYTYETLEREPYWPSEKLRISITGAGGFIASHIARRLKSEGHYIIASDWKKNEHMTEDMFCNEFHLVDLRVMDNCLKVTDGVDHVFNLAADMGGMGFIQSNHSVIMYNNTMISFNMIEAARINGVKRFFYASSACIYPEFKQLETNVSLKESDAWPAEPQDAYGLEKLATEELCKHYNKDFGIECRIGRFHNIYGPFGTWKGGREKAPAAFCRKSLTSTDKFEMWGDGLQTRSFTFIDECVEGVLRLTKSDFREPVNIGSDEMVSMNEMAEIVLGFENKKLPIYHIPGPEGVRGRNSDNTLIKEKLGWAPSMKLKDGLRITYFWIKEQLEKEKAHGTDLSAYGSSKVVGTQAPVQLGSLRAADGKE

SEQ ID NO: 6308 - protein, 376 aa, Phaseolus coccineus
MGSSGANDYGAYTYQNLEREPYWPSEKLRISITGAGGFIASHIARRLKTEGHYIIASDWKKNEHMTEDMFCHEFHLVDLRVMDNCLAVTKGVDHVFNLAADMGGMGFIQSNHSVIMYNNTMISFNMIEAARINGVKRFFYASSACIYPEFKQLETNVSLKEADAWPAEPQDAYGLEKLATEELCKHYNKDFGIECRIGRFHNIYGPYGTWKGGREKAPAAFCRKTLTSKDQFEMWGDGLQTRSFTFIDECVEGVLRLTKSDFREPVNIGSDEMVSMNEMAEIVLSFEDKTIPIYHIPGPEGVRGRNSDNTLIKEKLGWAPTMKLKDGLRITYFWIKEQLEKEKAAGVDLSVYGSSKVVQTQAPVQLGSLRAADGKE

SEQ ID NO: 6309 - protein, 376 aa, Petunia hybrida
MGSSGETKYGEYTYENLEREPYWPSEKLRISITGAGGFIASHIARRLKTEGHYVIASDWKKNEHMTEDMFCHEFHLVDLRVMDNCLKVTKEVDHVFNLAADMGGMGFIQSNHSVIMYNNTMISFNMMEASRINGVKRFFYASSACIYPEFKQLETNVSLKESDAWPAEPQDAYGLEKLATEELCKHYNKDFGIECRIGRFHNIYGPFGTWKGGREKAPAAFCRKALTSTDKFEMWGDGMQTRSFTFIDECVEGVLRLTKSDFREPVNIGSDEMVSMNEMAEMVLSFDEKKLPIQHIPGPEGVRGRNSDNTLIKEKLGWAPTMRLKDGLRITYFWIKEQIEKEKVQGADVSAYGSSKVVGTQAPVQLGSLRAADGKE

SEQ ID NO: 6310 - protein, 376 aa, Glycine max
MGISGTTDYGSFTYQNLEREPYWPSEKLRISITGAGGFIASHIARRLKTEGHYIIASDWKKNEHMTEGMFCHEFHLVDLRVMDNCLTVTKGVDHVFNLAADMGGMGFIQSNHSVIMYNNTMISFNMIEAARINGVKRFFYASSACIYPEFKQLETNVSLKESDAWPAEPQDAYGLEKLATEELCKHYNKDFGIECRIGRFHNIYGPYGTWKGGREKAPAAFCRKTLTSKDRFEMWGDGLQTRSFTFIDECVEGVLRLTKSDFREPVNIGSDEMVSMNEMAEIVLSFEDKNIPIYHIPGPEGVRGRNSDNTLIKEKLGWAPTMKLKDGLRITYFWIKEQLEKEKAEGVDLSGYGSSKVVQTQAPVQLGSLRAADGKE

SEQ ID NO: 6311 - protein, 378 aa, Picea glauca
MGSTGADGVAYGAYTYEDLEREPYWPSEKVIISITGAGGFIASHIARRLKSEGHYIIASDWKKNEHMTEDMFCNEFHLVDLRVMENCLAVTKGVDHVFNLAADMGGMGFIQSNHSVIMYNNTMISFNMIEAARINGVKRFFYASSACIYPEFKQLETNVSLKESDAWPAEPQDAYGLEKLATEELCKHYNKDFGIECRIGRFHNIYGPFGTWKGGREKAPAAFCRKTITSTDRFEMWGDGKQTRSFTFIDECVEGVLRLTKSDFREPVNIGSDEMVSMNEMAEMVLSFENKKLPIHHIPGPEGVRGRNSDNTLIKEKLGWAPTMRLKDGLRITYFWIKEQIEKEKVQGIDLSIYGSSKVVGTQAPVQLGSLRAADGKE

SEQ ID NO: 6312 - protein, 373 aa, Tropaeolum majus
MGTTDYGAYTYKELERELYWPSEKLRISITGAGGFIASHIARRLKNEGHYIIASDWKKNEHMTEDMFCHEFHLADLRVMDNCLKVTKEVDHVFNLAADMGGMGFIQSNHSVIMYNNTMISFNMLEASRISGVKRFFYASSACIYPEFKQLETNVSLKEADAWPAEPQDAYGLEKLATEELCKHYTKDFGIECRIGRFHNIYGPFGTWKGGREKAPAAFCRKALTATDKFEMWGDGLQTRSFTFIDECVEGVLRLTKSDFREPVNIGSDEMVSMNEMAEIVLGFDDKKLPIHHIPGPEGVRGRNSDNTLIKEKLGWAPTMKLKDGLRFTYFWIKEEIEKEKAKGVDLSVYGSSKVVGTQAPVQLGSLRAADGKE

SEQ ID NO: 6313 - protein, 376 aa, Salvia sclarea
MGTSGETTYGEYTYQELEREPYWPSEKLRISITGAGGFIASHIARRLKSEGHYIIASDWKKNEHMPEDMFCHEFHLVDLRVMDNCLKVTEGVDHVFNLAADMGGMGFIQSNHSVIMYNNTMISFNMIEAARINGIKRFFYASSACIYPEFKQLETNVSLKEADAWPAEPQDAYGLEKLATEELCKHYNKDFGIECRIGRFHNIYGPFGTWKGGREKAPAAFCRKALTATDKFEMWGDGKQTRSFTFIDECVEGVLRLTKSDFREPVNIGSDEMVSMNEMAEIVLSFDNKKLPIHHIPGPEGVRGRNSDNTLIKEKLGWAPSMRLKDGLRITYFWIKEQLEKEKAKGIDLTTYGSSKVVGTQAPVQLGSLRAADGKE

SEQ ID NO: 6314 - protein, 371 aa, Sorghum bicolor
MALNKEYTYAELEKEPYWPFEKLRISITGAGGFIASHIARRLKSEGHYIIASDWKKNEHMSEDMFCHEFHLVDLRVMDNCLKVTTGVDHVFNLAADMGGMGFIQSNHSVIMYNNTMISFNMLEAARINGVKRFFYASSACIYPEFKQLETVVSLKESDAWPAEPQDAYGLEKLATEELCKHYTKDFGIECRVGRFHNIYGPFGTWKGGREKAPAAFCRKALTSTGHFEMWGDGLQTRSFTFIDECVEGVLRLTKSDFREPVNIGSDEMVSMNEMAEIVLSFENKQLPIHHIPGPEGVRGRNSDNTLIKEKLGWAPTMRLKDGLRITYFWIKEQLEKEKAEGMDLSVYGSSKVVQTQAPVQLGSLRAADGKE

SEQ ID NO: 6315 - protein, 376 aa, Malus domestica
MGSTGEIKYGAYTYENLEREPYWPSEKLRISITGAGGFIASHIARRLKNEGHYIIASDWKKNEHMTEDMFCHEFHLADLRVMDNCLKVTKNVDHVFNLAADMGGMGFIQSNHSVIFYNNTMISFNMVEAARINDVKRFFYASSACIYPEFKQLETNVSLKESDAWPAEPQDAYGLEKLATEELCKHYTKDFGIECRIGRFHNIYGPFGTWKGGREKAPAAFCRKTLTATDKFEMWGDGLQTRSFTFIDECVEGVLRLTKSDFREPVNIGSDEMVSMNEMAEIVLSFEDKKLPIQHIPGPEGVRGRNSDNTLIKEKLGWAPTMRLKDGLRITYFWIKEQIEKEKAQGADLSVYGSSKVVGTQAPVQLGSLRAADGKE

SEQ ID NO: 6316 - protein, 376 aa, Vigna unguiculata
MGSSGTTDYGAYTYQNLEREPYWPTEKLRISITGAGGFIASHIARRLKTEGHYIIASDWKKNEHMTEDMFCHEFHLVDLRVMDNCLTVTKGVDHVFNLAADMGGMGFIQSNHSVIMYNNTMISFNMIEAARINGVKRFFYASSACIYPEFKQLETNVSLKEADAWPAEPQDAYGLEKLATEELCKHYNKDFGIECRIGRFHNIYGPYGTWKGGREKAPAAFCRKTLTSKDQFEMWGDGLQTRSFTFIDECVEGVLRLTKSDFREPVNIGSDEMVSMNEMAEIVLSFENKTIPIHHIPGPEGVRGRNSDNTLIKEKLGWAPTMKLKDGLRITYFWIKEQLEKEKASGVDLSVYGSSKVVQTQAPVQLGSLRAADGKE

SEQ ID NO: 6317 - protein, 376 aa, Lotus japonicus
MGSTGKTDYGEYTYENLERELYWPSEKLKISITGAGGFIASHIARRLKTEGHYIIASDWKKNEHMSEDMFCDEFHLVDLRVMDNCLKVTKGVDHVFNLAADMGGMGFIQSNHSVIMYNNTMISFNMIEAARINGIKRFFYASSACIYPEFKQLETNVSLKEADAWPAEPQDAYGLEKLATEELCKHYNKDFGIECRIGRFHNIYGPFGTWKGGREKAPAAFCRKTITSTDRFEMWGDGLQTRSFTFIDECVEGVLRLTKSDFREPVNIGSDEMVSMNEMAEIVLSFENKNIPIHHIPGPEGVRGRNSDNTLIKEKLGWAPTMKLKDGLRITYFWIKEQLDKEKAKGIDLAVYGTSKVVQTQAPVQLGSLRAADGKE

SEQ ID NO: 6318 - protein, 377 aa, Medicago truncatula
MGSSGINNDYGAFTYQNLEREPYWPTEKLRISITGAGGFIASHIARRLKTEGHYIIASDWKKNEHMTEDMFCHEFHLVDLRVMDNCLKVTKDVDHVFNLAADMGGMGFIQSNHSVIMYNNTMISFNMIEAARINGVKRFFYASSACIYPEFKQLETNVSLKEADAWPAEPQDAYGLEKLATEELCKHYNKDFGIECRIGRFHNIYGPFGTWKGGREKAPAAFCRKTLTSTDKFEMWGDGLQTRSFTFIDECVEGVLRLTKSDFREPVNIGSDEMVSMNEMAEIVLSFENKSIPIQHIPGPEGVRGRNSDNTLIKEKLGWAPTMKLKDGLRITYFWIKEQLEKEKAGGVDVTSYGSSKVVSTQAPVQLGSLRAADGNE

SEQ ID NO: 6319 - protein, 376 aa, Capsicum annuum
MGTSVETKYGEYTYENLEREPYWPSEKLRISITGAGGFIASHIARRLKTEGHYIIASDWKKNEHMSEDMFCHEFHLVDLRVMDNCLKVTKGVDHVFNLAADMGGMGFIQSNHSVIMYNNTMISFNMMEASRINGIKRFFYASSACIYPEFKQLETNVSLKESDAWPAEPQDAYGLEKLATEELCKHYNKDFGIECRIGRFHNIYGPFGTWKGGREKAPAAFCRKALTSTDKFEMWGDGKQTRSFTFIDECVEGVLRLTKSDFREPVNIGSDEMVSMNEMAEIVLGFDGKNLPIHHIPGPEGVRGRNSDNTLIKERLGWAPTMKLKDGLRITYFWIKEQIEKEKVQGSDVSAYGSSKVVGTQAPVELGSLRAADGKE

SEQ ID NO: 6320 - protein, 224 aa, Glycine max
MGSAGRTDYGAYTYENLEREPYWPSEKLKISITGAGGFIASHIARRLKTEGHYVIASDWKKNEHMTENMFCDEFHLVDLRVMDNCLKVTKGVDHVFNLAADMGGMGFIQSNHSVIMYNNTMISFNMIEAARINGIKRFFYASSACIYPEFKQLETNVSLKESDAWPAEPQDAYGLEKLATEELCKHYNKDFGIECRIGRFHNIYGPFGTWKGMWKGEGSCCFLS

SEQ ID NO: 6321 - protein, 380 aa, Medicago truncatula
MGSTEKTNYGEYTYENLEREPYWPSEKLKISITGAGGFIASHLARRLKKEGHYIIASDWKKNEHMTEDMFCDEFHLVDLRVMDNCLTVTKGVDHVFNLAADMGGMGFIQSNHSVIMYNNTMISFNMIEAARINGIKRFFYASSACIYPEFKQLETTNVSLKESDAWPAEPQDAYGLEKLATEEICKHYNKDFGIECRIGRFHNIYGPFGTWKGGREKAPAAFCRKAITSTDKFEMWGDGLQTRSFTFIDECVEGVLRLTKSDFREPVNIGSDEMVSMNEMAEIVLGFEDKKTPIHHIPGPEGVRGRNSDNTLIKEKLGWAPTMKLKDGLRITYVWIKEQLEKEKAQGLDTSGYGSSKVVSTQAPVQLGSLRAADGKEGSS

SEQ ID NO: 6322 - protein, 376 aa, Malus domestica
MGTAGETKYGAYTYENLEREPYWPSEKLRISITGAGGFIASHIARRLKNEGHYIIASDWKKNEHMTEDMFCHEFHLADLRVMDNCLKVTKNVDHVFNLAADMGGMGFIQSNHSVIFYNNTMISFNMVEASRINDVKRFFYASSACIYPEFKQLETNVSLKESDAWPAEPQDAYGLEKLATEELCKHYTKDFGIECRIGRFHNIYGPFGTWKGGREKAPAAFCRKALTATDKFEMWGDGLQTRSFTFIDECVEGVLRLTKSDFREPVNIGSDEMVSMNEMAEMVLSFEDKKLPIQHIPGPEGVRGRNSDNTLIKEKLGWAPTMRLKDGLRITYFWIKEQIEKEKAQGADLSVYGSSKVVGTQAPVQLGSLRAADGKE

SEQ ID NO: 6323 - protein, 377 aa, Arabidopsis thaliana
MGTTNGTDYGAYTYKELEREQYWPSENLKISITGAGGFIASHIARRLKHEGHYVIASDWKKNEHMTEDMFCDEFHLVDLRVMENCLKVTEGVDHVFNLAADMGGMGFIQSNHSVIMYNNTMISFNMIEAARINGIKRFFYASSACIYPEFKQLETTNVSLKESDAWPAEPQDAYGLEKLATEELCKHYNKDFGIECRIGRFHNIYGPFGTWKGGREKAPAAFCRKAQTSTDRFEMWGDGLQTRSFTFIDECVEGVLRLTKSDFREPVNIGSDEMVSMNEMAEMVLSFEEKKLPIHHIPGPEGVRGRNSDNNLIKEKLGWAPNMRLKEGLRITYFWIKEQIEKEKAKGSDVSLYGSSKVVGTQAPVQLGSLRAADGKE

SEQ ID NO: 6324 - protein, 376 aa, Artemisia annua
MGTTGETKYGSYTYEALEREPYWPTEKLRVSITGAGGFIASHIARRLKTEGHYIIASDWKKNEHMPEDMFCHEFHLVDLRVMDNCLKVTEKVDHVFNLAADMGGMGFIQSNHSVIMYNNTMISFNMLEAARISGVKRFFYASSACIYPEFKQLETNVSLKEADAWPAEPQDAYGLEKLATEELCRHYTKDFGIECRIGRFHNIYGPFGTWKGGREKAPAAFCRKALTATDKFEMWGDGLQTRSFTFIDECVEGVLRLTKSDFREPVNIGSDEMVSMNEMAEIVLSFEDKKLPIHHIPGPEGVRGRNSDNTLIKEKLGWAPTMRLKDGLRFTYFWIKEQIEKERGEGFDLSVYGSSKVVGTQAPVQLGSLRAADGKE

SEQ ID NO: 6325 - protein, 376 aa, Solanum tuberosum
MGTSVETTYGEYTYENLEREPYWPSEKLRVSITGAGGFIASHIARRLKNEGHYIIASDWKKNEHMSEDMFCHEFHLVDLRVMDNCLKVTKGVDHVFNLAADMGGMGFIQSNHSVIMYNNTMISFNMMEASRINSVKRFFYASSACIYPEFKQLETNVSLKESDAWPAEPQDAYGLEKLATEELCKHYNKDFGIECRIGRFHNIYGPFGTWKGGREKAPAAFCRKALTSTDKFEMWGDGKQTRSFTFIDECVEGVLRLTKSDFREPVNIGSDEMVSMNEMAEIVLSFDGKNLPIHHIPGPEGVRGRNSDNTLIKEKLGWAPNMKLKDGLRITYFWIKEQIEKEKVKGADVSAYGSSKVVGTQAPVELGSLRAADGKE

SEQ ID NO: 6326 - protein, 376 aa, Helianthus annuus
MGTAGETKYGSFTYENLEREPYWPSEKLRVSITGAGGFIASHIARRLKTEGHYIIASDWKKNEHMSEDMFCHEFHLVDLRVMDNCLKVTENVDHVFNLAADMGGMGFIQSNHSVIMYNNTMISFNMLEAARISGVKRFFYASSACIYPEFKQLETNVSLKESDAWPAEPQDAYGLEKLATEELCRHYTKDFGIECRIGRFHNIYGPFGTWKGGREKAPAAFCRKALTATDKFEMWGDGLQTRSFTFIDECVEGVLRLTKSDFREPVNIGSDEMVSMNEMAEIVLSFEDKKLPIHHIPGPEGVRGRNSDNTLIKEKLGWAPTMRLKDGLRITYFWIKEQIEKERGEGFDLSVYGSSKVVGTQAPVQLGSLRAADGKE

SEQ ID NO: 6327 - protein, 376 aa, Solanum lycopersicum
MGTSVETTYGEYTYENLEREPYWPSEKLRVSITGAGGFIASHIARRLKTEGHYIIASDWKKNEHMSEDMFCHEFHLVDLRVMDNCLKVTKGVDHVFNLAADMGGMGFIQSNHSVIMYNNTMISFNMMEASRINSVKRFFYASSACIYPEFKQLETNVSLKESDAWPAEPQDAYGLEKLATEELCKHYNKDFGIECRIGRFHNIYGPFGTWKGGREKAPAAFCRKALTSTDKFEMWGDGKQTRSFTFIDECVEGVLRLTKSDFREPVNIGSDEMVSMNEMAEIVLSFDGKNLPIHHIPGPEGVRGRNSDNTLIKEKLGWAPNMKLKDGLRITYFWIKEQIEKEKVKGADVSTYGSSKVVGTQAPVELGSLRAADGKE

SEQ ID NO: 6328 - protein, 376 aa, Lactuca sativa
MGTIGETKYGSFTYESLEREPYWPSEKLRVSITGAGGFIASHIARRLKTEGHYIIASDWKKNEHMPEDMFCHEFHLVDLRVMDNCLKVTKNVDHVFNMAADMGGMGFIQSNHSVIMYNNTMISFNMLEAARITGVKRFFYASSACIYPEFKQLETNVSLKESDAWPAEPQDAYGLEKLATEELCRHYTKDFGIECRIGRFHNIYGPFGTWKGGREKAPAAFCRKALTATDKFEMWGDGLQTRSFTFIDECVEGVLRLTKSDFREPVNIGSDEMVSMNEMAEIVLSFENKKLPIHHIPGPEGVRGRNSDNTLIKEKLGWAPTMKLKDGLRITYFWIKEQIEKERGEGFDLSVYGSSKVVGTQAPVQLGSLRAADGKE

SEQ ID NO: 6329 - protein, 376 aa, Solanum phureja
MGTSVETTYGEYTYENLEREPYWPSEKLRVSITGAGGFIASHIARRLKNEGHYIIASDWKKNEHMSEDMFCNEFHLVDLRVMDNCLKVTKGVDHVFNLAADMGGMGFIQSNHSVIMYNNTMISFNMMEASRINSVKRFFYASSACIYPEFKQLETNVSLKESDAWPAEPQDAYGLEKLATEELCKHYNKDFGIECRIGRFHNIYGPFGTWKGGREKAPAAFCRKALTSTDKFEMWGDGKQTRSFTFIDECVEGVLRLTKSDFREPVNIGSDEMVSMNEMAEIVLSFDGKNLPIHHIPGPEGVRGRNSDNTLIKEKLGWAPNMKLKDGLRITYFWIKEQIEKEKVKGADVSAYGSSKVVGTQAPVELGSLRAADGKE

SEQ ID NO: 6330 - protein, 376 aa, Artemisia annua
MGTTGETKYGSYTYEALEREPYWPTEKLRVSITGAGGFIASHIARRLKTEGHYIIASDWKKNEHMPEDMFCHEFHLVDLRVMDNCLKVTEKVDHVFNLAADMGGMGFIQSNHSVIMYNNTMISFNMLEAARISGVKRFFYASSACIYPEFKQLETNVSLKEADAWPAEPQDAYGLEKLATEELCRHYTKDFGIECRIGRFHNIYGPFGTWKGGREKAPAAFCRKALTATDKFEMWGDGLQTRSFTFIDECVEGVLRLTKSDFREPVNIGSDEMVSMNEMAEIVLSFEDKKLPIHHIPGPEGVRGRNSDNTLIKEKLGWAPTMRLKDGLRFTHFWIKEQIEKERGEGFDLSVYGSSKVVGTQAPVQLGSLRAADGKE

SEQ ID NO: 6331 - protein, 376 aa, Helianthus annuus
  misc_feature (285)..(285): Xaa can be any naturally occurring amino acid
MGTTSDTKYGSFTYENLEREPYWPSEKLRVSITGAGGFIASHIARRLKTEGHYIIASDWKKNEHMSEDMFCHEFHLVDLRVMDNCLKVTENVDHVFNLAADMGGMGFIQSNHSVIMYNNTMISFNMLEAARISGVKRFFYASSACIYPEFKQLETNVSLKESDAWPAEPQDAYGLEKLATEELCRHYTKDFGIECRIGRFHNIYGPFGTWKGGREKAPAAFCRKALTATDKFEMWGDGLQTRSFTFIDECVEGVLRLTKSDFREPVNIGSDEMVSMNEMAEIVLXFEDKKLPIHHIPGPEGVRGRNSDNTLIKEKLGWAPTMRLKDGLRITYFWIKEQIEKERGEGFDLSVYGSSKVVGTQAPVQLGSLRAADGKE

SEQ ID NO: 6332 - protein, 377 aa, Arabidopsis lyrata
MGTTNGSDYGAYTYKELEREPYWPSEKLKISITGAGGFIASHIARRLKHEGHYVIASDWKKNEHMTEDMFCDEFHLVDLRVMENCLKVTKGVDHVFNLAADMGGMGFIQSNHSVIMYNNTMISFNMIEAARINGIKRFFYASSACIYPEFKQLETTNVSLKESDAWPAEPQDAYGLEKLATEELCKHYNKDFGIECRIGRFHNIYGPFGTWKGGREKAPAAFCRKALTSTDRFEMWGDGLQTRSFTFIDECVEGVLRLTKSDFREPVNIGSDEMVSMNEMAEMVLSFEEKKLPIHHIPGPEGVRGRNSDNNLIKEKLGWAPNMRLKEGLRITYFWIKEQIEKEKAKGSDVSLYGSSKVVGTQAPVQLGSLRAADGKE

SEQ ID NO: 6333 - protein, 376 aa, Lactuca sativa
MGTIGETKYGSFTYESLEREPYWPTEKLRVSITGAGGFIASHIARRLKTEGHYIIASDWKKNEHMPEDMFCHEFHLVDLRVMDNCLKVTKNVDHVFNMAADMGGMGFIQSNHSVIMYNNTMISFNMLEAARITGVKRFFYASSACIYPEFKQLETNVSLKESDAWPAEPQDAYGLEKLATEELCRHYTKDFGIECRIGRFHNIYGPFGTWKGGREKAPAAFCRKALTATDKFEMWGDGLQTRSFTFIDECVEGVLRLTKSDFREPVNIGSDEMVSMNEMAEIVLSFENKKLPIHHIPGPEGVRGRNSDNTLIKEKLGWAPTMKLKDGLRITYFWIKEQIEKERGEGFDLSVYGSSKVVGTQAPVQLGSLRAADGKE

SEQ ID NO: 6334 - protein, 379 aa, Raphanus sativus
MAATTNGSSDYGEYTYKELERELYWPSEKLRISITGAGGFIASHIARRLKHEGHYVIASDWKKNEHMTEDMFCDEFHLVDLRVMENCLKVTDGVDHVFNLAADMGGMGFIQSNHSVIMYNNTMISFNMIEAARINGIKRFFYASSACIYPEFKQLETTNVSLKESDAWPAEPQDAYGLEKLATEELCKHYNKDFGIECRIGRFHNIYGPFGTWKGGREKAPAAFCRKALTSTDRFEMWGDGLQTRSFTFIDECVEGVLRLTKSDFREPVNIGSDEMVSMNEMAEMVLSFEEKKLPIHHIPGPEGVRGRNSDNNLIKEKLGWAPTMRLKEGLRITYFWIKEQIEKEKAKGSDVTLYGSSKVVGTQAPVQLGSLRAADGKE

SEQ ID NO: 6335 - protein, 379 aa, Unknown
  Sequence found in Organisms: Brassica napus, Brassica rapa
MAAATNGSTDYGAYTYKELERELYWPSEKLRISITGAGGFIASHIARRLKHEGHYVIASDWKKNEHMTEDMFCDEFHLVDLRVMENCLKVTDKVDHVFNLAADMGGMGFIQSNHSVIMYNNTMISFNMIEAARINGIKRFFYASSACIYPEFKQLETTNVSLKESDAWPAEPQDAYGLEKLATEELCKHYNKDFGIECRIGRFHNIYGPFGTWKGGREKAPAAFCRKALTSTDRFEMWGDGLQTRSFTFIDECVEGVLRLTKSDFREPVNIGSDEMVSMNEMAEMVLSFEEKKLPIHHIPGPEGVRGRNSDNNLIKEKLGWAPTMRLKEGLRITYFWIKEQIEKEKAKGSDVTLYGSSKVVGTQAPVQLGSLRAADGKE

SEQ ID NO: 6336 - protein, 376 aa, Centaurea maculosa
  misc_feature (365)..(365): Xaa can be any naturally occurring amino acid
  misc_feature (375)..(375): Xaa can be any naturally occurring amino acid
MGTGEAKYGSFTYESLEREPYWPSDKLRVSITGAGGFIASHIARRLKTEGHYIIASDWKKNEHMPEDMFCHEFHLVDLRVMDNCLKVTQNVDHVFNLAADMGGMGFIQSNHSVIMYNNTMISFNMLEASRISGVKRFFYASSACIYPEFKQLETTNVSLKESDAWPAEPQDAYGLEKLATEELCRHYTKDFGIECRIGRFHNIYGPFGTWKGGREKAPAAFCRKALTSTDKFEMWGDGLQTRSFTFIDECVEGVLRLTKSDFREPVNIGSDEMVSMNEMAEIVLGFEDKKLPIHHIPGPEGVRGRNSDNTLIKEKLGWAPTMKLKDGLRITYFWIKEQIEKEKGSGFDLSVYGTSKVVGTQAPVXLGSLRAADGXE

SEQ ID NO: 6337 - protein, 376 aa, Cichorium intybus
MGTTGETKYGSFTYESLEREPYWPTEKLRVSITGAGGFIASHIARRLKTEGHYIIASDWKKNEHMSEDMFCHEFHLVDLRVMDNCLKVTENVDHVFNLAADMGGMGFIQSNHSVIMYNNTMISFNMLEASRITGVKRFFYASSACIYPEFKQLETNVSLKESDAWPAEPQDAYGLEKLATEELCRHYTKDFGIECRIGRFHNIYGPFGTWKGGREKAPAAFCRKALTAVDKFEMWGDGLQTRSFTFIDECVEGVLRLTKSDFREPVNIGSDEMVSMNEMAEIVLSFENKKLPIHHIPGPEGVRGRNSDNTLIKEKLGWAPTMKLKDGLRITYFWIKGQIEKERGEGFDLSVYGSSKVVGTQAPVQLGSLRAADGKE

SEQ ID NO: 6338 - protein, 376 aa, Carthamus tinctorius
  misc_feature (343)..(343): Xaa can be any naturally occurring amino acid
  misc_feature (365)..(365): Xaa can be any naturally occurring amino acid
  misc_feature (370)..(370): Xaa can be any naturally occurring amino acid
MGTGEAKYGSFTYENLEREPYWPSDKLRVSITGAGGFIASHIARRLKTEGHYIIASDWKKNEHMPEDMFCHEFHLVDLRVMDNCLKVTQNVDHVFNLAADMGGMGFIQSNHSVIMYNNTMISFNMLEASRINGVKRFFYASSACIYPEFKQLETTNVSLKESDAWPAEPQDAYGLEKLATEELCRHYTKDFGIECRIGRFHNIYGPFGTWKGGREKAPAAFCRKALTSTDKFEMWGDGLQTRSFTFIDECVEGVLRLTKSDFREPVNIGSDEMVSMNEMAEIVLGFEDKKLPIHHIPGPEGVRGRNSDNTLIKEKLGWAPTMKLKDGLRITYFWIKEQIEKEXGAGFDLSVYGTSKVVGTQAPVXLGSLXAADGKE

SEQ ID NO: 6339 - protein, 80 aa, Tragopogon dubius
MGTTADAKYGSYTYEALEREIYWPTEKLRVSITGAGGFIASHIARRLKTKDITSSPLIGRKMSTCLRTCFVMNSILLIFV

SEQ ID NO: 6340 - protein, 371 aa, Brachypodium distachyon
MALNKEYTYADLEKEPYWPFEKLRISITGAGGFIASHIARRLKGEGHYIIASDWKKNEHMEEDMFCHEFHLADLRVMDNCLKVTTGVDHVFNLAADMGGMGFIQSNHSVIMYNNTMISFNMLEAARINGIKRFFYASSACIYPEFKQLETVVSLKEADAWPAEPQDAYGLEKLATEELCKHYTKDFGIECRVGRFHNIYGPYGTWKGGREKAPAAFCRKAQTSTDRFEMWGDGLQTRSFTFIDECVEGVLRLTKSDFREPVNIGSDEMVSMNEMAEIVLGFENKQLPIHHIPGPEGVRGRNSDNTLIKEKLGWAPTMRLKDGLRITYFWIKEQLEKERAEGGDVSAYGSSKVCTTQAPVQLGSLRAADGKE

SEQ ID NO: 6341 - protein, 371 aa, Hordeum vulgare
MALNEKYTYAELEKEPYWPFEKLRISITGAGGFIASHIAKRLKGEGHYIIASDWKKNEHMEEDMFCHEFHLADLRVMDNCLKVTTGVDHVFNLAADMGGMGFIQSNHSVIMYNNTMISFNMLEAGRINGVKRFFYASSACIYPEFKQLETVVSLKEADAWPAEPQDAYGLEKLATEELCKHYTKDFDIECRVGRFHNIYGPYGTWKGGREKAPAAFCRKALTSTDRFEMWGDGLQTRSFTFIDECVEGVLRLTKSDFREPVNIGSDEMVSMNEMAEIVLGFENKQLPIHHIPGPEGVRGRNSDNTLIKEKLGWAPTMRLKDGLRITYFWIKEQLEKEKSEGADVSAYGSSKVCTTQAPVQLGSLRAADGKE

SEQ ID NO: 6342 - protein, 371 aa, Zea mays
MALNKEYTYAELEKEPYWPFEKLRVSITGAGGFIASHIARRLKGEGHYVVASDWKRNEHMPEDMFCHEFHLVDLRVMDNCLKVTTGVDHVFNLAADMGGMGFIQSNHSVIMYNNTMISFNMLEAARINGVKRFFYASSACIYPEFKQLETVVSLKESDAWPAEPQDAYGLEKLATEELCKHYTKDFGIECRIGRFHNIYGPFGTWKGGREKAPAAFCRKALTSTGRFEMWGDGLQTRSFTFIDECVEGVLRLTKSDFREPVNIGSDEMVSMNEMAEMVLSFENKQLPIHHIPGPEGVRGRNSDNTLIKEKLGWAPTMRLKDGLRITYSWIKEQLEKEKAEGMDLSVYGSSKVVQTQAPVQLGSLRAADGKE

SEQ ID NO: 6343 - protein, 379 aa, Raphanus sativus
  misc_feature (291)..(291): Xaa can be any naturally occurring amino acid
MATTTNGSTDYGAYTYKDLSRELYWPSQKLKISITGAGGFIASHIARRLKHEGHYVIASDWKKNEHMTEDMFCDEFHLVDLRVMENCLKVTDGVDHVFNLAADMGGMGFIQSNHSVIMYNNTMISFNMIEAARINGIKRFFYASSACIYPEFKQLETTNVSLKESDAWPAEPQDAYGLEKLATEELCKHYNKDFGIECRIGRFHNIYGPFGTWKGGREKAPAAFCRKALTSTDRFEMWGDGLQTRSFTFIDECVEGVLRLTKSDFREPVNIGSDEMVSMNEMAEMVLSFEXKKLPIHHIPGPEGVRGRNSDNNLIKEKLGWAPTMRLKEGLRITYFWIKEQIEKEKAKGSDVSLYGSSKVVGTQAPVQLGSLRAADGKE

SEQ ID NO: 6344 - protein, 252 aa, Brassica oleracea
MIEAARINGIKRFFYASSACIYPEFKQLETTNVSLKESDAWPAEPQDAYGLEKLATEELCKHYNKDFGIECRIGRFHNIYGPFGTWKGGREKAPAAFCRKALTSTDRFEMWGDGLQTRSFTFIDECVEGVLRLTKSDFREPVNIGSDEMVSMNEMAEMVLSFEEKKLPIHHIPGPEGVRGRNSDNNLIKEKLGWAPTMRLKEGLRITYFWIKEQIEKEKAKGSDVTLYGSSKVVGTQAPVQLGSLRAADGKE

SEQ ID NO: 6345 - protein, 267 aa, Glycine max
MGSAGGTDYGAYTYENLEREPYWPSEKLKISITGAGGFIASHIARRLKTEGHYIIASDWKKNEHMTEDMFCDEFHLVDLRVMNNCLKVTEGVDHVFNLAADMGGMGFIQSNHSVIMYNNTMISFNMIEAARINGIKRFFYASSACIYPEFKQLETNVSLKESDAWPAEPQDAYGLEKLATEELCKHYNKDFGIECRIGRFHNIYGPFGTWKGMLYTELKTFIVEGRRLLLLFVVKLSLPLIDLRCGGMDCKHDHLPSLMNVLKGCSD

SEQ ID NO: 6346 - protein, 431 aa, Triticum aestivum
VPRIFWGQNGKTSLQQLPDSLHQFSVSPAPSSSTAPATSPAAAPEPPSLPPARGRSVSRRMALNKEYTYADLEKEPYWPFEKLRISITGAGGFIASHIAKRLKGEGHYIIASDWKKNEHMEEDMFCHEFHLADLRVMDNCLKVTTGVDHVFNLAADMGGMGFIQSNHSVIMYNNTMISFNMLEASRINGVKRFFYASSACIYPEFKQLETVVSLKEADAWPAEPQDAYGLEKLATEELCKHYTKDFDIECRIGRFHNIYGPYGTWKGGREKAPAAFCRKALTSTDRFEMWGDGLQTRSFTFIDECVEGVLRLTKSDFCEPVNIGSDEMVSMNEMAEIVLGFENKQLPIHHIPGPEGVRGRNSDNTLIKEKLGWAPTMRLKDGLRITYFWIKEQLEKEKSEGADMSAYGTSKVCTTQAPVQLGSLRAADGKE

SEQ ID NO: 6347 - protein, 432 aa, Triticum aestivum
PVPGIFWGENGKTSLKQLPDSLHQFSVSPVPSSSTGPATSPTAAPEPPSFPPASSRSVSHRMALNKEYTYADLEKEPYWPFEKLRISITGAGGFIASHIAKRLKGEGHYIIASDWKKNEHMEEDMFCHEFHLADLRVMDNCLKVTTGVDHVFNLAADMGGMGFIQSNHSVIMYNNTMISFNMLEAGRINGVKRFFYASSACIYPEFKQLETVVSLKEADAWPAEPQDAYGLEKLATEELCKHYTKDFDIECRIGRFHNIYGPYGTWKGGREKAPAAFCRKALTSTDRFEMWGDGLQTRSFTFIDECVEGVLRLTKSDFCEPVNIGSDEMVSMNEMAEIVLGFENKQLPIHHIPGPEGVRGRNSDNTLIKEKLGWAPTMRLKDGLRITYSWIKEQLEKEKSEGTDMSAYGTSKVCTTQAPVQLGSLRAADGKE

SEQ ID NO: 6348 - protein, 371 aa, Lolium multiflorum
MALNDKHTYAELEKELYWPAEKLRISITGAGGFIASHLAKRLKSEGHYIIASDWKKNEHMDEDMFCHEFHLADLRVMDNCLKVTTGVDHVFNLAADMGGMGFIQSNHSVIMYNNTMISFNMLEAGRINGVKRFFYASSACIYPEFKQLETVVSLKEADAWPAEPQDAYGLEKLATEELCKHYTKDFDIECRVGRFHNIYGPYGTWKGGREKAPAAFCRKALTSTDRFEMWGDGLQTRSFTFIDECVEGVLRLTKSDFCEPVNIGSDEMVSMNEMAEIVLGFENKELPIHHIPGPEGVRGRNSDNTPIKEKLGWAPTMRLKDGLRITYFWIKEQLEKERMEGADVSAYGTSTVVGTQAPVQLGSLRAADGKE

SEQ ID NO: 6349 - protein, 371 aa, Avena sativa
MALNEEYTYAALEKELYWPSQKLRISITGAGGFIASHLARRLKGEGHYIIASDWKKNEHMEEDMFCHEFHLADLRVMDNCLKVTTGVDHVFNLAADMGGMGFIQSNHSVIMYNNTMISFNMLEAGRINGVKRFFYASSACIYPEFKQLETVVSLKEADAWPAEPQDAYGLEKLATEELCKHYTKDFDIECRVGRFHNIYGPYGTWKGGREKAPAAFCRKALTSTDRFEMWGDGLQTRSFTFIDECVEGVLRLTKSDFCEPVNIGSDEMVSMNEMAEIVLGFENKQLPIHHIPGPEGVRGRNSDNTLIKEKLGWAPTMRLKDGLRITYSWIKEQLEKEKSTGANVSDYGSSKVCTTMAPVQLGSLRAADGKE

SEQ ID NO: 6350 - protein, 367 aa, Manihot esculenta
MGSSGATAYGEYTYEDLEREPYWPSEKLRISITGAGGFIASHIAGRLKSEGHYIIASDWKKNEQYDRGHVLVMDNCLKVTSGVDHVFNLAADMGGMGFIQSNHSVIMYNNTMISFNMLEAARINGVKRFFYASSACIYPEFKQLDTNVSLKESDAWPAEPQDAYGLEKLATEELCKHYTKDFGIECRIARFHSIYGPFGTWKGGREKAPAAFCRKAITSTHVFEMWGDGLQTWSFTFIDECVEGVLRLTKSDFREPVNIGSDEMVSMNEMAEIVLSFEIKKLPIHHIPGPEGVRGRNSDNTLIKEKLGSAPSMKLKDGLRITYFWIKEQIEKEKAQGVDLTIYGSSKVVGTQAPVRLGSLRAGDGEE

SEQ ID NO: 6351 - protein, 373 aa, Selaginella moellendorffii
MGSHYGDYTAGAELEREAYWPNEKLRISISGAGGFIASHIARRLKAEGHYVIASDWKKNEHMSEEMFCHEFHLVDLRVMENCLAVTKGVDHVFNLAADMGGMGFIQSNHSVILFNNTMISFNMLEAARINGVKRFFYASSACIYPEFKQLETNVSLKESDAWPAEPQDAYGLEKLCSEELCKHYTKDFGIECRIGRFHNIYGPFGTWKGGREKAPAAFCRKALTSTDKFEMWGDGKQTRSFTFIDECVEGVLRLTKSDFREPLNIGSDEMVSMNEMAEIILGFGDKKLPIHHIPGPEGVRGRNSDNDLIKEKLGWAPTMRLKDGLRITYMWIKEELDKEISEGQDMAAYSSSKVVGTQAPVQLGSLRKADGKE

SEQ ID NO: 6352 - protein, 373 aa, Selaginella moellendorffii
MGSHYGDYTAGAELERETYWPNEKLRISISGAGGFIASHIARRLKAEGHYVIASDWKKNEHMSEEMFCHEFHLVDLRVMENCLAVTKGVDHVFNLAADMGGMGFIQSNHSVILFNNTMISFNMLEAARINGVKRFFYASSACIYPEFKQLETNVSLKESDAWPAEPQDAYGLEKLCSEELCKHYTKDFGIECRIGRFHNIYGPFGTWKGGREKAPAAFCRKALTSTDKFEMWGDGKQTRSFTFIDECVEGVLRLTKSDFREPLNIGSDEMVSMNEMAEIILGFGDKKLPIHHIPGPEGVRGRNSDNNLIKEKLGWAPTMRLKDGLRITYMWIKEQLDEEISEGQDMAAYSSSKVVGTQAPVQLGSLRKADGKE

SEQ ID NO: 6353 - protein, 360 aa, Musa acuminata
  misc_feature (284)..(285): Xaa can be any naturally occurring amino acid
  misc_feature (291)..(291): Xaa can be any naturally occurring amino acid
  misc_feature (326)..(326): Xaa can be any naturally occurring amino acid
MGSTTGNDGTDYGAYTFANLEREPYWPSEKLRISITGAGGFIASHIARRLKNEGHYIIASDWKKNEHMTEDMFCHEFHLVDLRVMDNCLKVTSGANHVFNLAADMGGMGFIQSNHSVIFYNNTMISFNMLEAARINGVKRFFYASSACIYPEFKQLDTNVSLKESDAWPAEPQDAYGLEKLATEELCKHYNKDFGIECRIGRFHNIYGPFGTWKGGREKAPAAFCRKAITSTDKFEMWGDGLQTRSFTFIDECVEGVLRLTKSDFREPVNIGSDEMVSMNEMAXXVLSFEXKNLPIHHIPGPEGVRGRNSDNTLIKEKLGWAPSMXLKDGLRITYFWIKEQIEKEKARGQDVSVYGSSKV

SEQ ID NO: 6354 - protein, 376 aa, Physcomitrella patens
MASNGSFGDYTATNLDREEYWPSQKLRISITGAGGFIASHIARRLKSEGHYIIASDWKKNEHMSEDMFCDEFHLVDLRVMDNCMKVTKGAHHVFNLAADMGGMGFIQSNHAVIMYNNTMISFNMLEAARINGVTRFFYASSACIYPEFKQLETDVSSLKESDAWPALPQDAYGLEKLATEELCKHYTKDFGMECRIGRFHNIYGPYGTWKGGREKAPAAFCRKALTATEHFEMWGDGKQTRSFTFIDECVEGVLRLTKSDFQEPVNIGSDEMVSMNEMAEIVLSFDNKQLPIKHIPGPEGVRGRNSDNTLIKEKLGWAPSMRLRDGLAITYKWIKEQIEKEKESGADLASKYGSSKVVGTQAPVQLGSLRAADGKE

SEQ ID NO: 6355 - protein, 376 aa, Physcomitrella patens
MASYGRFGDYTATNLDREAYRPAEKLRISITGAGGFIASHIARRLKSEGHYIIASDWKKNEHMSEDMFCDEFHLVDLRVMDNCLKVTKGANHVFNLAADMGGMGFIQSNHAVIMYNNTMISFNMLEASRINGVSRFFYASSACIYPEFKQLETDVSSLKESDAWPALPQDAYGLEKLATEELCRHYTKDFGMECRIGRFHNIYGPYGTWKGGREKAPAAFCRKALTATEYFEMWGDGKQTRSFTFIDECVEGVLRLTKSDFQEPVNIGSDEMLSMNEMAEIVLSFDNKKLPIKHIPGPEGVRGRNSDNTLIKEKLGWAPSMRLRDGLAITYKWIKEQIEKEKESGADLASKYGSSKVVGTQAPVQLGSLRAADGKE

SEQ ID NO: 6356 - protein, 341 aa, Gerbera hybrid cultivar
SITGAGGFIASHIARRLKTEGHYIIASDWKKNEHMSEDMFCHEFHLADLRVMDNCLKVTENVDHVFNLAADMGGMGFIQSNHSVIMYNNTMISFNMLEAARINGVKRFFYASSACIYPEFKQLETNVSLKESDAWPAEPQDAYGLEKLATEELCKHYTKDFGIECRIGRFHNIYGPFGTWKGGREKAPAAFCRKALTSIDKFEMWGDGLQTRSFTFIDECVEGVLRLTKSDFHEPVNIGSDEMVSMNEMAEIVLGFEDKKLPIEHIPGPEGVRGRNSDNTLIKEKLGWAPTMKLKDGLRITYFWIKDQIEKKKVKVLTSPFTDLQGGGDSSTCSTRISQSR

SEQ ID NO: 6357 - protein, 346 aa, Coffea canephora
CITGAGGFIASHIARRLKTEGHYIVASDWKKNEHMTEDMFCHEFHLVDLRVMENCLIVTKAVDHVFNLAADMGGMGFIQSNHSVIMYNNTMISFNMIEAARINGVKRFFYASSACIYPEFKQLDTNVSLKESDAWPAEPQDAYGLEKLATEELCKHYNKDFGIECRIGRFHNIYGPFGTWKGGREKAPAAFCRKAITSTDKFEMWGDGLQTRSFTFIDECVEGVLRLTKSDFREPVNIGSDEMVSMNEMAEIVLSFEDKKLPIHHIPGPEGVRGRNSNNTLIKEKLGWAPSMRLKDGLRITYFWIKEQIEKEKGHGVDLSIYGTSKVVGTQAPVQLGSLRAADGKE

SEQ ID NO: 6358 - protein, 380 aa, Physcomitrella patens
MAESNGTSFGNYTATNLDRELYWPNQKLRISITGAGGFIASHIARRLKSEGHYIIASDWKKNEHMSEDAFCDEFHLVDLRVMDNCLKVTQGAHHVFNLAADMGGMGFIQSNHAVIMYNNTMISFNMLEAARINGVSRFFYASSACIYPEFKQLETDVSSLKESDAWPALPQDAYGLEKLATEELCKHYTKDFGMECRIGRFHNIYGPYGTWKGGREKAPAAFCRKALTATEYFEMWGDGKQTRSFTFIDECVEGVLRLTKSDFQEPVNIGSDEMVSMNEMAEIVLSFDNKKLPIKHIPGPEGVRGRNSDNTLIKEKLGWAPSMRLMDGLAITYKWIKEQIDKEKELGTELASKYGTSMVVGTQAPVQLGSLRAADGKESH

SEQ ID NO: 6359 - protein, 398 aa, Festuca arundinacea
  misc_feature (19)..(19): Xaa can be any naturally occurring amino acid
  misc_feature (312)..(312): Xaa can be any naturally occurring amino acid
  misc_feature (373)..(373): Xaa can be any naturally occurring amino acid
  misc_feature (376)..(376): Xaa can be any naturally occurring amino acid
  misc_feature (380)..(381): Xaa can be any naturally occurring amino acid
  misc_feature (383)..(383): Xaa can be any naturally occurring amino acid
ARGLVPQESSLPTSKSRCXGSVQRLQRMALNDKHTYAELEKELYWPAEKLRISITGAGGFIASHLAKRLKSEGHYIIASDWKKNEHMEEDMFCHEFHLADLRVMDNCLKVTTGVDHVFNLAADMGGMGFIQSNHSVIMYNNTMISFNMLEAGRINGVKRFFYASSACIYPEFKQLETVVSLKEADAWPAEPQDAYGLEKLATEELCKHYTKDFDIECRVGRFHNIYGPYGTWKGGREKAPAAFCRKALTSTDRFEMWGDGLQTRSFTFIDECVEGVLRLTKSDFCEPVNIGSDEMVSMNEMAEIVLGFENKXLPIHHIPGPEGVRGRNSDNTLIKEKLGWAPTMRLKDGLRITYFWIKEQLEKEKLEGADVSXYGXSKVXXTXAPVQLGSLRAADGKE

SEQ ID NO: 6360 - protein, 379 aa, Marchantia polymorpha
MASNGVNGTTNGLYEATNLDKELYWPEKKLRISVTGAGGFIASHIARRLKSEGHYVIASDWKRNEHMTEDMFCDEFHLVDLRVMENCLKVTQDVEHVFNLAADMGGMGFIQSNHSVIMYNNTMISFNMLEAARINGVKRFFYASSACIYPEYKQLDVDCVSLKEADAWPAEPQDAYGLEKLATEELCKHYTKDFGMQCRIGRFHNIYGPYGTWKGGREKAPAAFCRKAITSTEKFEMWGDGKQTRSFTFIDECVEGVLRLTKSEYSEPVNIGSDEMVSMNEMAEIVLSFEGKDLPIEHIPGPEGVRGRNSDNTLIKEKLGWSPTMRLKDGLRITYYWILEQVEKEKAKGVTMDTYATSKVVGTQAPVALGSLRAADGKE

SEQ ID NO: 6361 - protein, 360 aa, Selaginella moellendorffii
REAYWPQAKLRISISGAGGFIASHIARRLKAEGHYVIASDWKKNEHMSEDMFCHEFHLVDLRVMENCLAVTRGVDHVFDLAADMGGMGFIQSNHSVILFNNTMISFNMLEASRINGVKRFFYASSACIYPEFKQLETNVSLKESDAWPAEPQDAYGLEKLCTEELCKHYTKDFGIECRIGRFHNIYGPFGTWKGGREKAPAAFCRKALTSTDSFEMWGDGMQTRSFTFIDECVEGVLRLTKSDFREPLNIGSDEMVSMNEMAEIILGFENKQIPIRHIPGPEGVRGRNSENSLIKEKLGWAPSMRLKDGLRITYLWIKEQLDKEIGEGSQDLLTGYSSSKVVGTQAPVQLGSLRKADGKE

SEQ ID NO: 6362 - protein, 325 aa, Persea americana
HWCWRFIASHIARRLKSEGHYIIASDWKKNEHMTEDMFCNEFHLVDLRVMDNCLKVTNGVDHVFNLAADMGGMGFIQSNHSVIMYNNTMISFNMLEAARINGVKRFFYASSACIYPEFKQLETNVSLKESDAWPAEPQDAYGLEKLATEELCKHYTKDFGIECRIGRFHNIYGPFGTWKGGREKAPAAFCRKAITSTDKFEMWGDGLQTRSFTFIDECVEGVLRLTKSDFREPVNIGSDEMVSMNEMAEIVLSFEDMKLPIHHIPGPEGVRGRNSDNTLIKEKLGWAPTMRLKDGLRITYFWIKEQIEKEKSQGVDLSVYGSSKV

SEQ ID NO: 6363 - protein, 143 aa, Pennisetum glaucum
MEVFGKSVIAEPSNVIFLSAILNTEGSNPSHKCDKRCQNEHVFGNMYRCKLTGTTHICDKNCNQRILYDNHNSLCRVSGQLFPLSPLEQQAVRGIRRKHEVDSNEGCSFKRRRGAQLHPSPFERSYSAVSPIPSQVGDGMDLS

SEQ ID NO: 6364 - protein, 143 aa, Panicum virgatum
MEVFGKSVIAEPSNVIFLSAILNTEGSNPSHKCDKRCQNEHVFGNMFRCKLTGTTHICDKNCNQRILYDNHNSLCRVSGQLFPLSPLEQQAVRGIRRKHEVDSNEGCSFKRRRGAQLHPSPFERSYSAVSPIPSQVGDGMDLS

SEQ ID NO: 6365 - protein, 143 aa, Unknown
  Sequence found in Organisms: Sorghum bicolor, Saccharum officinarum
MEVFGKSVIAEPSNVIFLSAILNTEGSNPSHKCDKRCQNEHIFGNMYRCKLTGTTHICDKNCNQRILYDNHNSLCRVSGQFFPLSPLEQQAVRGIRRKHEVDSNEGCSFKRRRGAQLHPSPFERSYSAVSPIPSQVGDGMDLS

SEQ ID NO: 6366 - protein, 143 aa, Cenchrus ciliaris
MEVFGKSVIAEPSNVIFLSAILNTEGSNPSHKCDKRCQTEHVFGNMYHCKLTGTTHICDKNCNQRILYDNHNSLCRVSGQLFPLSPLEQQAVRGIRRKHEVDSNEGCSFKRRRGAQLHPSPFERSYTAASPIPSQVGDGMDLS

SEQ ID NO: 6367 - protein, 143 aa, Triticum aestivum
MEVLGKSVIAEPSNVIFLSTILNTEGEIPSHKCDKRCQNEHIFGNMYRCKLTGMTHICDKNCNQRILYDNHNSLCRVSGQLFPLSPLELTAVRGIRRKHEADSNEGCSFKRRRGAQLHPSPFERSYSAVSPIPSQAGDGMDLS

SEQ ID NO: 6368 - protein, 143 aa, Triticum aestivum
MEVLGKSVIAEPSNVIFLSTILNTEGEIPSHKCDKRCQNEHIFGNMYRCKLTGMTHICDKNCNQRILYDNHNSLCRVSGQLFPLSPLELQAVRGIRRKHEADSHEGCSFKRRRGAQLHPSPFERSYSAVSPIPSQAGDGMDLS

SEQ ID NO: 6369 - protein, 143 aa, Hordeum vulgare
MEVLGKSVIAEPSNVIFLSTILNTEGQVPSHKCDKRCQNEHIFGNMYRCKLTGLTHICDKNCNQRILYDNHNSLCRVSGQLFPLSPLELQAVRGIRRKHEADSHEGCSFKRRRGAQLHPSPFERSYSAVSPIPSQAGDGMDLS

SEQ ID NO: 6370 - protein, 144 aa, Brachypodium distachyon
MEVLGKSVIAEPSNVIFMSTILNTEGPIPSHKCDKRCQNEHIFGNMYRCKLTGMTHICDKNCNQRILYDNHSSLCRVSGQLFALSPLELQAVRGIRRKHEVDSHEGCSSFKRRRGAQLHPSPFERSYSVASPIPSQAGDGMDLS

SEQ ID NO: 6371 - protein, 173 aa, Eragrostis curvula
  misc_feature (29)..(29): Xaa can be any naturally occurring amino acid
  misc_feature (43)..(43): Xaa can be any naturally occurring amino acid
MEVFGKSVIAEPSNVIFLSTILNTEGSNXSHKCDKRCQNEHVXGNMYRCKLTGITHICDKNCNQRILYDNHNSLCRVSGQLFPLSPVEQQAVRGIRRKHEVDSNEGCSFKRRRGAKLHPSPFERSYSAVSPSQARRRWHGTELELTRFLYFGSHLIPVFRIPVYTCKLRRLGL

SEQ ID NO: 6372 - protein, 143 aa, Avena sativa
MEVLGKSVIAEPSNVIFMSTILNTEGQIPSHKCDKRCQNEHIFGNMYRCKLTGLTHICDKNCNQRILYDNHNSLCRVSGQLFPLSPLELQAVRGIRRKHEVDSHEGCSFKRRRGAQMHPSPFERSYSAASPIPSQAGDGMDLS

SEQ ID NO: 6373 - protein, 143 aa, Festuca arundinacea
  misc_feature (10)..(10): Xaa can be any naturally occurring amino acid
MEVLGKPVIXEPSNVIFLSTILNTEGQVPSHKCDKRCQNEHIFGNMYRCKLTGMTHICDKNCNQRILYDNHNSLCRVSGQLFPLSPLELQAVRGIRRKHEVDSHEGCSFKRRRGAQLHPSPFERSYSAVSPIPSQAGDGMDLS

SEQ ID NO: 6374 - protein, 144 aa, Triticum aestivum
MEVLGKSVIAEPSNVIFLSTILNTEGEIPSHKCDMRCQNEHIFGNMYRCKLTGMTHICDKNCNQRILYDNHNSLCRVSGQLFALSPLELQAVRGIRRKHEADSSHEGCSFKRRRGAQLHPSPFERSYSAVSPIPSQAGDGMDLS

SEQ ID NO: 6375 - protein, 143 aa, Musa acuminata
MEVYGKSMIAEPSNVIYLSSILNKEGLIPSHKCDKRCQNEHVFGNMYRCKLTGLTHICDKNCEQRILYDNHSSLCRVSGQFFPLSPAEEQAVRGVRRKLEVTNTDGCAFKRRRDAQLHPSPFERIFSAVSPICSQIGDGMDMS

SEQ ID NO: 6376 - protein, 461 aa, Hordeum vulgare
MAHVLAAAEPLTLLKRPTPQNDGFGDDNGSTEEKALKARRRESDPAAALAAARHEFGEHGGVNMSIEASATFTVMEPDTMRRLFTGELGPERGDLYIYSRHFNPTVLALGRQMAALEGTEAAYCTASGMSAISSVLMQLVGAGGHVVASRCLYGGTHALLSRFLPRTSGVKATFVDADDEAAVRAAMRPGETRVVYVETMSNPTLAVADIPMLARVAHEAGAKLVVDNTFTPVVVTPARLGADVVVHSVSKFISGGADIIAGAICGPASLVNAMMDLQDGALMLLGPTMNAKVASELAGRLPHLPLRMQEHSRRAAEFAARMRRQGLRVTYPGLPDHPHHARLRAMGNPGYGAGGMLCLDMGTEERANRLMYHLQNTTQFGLMAVSLGYYDTLMSCSGNSTSSEMDPEDRARAGISPGLIRMSVGYNGTLEQRWAQFERALALMQQETPAAAATAKYGKAV

SEQ ID NO: 6377 - protein, 478 aa, Triticum aestivum
  misc_feature (320)..(320): Xaa can be any naturally occurring amino acid
  misc_feature (324)..(324): Xaa can be any naturally occurring amino acid
MAHVLAAAEPLTLLKRPPPQNDGFGDDNGSTEEKAPKARRRESDPAAALAAARHEFGEHGGVNMSIEASATFTVMEPDTMRRLFTGELGPERGDLYIYSRHFNPTVLALGRQMAALEGTEAAYCTASGMSAISCVLMQLVGAGGHVVASRCLYGGTHALLSRFLPRTSGVQATFVDTDDEAAVRAAIRPGETRLVYVETMSNPTLAVADIPMLARVAHEAGAKLVVDNTFTPVVVSPARLGADVVVHSVSKFISGGADIIAGAICGPASLVKLHDGPAGRRTDAAGPHDERQGGVRAGWLASRTCRCGCRSTRAAPPSSXPGCXARASASPTRASPTTRTTPGCAPWATRATAPAACCASTWARRSAPTASCTTCRTPPSSASWPSASATTTRSCPAPATAPAARWTPRTARAPASPRASSACPSATTAPWSSAGRSSSAPSRSCSSRTPPPPPQSTARPSDDPRGCVNHQALMPHGM

SEQ ID NO: 6378 - protein, 461 aa, Hordeum vulgare
MAHVLAAAEPLTLLKRPTPQNDGFGDDNGSTEEKALKARRRESDPAAALAAARHEFGEHGGVNMSIEASATFTVMEPDTMRRLFTGELGPERGDLYIYSRHFNPTVLALGRQMAALEGTEAAYCTASGMSAISSVLMQLVGAGGHVVASRCLYGGTHALLSRFLPRTSGVKATFVDADDEAAVRAAMRPGETRVVYVETMSNPTLAVADIPMLARVAHEAGAKLVVDNTFTPVVVTPARLGADVVVHSVSKFISGGADIIAGAICGPASLVNAMMDLQDGALMLLGPTMNAKVASELAGRLPHLPLRMQEHSRRAAEFAARMRRQGLRVTYPGLPEHPHHARLRAMGNPGYGAGGMLCLDMGTEERANRLMYHLQNTTQFALMAVSLGYYDTLMSCSGNSTSSEMDPEDRARAGISPGLIRMSVGYNGTLEQRWAQFERALALMQQETPAAAATAKYGKAV

SEQ ID NO: 6379 - protein, 460 aa, Leymus cinereus x Leymus triticoides
  misc_feature (6)..(6): Xaa can be any naturally occurring amino acid
  misc_feature (17)..(17): Xaa can be any naturally occurring amino acid
  misc_feature (172)..(173): Xaa can be any naturally occurring amino acid
  misc_feature (199)..(199): Xaa can be any naturally occurring amino acid
MAHVLXAAEPLTLLKRXPPQNDGFGDDNGSTEEKAPKARRRESDPAAALAAARHEFGEHGGVNMSIEASATFTVMEPDTMRRLFTGELGPERGDLYIYSRHFNPTVLALGRQMAALEGTEAAYCTASGMSAISSVLMQLVGAGGHVVASRCLYGGTHALLSRFLPRTSGVQXXFVDADDEAAVRAAIRPGETRVVYVEXMSNPTLAVADIPMLARVAHEAGAKLVVDNTFTPVVVSPARLGADVVVHSVSKFISGGADIIAGAICGPASLVNAMMDLQDGALMLLGPTMNAKVASELAGRLPHLPLRMQEHSRRAAEFAARMRRQGLRVTYPGLPDHPHHARLRAMGNPGYGAGGMLCLDMGTEERANRLMYHLQNTTQFGLMAVSLGYYDTLMSCSGNSTSSEMDPEDRARAGISPGLIRMSVGYNGTLEQRWAQFERALALMQQETPAAAAAKYGKAV

SEQ ID NO: 6380 - protein, 473 aa, Zea mays
MAQTLSAASELATLKRPFGNDGFGDGSNNGSATGEKPKARRREADPAAALAAARHEFGEHGGVNMSIEASATFTVMEPDTMRRLFAGELGPDRGDMYIYSRHFNPTVLALGRQMAALEGTEAGYCTASGMSAISSVLMQLVGAGGHVVASRCLYGGTHALLARFLPRASGVRATFVDADDEAAVRAAVVPGETRVVYVETMSNPTLAVADIPMLARVAHEAGAKLVVDNTFTPVVVSPARLGADVVVHSVSKFISGGADIIAGAICGPASLVNAMMDLQEGALMLLGPTMNAKVAFELSERLPHLPLRMQEHSRRALAFAERMQGLGLRVLYPGLPGHPHHARLAAMGNPGYGCGGMLCLDMGTEERANRLMHHLQNTTQFGLMAVSLGYYETLMSCSGSSTSSEMPPEDRARAGISPGLVRMSVGYNGTLEQRWAQFERALALMQTPTPTHHLKQAADRDGPEAANNHHRKH

SEQ ID NO: 6381 - protein, 483 aa, Panicum virgatum
MAQAMAAASELVTPLKRPFGSDGLGDGNIISNSGGSNGGVAPGADDEKPKARRREADPAAALAAARHEFGEHGGVNMSIEASATFTVMEPDTMRRLFAGELGPDRGDMYIYSRHFNPTVLALGRQMAALEGTEAAYCTASGMSAISAVLMQLVGAGGHVVASRCLYGGTHALLSRFLPRASGVRATFVDADDEAAVRAAVVPGETRVVYVETMSNPTLAVADIPMLARVAHEAGAKLVVDNTFTPVVVSPARLGADVVVHSVSKFISGGADIIAGAICGPASLVNAMMDLQEGALMLLGPTMNAKVAFELSERLPHLPLRMQEHSRRALAFASRMQRLGLRVLYPGLPDHPHHARLAAAANPGYGSGGMLCVDMGTEDRANRLMHHLQNTTQFGLMAVSLGYYETLMSCSGSSTSSEMPPEDRARAGISPGLVRMSVGYNGTLEQRWAQFERALALMQPPPLHHKAAAGRDVPDAGTTNHRKH

SEQ ID NO: 6382 - protein, 477 aa, Sorghum bicolor
MAQTMAAASELVTLKRPFGGNDGFGDGSGNGGTVAEEKPKARRREADPAAALASARHEFGEHGGVNMSIEASATFTVMEPDTMRRLFAGELGPDRGDMYIYSRHFNPTVLALGRQMAALEGTEAAYCTASGMSAISAVLMQLVGAGGHVVASRCLYGGTHALLARFLPRTSGVRATFVDADDEAAVRAAVVPGETRVVYVETMSNPTLAVADIPMLARVAHEAGAKLVVDNTFTPVVVSPARLGADVVVHSVSKFISGGADIIAGAICGPASLVNAMMDLQDGALMLLGPTMNAKVAFELSERLPHLPLRIQEHSRRALAFAERMQGLGLRVLYPGLPDHPHHARLAAMGNPGYGSGGMLCLDMGTEERANRLMHHLQNTTQFGLMAVSLGYYETLMSCSGSSTSSEMPPEDRARAGISPGLVRMSVGYNGTMEQRWAQFERALALMHPPTHHLSLKGAAAADRDGSDAAGNNHRKH

SEQ ID NO: 6383 - protein, 458 aa, Brachypodium distachyon
MAHVLAAAEPISMLKRPPPPNDDEKAPPVNKAARRRDPPSSDPAAALAAARHEFGEHGGVNMSIEASATFTVMEPDTMRKLFAGELGPDRGDLYIYSRHFNPTVLALGRQMAALEGTEAAYCTASGMSAISSVLMQLVGAGGHVVASRCLYGGTHALLSRFLPRTSGVTATFVDADDEDAVRAAVRPGETKVVYVETMSNPTLAVADIPMLARVAREAGAKLVVDNTFTPVVVSPARLGADVVVHSVSKFISGGADIIAGAICGPASLVNSMMDLQDGALMLLGPTMNAKVASELAARLPHLPLRMQEHSRRAGEFAARMQRMGLRVVYPGLQDHTHHGRLRAMANPGYGFGGMLCVDMGTEERAARLMHHLQNTTQFGLMAVSLGYYETLMSCSGSSTSSEMDPNDRALAGISPGLIRMSVGYNGTLEQRWAQFERAFALMQQQDAPSAAAKYCKAI

SEQ ID NO: 6384 - protein, 458 aa, Brachypodium distachyon
MAHVLAAAEPISMLKRPPPPNDDEKAPPVNKAARRRDPPSSDPAAALAAARHEFGEHGGVNMSIEASATFTVMEPDTMRKLFAGELGPDRGDLYIYSRHFNPTVLALGRQMAALEGTEAAYCTASGMSAISSVLMQLVGAGGHVVASRCLYGGTHALLSRFLPRTSGVTATFVDADDEDAVRAAVRPGETKVVYVETMSNPTLAVADIPMLARVAREAGAKLVVDNTFTPVVVSPARLGADVVVHSVSKFISGGADIIAGAICGPASLVNSMMDLQDGALMLLGPTMNAKVASELAARLPDLPLRMQEHSRRAGEFAARMQRMGLRVVYPGLQDHTHHGRLRAMANPGYGFGGMLCVDMGTEERAARLMHHLQNTTQFGLMAVSLGYYETLMSCSGSSTSSEMDPNDRALAGISPGLIRMSVGYNGTLEQRWAQFERAFALMQQQDAPSAAAKYCKAI

SEQ ID NO: 6385 - protein, 476 aa, Zea mays
MAQTTMAAASELVTLKRPFGKDVSGSGDGSVAEEKPKAPARRREAEDPAAALAAARHEFGEHGGVNMSIEASATFTVMEPETMRRLFAGELGPDRGGMYIYSRHFNPTVQALGRQMAALEGTEAAYCTASGMSAISSVMVQLVGAGGHVVASRCLYGGTHALLARFLPRAAGVRATFVDVDDEAAVRAAVVPGETRVVFVETMSNPTLAVADIPMLARVAHEAGAKLVVDNTFTPVVVSPARLGADVVVHSVSKFISGGGDIIAGAICGPASLVNAMMDLQEGALMLLGPTMNAKMAFELWERLPHLPLRMQEHSRRALAFAARMQRLGLRVLYPGLPDHPHHARLAAMRNPGYGSGGMLCVDMGTEERANRLMHHLQNTTQFGLMAVSLGYYETLVSCSGTSTSSEMPPQDRERAGISPGLVRMSVGYNGTLEQRWAQLERALALMQPPPPPRHHHLKGAADRDGPDAANNHGKH

SEQ ID NO: 6386 - protein, 263 aa, Saccharum officinarum
MAQTMAATSELVTLKRPFGGNDGFGDGGSNGTVADEKPKARRREADPAAALASARHEFGEHGGVNMSIEASATFTVMEPDTMRRLFAGELGPDRGDMYIYSRHFNPTVLALGRQMAALEGTEAAYCTASGMSAISAVLMQLVGAGGHVVASRCLYGGTHALVARFLPRTSGVRATSWTPTTRPPCAPRWSRGRRGWCTWRPCPTRRWPSPTSPCWRGWRTRRGPSSWWTTPSPPWWSRPRASAPTSSSTASPSSSAVAPTSSP

SEQ ID NO: 6387 - protein, 214 aa, Panicum virgatum
MTSVVHSVSGDHRAEDQHQQQKQAEPEDQQEAPVTSSDSQPTVGTPSADYVTPYAPHDMAHAMGQYAYPNIDPYYGSLYAAYGGQPMMHPPLVGMHPTGLPLPTDAIEEPVYVNAKQYNAILRRRQSRAKAESERKLVKGRKPYLHESRHQHALKRARGAGGRFLNSKPDDKEENSDSSHKEKQNGVAPHKSGQPSTPPSPNGASSANQADSHQ

SEQ ID NO: 6388 - protein, 912 aa, Zea mays
MNPDNFTHKTNEAIVGAHEIAVEAGHAQLTPLHLAAVLAADKGGILRQAITGASGGDGAAGDSFERVLNNSLKKLPSQSPPPDSVPASTALIKVIRRAQSAQKKRGDSHLAVDQLLLGLLEDSQISDCLKEAGVSAARVRAELEKLRGGEGRRVESASGDTNFQALKTYGRDLVEQAGKLDPVIGRDEEIRRVVRILSRRTKNNPVLIGEPGVGKTAVVEGLAQRIVRGDVPSNLLDVRLIALDMGALVAGAKYRGEFEERLKAVLKEVEEAEGKVILFIDEIHLVLGAGRTEGSMDAANLFKPMLARGQLRCIGATTLEEYRKYVEKDAAFERRFQQVFVAEPSVPDTVSILRGLKEKYEGHHGVRIQDRALVVAAQLSARYIMGRHLPDKAIDLVDEACANVRVQLDSQPEEIDNLERKRIQLEVELHALEKEKDKASKARLIEVRKELDDLRDKLQPLTMKYRKEKERIDEIRKLKQRREELQFTLQEAERRMDLARVADLKYGALQEIDAAISKLESETGENLMLTETVGPEQIAEVVSRWTGIPVTRLGQNDKERLVGLADRLHQRVVGQTEAVSAVAEAVLRSRAGLGRPQQPTGSFLFLGPTGVGKTELAKALAEQLFDDENLLVRIDMSEYMEQHSVARLIGAPPGYVGHEEGGQLTEQVRRRPYSVILFDEVEKAHVAVFNTLLQVLDDGRLTDGQGRTVDFRNTVIIMTSNLGAEHLLAGMVGKNSMKVARDLVMQEVRRHFRPELLNRLDEIVIFDPLSHEQLRKVARLQMKDVAVRLAERGIALAVTDAALDIILSLSYDPVYGARPIRRWIEKRVVTQLSKMLIQEEIDENCTVYIDAAPGKDELVYRVDRSGGLVNAETGMKSDILIQVPTSSTRSDAAQAVKKMRIMEEDEDGMDEE

SEQ ID NO: 6389 - protein, 912 aa, Oryza sativa
MNPDNFTHKTNEALVAAHEIASEAGHAQLTPLHLVAALAADKGGILRQAISQASGGDAGAPDSFERVVSGALKKLPSQSPPPDSVPASTALIKVIRRAQSAQKKRGDSHLAVDQLLLGLLEDSLISDCLKEAGVSAARVRAELEKLRGGEGRKVESASGDTNFQALKTYGRDLVEQAGKLDPVIGRDEEIRRVVRILSRRTKNNPVLIGEPGVGKTAVVEGLAQRIVRGDVPSNLLDVRLIALDMGALVAGAKYRGEFEERLKAVLKEVEEAEGKVILFIDEIHLVLGAGRTEGSMDAANLFKPMLARGQLRCIGATTLEEYRKYVEKDAAFERRFQQVFVAEPSVPDTISILRGLKEKYEGHHGVRIQDRALVVAAQLSARYIMGRHLPDKAIDLVDEACANVRVQLDSQPEEIDNLERKRIQLEVEHHALEKEKDKASKARLVEVKKELDDLRDKLQPLTMKYRKEKERIDEIRKLKQRREELQFTLQEAERRMDLARVADLKYGALQEIDVAIAKLESETGENLMLTETVGPEQIAEVVSRWTGIPVTRLGQNDKERLVGLADRLHQRVVGQAEAVSAVAEAVLRSRAGLGRPQQPTGSFLFLGPTGVGKTELAKALAEQLFDDENLLVRIDMSEYMEQHSVARLIGAPPGYVGHEEGGQLTEQVRRRPYSVILFDEVEKAHVAVFNTLLQVLDDGRLTDGQGRTVDFRNTVIIMTSNLGAEHLLAGMVGKNSMKVARDLVMQEVRRHFRPELLNRLDEIVIFDPLSHEQLRKVARLQMKDVAVRLAERGVALAVTDAALDVILSLSYDPVYGARPIRRWIEKRVVTQLSKMLIQEEIDENCTVYIDAAPHKDELAYRVDNRGGLVNAETGQKSDILIQVPNGAATGSDAAQAVKKMRIMEDEDGMDEE

SEQ ID NO: 6390 - protein, 911 aa, Brachypodium distachyon
MNPDNFTHKTNEALVAAHEAASEAGHAQITPLHLAASLAGDKSGILRQAIAQASGGDPAAGDSFERVLSGALKKLPSQSPPPDSVPASTALIKAIRRAQSAQKKRGDSHLAVDQLLLGLLEDSQISDCLKEAGVSASRVRAELEKLRGGDSRKVESASGDTNFQALKTYGRDLVEQAGKLDPVIGRDEEIRRVVRILSRRTKNNPVLIGEPGVGKTAVVEGLAQRIVRGDVPSNLLDVRLIALDMGALVAGAKYRGEFEERLKAVLKEVEEAEGKVILFIDEIHLVLGAGRTEGSMDAANLFKPMLARGQLRCIGATTLEEYRKYVEKDAAFERRFQQVYVAEPSVADTISILRGLKEKYEGHHGVRIQDRAIVVAAQLSSRYIMGRHLPDKAIDLVDEACANVRVQLDSQPEEIDNLERKRIQLEVELHALEKEKDKASKARLVEVRKELDDLRDKLQPLTMKYRKEKERIDEIRKLKQRREELQFTLQEAERRMDLARVADLKYGALMEIDAAIAKLEGETGENLMLTETVGPEQIAEVVSRWTGIPVTRLGQNDKERLVGMADRLHTRVVGQTEAVNAVAEAVLRSRAGLGRPQQPTGSFLFLGPTGVGKTELAKALAEQLFDDENLLVRIDMSEYMEQHSVARLIGAPPGYVGHEEGGQLTEQVRRRPYSVILFDEVEKAHVAVFNTLLQVLDDGRLTDGQGRTVDFRNTVIIMTSNLGAEHLLAGMVGKNSMKVARDLVMQEVRRHFRPELLNRLDEIVVFDPLSHEQLRKVARLQMKDVAVRLAERGIALAVTDAALDVILSLAYDPVYGARPIRRWIEKRVVTQLSKMLIQEEIDENCTVYIDASANKDELAYRVDRSGGLVNAETGQRSDILIQVPNGAVGGGEAAQAVKKMRIMEEDGMDED

SEQ ID NO: 6391 - protein, 912 aa, Brachypodium distachyon
MNPDNFTHKTNEALVAAHEAASEAGHAQITPLHLAASLAGDKSGILRQAIAQASGGDPAAGDSFERVLSGALKKLPSQSPPPDSVPASTALIKAIRRAQSAQKKRGDSHLAVDQLLLGLLEDSQISDCLKEAGVSASRVRAELEKLRGGDSRKVESASGDTNFQALKTYGRDLVEQAGKLDPVIGRDEEIRRVVRILSRRTKNNPVLIGEPGVGKTAVVEGLAQRIVRGDVPSNLLDVRLIALDMGALVAGAKYRGEFEERLKAVLKEVEEAEGKVILFIDEIHLVLGAGRTEGSMDAANLFKPMLARGQLRCIGATTLEEYRKYVEKDAAFERRFQQVYVAEPSVADTISILRGLKEKYEGHHGVRIQDRAIVVAAQLSSRYIMGRHLPDKAIDLVDEACANVRVQLDSQPEEIDNLERKRIQLEVELHALEKEKDKASKARLVEVRKELDDLRDKLQPLTMKYRKEKERIDEIRKLKQRREELQFTLQEAERRMDLARVADLKYGALMEIDAAIAKLEGETGENLMLTETVGPEQIAEVVSRWTGIPVTRLGQNDKERLVGMADRLHTRVVGQTEAVNAVAEAVLRSRAGLGRPQQPTGSFLFLGPTGVGKTELAKALAEQLFDDENLLVRIDMSEYMEQHSVARLIGAPPGYVGHEEGGQLTEQVRRRPYSVILFDEVEKAHVAVFNTLLQVLDDGRLTDGQGRTVDFRNTVIIMTSNLGAEHLLAGMVGKNSMKVARDLVMQEVRRHFRPELLNRLDEIVVFDPLSHEQLRKVARLQMKDVAVRLAERGIALAVTDAALDVILSLAYDPVYGARPIRRWIEKRVVTQLSKMLIQEEIDENCTVYIDASANKDELAYRVDRSGGLVNAETGQRSDILIQVPNGAVGGGEAAQAVKKMRIMEEDGMDEDV

SEQ ID NO: 6392 - protein, 916 aa, Hordeum vulgare
MNPDNFTHKTNEALVAAHEAASEAGHAQITPLHLAAALAADKSGILRQAVAGASGGNAAAGDSFERVLTAALKKLPSQSPPPDSVPASTALIKAIRRAQSAQKKRGDSHLAVDQLLMGLLEDSQIADCLKEAGVSASRVRAELEKLRGGDSRKVESASGDTNFQALKTYGRDLVEVAGKLDPVIGRDEEIRRVVRILSRRTKNNPVLIGEPGVGKTAVVEGLAQRVVRGDVPSNLLDVRLVALDMGALVAGAKYRGEFEERLKAVLKEVEEAEGKVILFIDEIHLVLGAGRTEGSMDAANLFKPMLARGQLRCIGATTLEEYRKYVEKDAAFERRFQQVYVAEPSVADTISILRGLKEKYEGHHGVRIQDRAIVVAAQLSARYIMGRHLPDKAIDLVDEACANVRVQLDSQPEEIDNLERKRIQLEVELHALEKEKDKASKARLVEVRKELDDLRDKLQPLTMKYRKEKERIDEIRKLKQRREELQFTLQEAERRMDLARVADLKYGALQEIDAAIAKLEGETGENLMLTETVGPEQIAEVVSRWTGIPVTRLGQNDKERLVGMADRLHTRVVGQTEAVNAVAEAVLRSRAGLGRPQQPTGSFLFLGPTGVGKTELAKALAEQLFDDENLLVRIDMSEYMEQHSVARLIGAPPGYVGHEEGGQLTEQVRRRPYSVILFDEVEKAHVAVFNTLLQVLDDGRLTDGQGRTVDFRNTVIIMTSNLGAEHLLAGMVGKNSMKVARDLVMQEVRRHFRPELLNRLDEIVVFDPLSHEQLRKVARLQMKDVAVRLAERGVALAVTDAALDVILSLAYDPVYGARPIRRWIEKRVVTQLSKMLIQEEIDENCTVYIDAANKDELAYRVDRTGGLVNAETGQRSDILIQVPNGALAGGGGEAAKAVKKMRVMEDGDEDGMDEDA

SEQ ID NO: 6393 - protein, 917 aa, Triticum aestivum
MNPDNFTHKTNEALVAAHEAASEAGHAQITPLHLAAALAADKSGILRQAVAGASGGNASAGDSFERVLSGALKKLPSQSPPPDSVPASTALIKAIRRAQSAQKKRGDSHLAVDQLLMGLLEDAQIADCLKEAGVSASRVRAELEKLRGGDNSRKVESASGDTNFQALKTYGRDLVEVAGKLDPVIGRDEEIRRVVRILSRRTKNNPVLIGEPGVGKTAVVEGLAQRVVRGDVPSNLLDVRLVALDMGALVAGAKYRGEFEERLKAVLKEVEEADGKVILFIDEIHLVLGAGRTEGSMDAANLFKPMLARGQLRCIGATTLEEYRKYVEKDAAFERRFQQVYVAEPSVADTISILRGLKEKYEGHHGVRIQDRAIVVAAQLSARYIMGRHLPDKAIDLVDEACANVRVQLDSQPEEIDNLERKRIQLEVELHALEKEKDKASKARLVEVRKELDDLRDKLQPLTMKYRKEKERIDEIRKLKQRREELQFTLQEAERRMDLARVADLKYGALQEIDAAIAKLEGETGENLMLTETVGPEQIAEVVSRWTGIPVTRLGQNDKERLVGMADRLHTRVVGQTEAVNAVAEAVLRSRAGLGRPQQPTGSFLFLGPTGVGKTELAKALAEQLFDDENLLVRIDMSEYMEQHSVARLIGAPPGYVGHEEGGQLTEQVRRRPYSVILFDEVEKAHVAVFNTLLQVLDDGRLTDGQGRTVDFRNTVIIMTSNLGAEHLLAGMVGKNSMKVARDLVMQEVRRHFRPELLNRLDEIVVFDPLSHEQLRKVARLQMKDVAVRLAERGVALAVTDAALDVILSLAYDPVYGARPIRRWIEKRVVTQLSKMLIQEEIDENCTVYIDAANKDELAYRVDRSGGLVNAETGQRSDILIQVPNGALGGGGGEAAKAVKKMRVMEDGDEDSMDEDV

SEQ ID NO: 6394 - protein, 913 aa, Triticum aestivum
MNPDKFTHKTNEALAAAHEMASEAGHAQLTPLHLAAALAADRSGILRQAIAHASGGNDAAADSFERVASAALKRLPSQSPPPDTVPASTSLVKAVRRAQSAQKSRGDSHLAVDQLLMGLLEDPQISDALKEAGISAARVKAEVEKLRGGDNRRVESASGDTNFQALKTYGRDLVEVAGKLDPVIGRDEEIRRVVRILSRRTKNNPVLIGEPGVGKTAVVEGLAQRVVRGDVPSNLLDVRLVALDMGALVAGAKYRGEFEERLKAVLKEVEEAEGKVILFIDEIHLVLGAGRTEGSMDAANLFKPMLARGQLRCIGATTLEEYRKYVEKDAAFERRFQQVFVAEPSVPDTVSILRGLKEKYEGHHGVRIQDRALVIAAQLSSRYIMGRHLPDKAIDLVDEACANVRVQLDSQPEEIDNLERKRIQLEVELHALEKEKDKASKARLVDVRKELDDLRDKLQPLQMKYRKEKERIDEIRSLKQRREELQFTLQEAERRMDLARVADLRYGALQEVDAAIAKLEGETGENLMLTETVGPDQIAEVVSRWTGIPVTRLGQNEKARLIGLADRLHQRVVGQYEAVNAVGEAVLRSRAGLGRPQQPTGSFLFLGPTGVGKTELAKALAEQLFDDENLLVRIDMSEYMEQHSVARLIGAPPGYVGHEEGGQLTEQVRRRPYSVILFDEVEKAHVAVFNTLLQVLDDGRLTDGQGRTVDFRNTVIIMTSNLGAEHLLAGMVGNSMKVARDLVMQEVRRHFRPELLNRLDEIVIFDPLSHEQLRKVARLQMKDVAVRLAERGVALAVTDAALDVILSLSYDPVYGARPIRRWIEKRIVTELSKMLIREEIDENSTVYIDAAPSKDELTYGVDKHGGLVNARTGHKSDILIQVPSGAVGGDAAHAVKKMKIMQDGGEVDDMEEE

SEQ ID NO: 6395 - protein, 913 aa, Brachypodium distachyon
MNPDKFTHKTNEALAAAHEMALDAGHAQLTPLHLAAALAADRSGILRQAIAHASGGNDSAAESFERVAAAALKRLPSQAPPPDAVPPSTSLVKAIRRAQSAQKSRGDSHLAVDQLLIGLLEDSQISDALKEAGVSAARVKAEVEKLRGGDNRRVESASGDTNFQALKTYGRDLVEVAGKLDPVIGRDEEIRRVVRILSRRTKNNPVLIGEPGVGKTAVVEGLAQRIVRGDVPSNLLDVRLVALDMGALVAGAKYRGEFEERLKAVLKEVEEAEGKVILFIDEIHLVLGAGRTEGSMDAANLFKPMLARGQLRCIGATTLEEYRKYVEKDAAFERRFQQVFVAEPSVTDTVSILRGLKEKYEGHHGVRIQDRALVVAAQLSSRYIMGRHLPDKAIDLVDEACANVRVQLDSQPEEIDNLERKRIQLEVELHALEKEKDKASKARLIEVRKELDDLRDKLHPLQMKYRKEKERIDEIRNLKQRREELQFTLQEAERRMDLARVADLRYGALQEIDVAIAKLEGETGENLMLTETVGPDQIAEVVSRWTGIPVTRLGQNEKERLVGLDDRLHQRVVGQHEAVSAVAEAVLRSRAGLGRPQQPTGSFLFLGPTGVGKTELAKALAEQLFDDENLLVRIDMSEYMEQHSVARLIGAPPGYVGHEEGGQLTEQVRRRPYSVILFDEVEKAHVAVFNTLLQVLDDGRLTDGQGRTVDFRNTVIIMTSNLGAEHLLAGMMGNSMKVARDMVMQEVRRHFRPELLNRLDEIVIFDPLSHEQLRKVARFQMKDVAVRLAERGIALAVTDAALDIILSLSYDPVYGARPIRRWIEKRIVTELSKMLIREEIDENSTVYIDAAPGKEELTYRVDKNGGFVNVQTGQKSDILIQVPSGAIGSDAAHAVKKMKIMQDGGDVDDMEEE

SEQ ID NO: 6396 - protein, 915 aa, Sorghum bicolor
MNPNKFTHKTNEALALAHNIASEAGHAQITPLHLAAALIADRPGVLRQAIAHASGGNDVAAADSFERVLASTLKRLPSQSPPPDTVPASTALVKVIRRAQSAQKVRGDSHLAVDQLLVGLLEDPQVWDALKEAGVVAARVKAEVDKLRGGDNRRVESASGDTSFQAVKTYGRDLVEVAGKLDPVIGRDEEIRRVVRILSRRTKNNPVLIGEPGVGKTAVVEGLAQRIVRGDVPSNLLDVRLVALDMGALVAGAKYRGEFEERLKAVLKEVEESDGKVILFIDEIHLVLGAGRTDGSMDAANLFKPMLARGQLRCIGATTLEEYRKYVEKDAAFERRFQQVYVAEPSVSDTVSILRGLKEKYEGHHGVRIQDRALVIAAQLSSRYIMGRHLPDKAIDLVDEACANVRVQLDSQPEEIDNLERKRIQLEVELHALEKEKDKASKARLVEVRKELDNLRDKLQPLQMRYRKEKERIDEIRKLKHRREELLFSLQEAERRMDLARVADIRYGALQEIDAAIAKLEGETGENLMLTETVGPEQIAEVVSRWTGIPVTRLGQNDKERLVGLADRLHRRVIGQHEAVNAIAEAVLRSRAGLGRTQQPTGSFLFLGPTGVGKTELAKALAEQLFDDEKLLVRLDMSEYMEKHSVSRLIGAPPGYVGHEEGGQLTEQVRRRPYSVILFDEVEKAHVAVFNTLLQVLDDGRLTDGQGRTVDFRNTVIIMTSNIGAKHLLAGMVGNNSMKAARDLVMLEVRKHFRPELLNRLDEIVIFDPLSHEQLRMVARLQVKEVAYRLAERGVALAVTDAALDLILSLSYDPVYGARPIRRWIEKKVVTELSKMLIKEEIDENSTVSIDASPSKDELIYKVDMNGGLVNAQTGHKSDILIQVPNGGINGGAAHTVKKMRLMEDDQDDDDMEEE

SEQ ID NO: 6397 - protein, 908 aa, Cucumis sativus
MNPDKFTHKTNEALAGAHELALNSGHAQLTPLHLAVALVSDPSGILSQAIASSGGENAHKEVETVFKRALKKLPSQSPAPDEVPASTTLIKVIRRAQAAQKSRGDTHLAVDQLVLGLLEDSQIGDLLKEAGVTTAKVKSEVEKLRGKEGKKVESASGDTTFQALKTYGRDLVEQAGKLDPVIGRDEEIRRVVRILSRRTKNNPVLIGEPGVGKTAVVEGLAQRIVRGDVPSNLADVRLIALDMGALVAGAKYRGEFEERLKAVLKEVEDAEGKVILFIDEIHLVLGAGRTEGSMDAANLFKPMLARGQLRCIGATTLEEYRKYVEKDAAFERRFQQVYVAEPSVPDTISILRGLKERYEGHHGVRIQDRALVVAAQLSSRYITGRHLPDKAIDLVDEACANVRVQLDSQPEEIDNLERKRMQLEVELHALEKEKDKASKARLVEVRRELDDLRDKLQPLLMKYRKEKERIDEIRRLKQRREELQIALQEAERRYDLARAADLRYGAIQEVESAIARIEGNTDENLMLTETVGPEQVAEVVSRWTGIPVTRLGQNDKERLVGLADRLHKRVVGQNQAVDAVAEAVLRSRAGLGRPQQPTGSFLFLGPTGVGKTELAKALAEQLFDDENLLVRIDMSEYMEQHSVSRLIGAPPGYVGHEEGGQLTEAVRRRPYSVILFDEVEKAHIAVFNTLLQVLDDGRLTDGQGRTVDFRNTVIIMTSNLGAEHLLAGLMGKCTMQVARDRVMQEVRKHFRPELLNRLDEIVVFDPLSHEQLRKVARLQMKDVAARLAERGVALAVTDAALDYVLAESYDPVYGARPIRRWLEKRVVTELSRMLIKEEIDENSTVYIDAAADGNSLAYRVEKNGGFVDAATGKKSDVLIQINNVPRSDAAQTVKKMKIEETDEDEMEE

SEQ ID NO: 6398 - protein, 911 aa, Vitis vinifera
MNPEKFTHKTNETLAGAHELAMNSGHAQLTPLHVAVALITDPNGILRQAIIGAGGNEEAANSVERVFNKALKKLPSQSPPPDEIPVSTTLIKVVRRAQSSQKSRGDTHLAVDQLILGLLEDSQIGDLLKEAGVSTSRVKSEVEKLRGKEGKKVESASGDTTFQALKTYGRDLVEQAGKLDPVIGRDEEIRRVIRILSRRTKNNPVLIGEPGVGKTAVVEGLAQRIVRGDVPSNLAEVRLIALDMGALVAGAKYRGEFEERLKSVLKEVEEAEGKVILFIDEIHLVLGAGRTEGSMDAANLFKPMLARGQLRCIGATTLEEYRKYVEKDAAFERRFQQVYVAEPSVPDTISILRGLKERYEGHHGVRIQDRALVVAAQLSSRYITGRHLPDKAIDLVDEACANVRVQLDSQPEEIDNLERKRMQLEVELHALEKEKDKASKARLVEVRRELDDLRDKLQPLMMKYKKEKERIDELRRLKQKREELLFALQEAERRYDLARAADLRYGAIQEVEAAIANLEGTTDENMMLTETVGPEQIAEVVSRWTGIPVTRLGQNDKERLIGLAERLHQRVVGQDQAVSAVAEAVLRSRAGLGRPQQPTGSFLFLGPTGVGKTELAKALAEQLFDDENLLVRIDMSEYMEQHSVSRLIGAPPGYVGHDEGGQLTEAVRRRPYSVVLFDEVEKAHIAVFNTLLQVLDDGRLTDGQGRTVDFTNTVIIMTSNLGAEHLLSGLVGKCTMQDARDRVMQEVRRHFRPELLNRLDEIVVFDPLSHDQLRKVARLQMKDVASRLAERGIALAVTDAALDVVLAESYDPVYGARPIRRWLEKKVVTELSKMLIREEIDENSTVYIDAGVSGKGLAYRVENNGGLVNASTGQKSDVLIRIPNGPRSDAAQAVKKMKIEEIEDEEDEMDL

SEQ ID NO: 6399 - protein, 910 aa, Castanea mollissima
MNPEKNTHKTNETLLAANELATTGGHSQFTPLHLALALISDANGIFKQAIANAGGEDATKAVERVFSQALKKLPSQSPPPDEVPASTSLIKVLRRAQAAQKTRGDTHLAVDQLILGLLEDSQIGDLLKEAGVPAAKVKSEVEKLRGKEGRKVESASGDTNFQALKTYGRDLVEVAGKLDPVIGRDEEIRRVVRILSRRTKNNPVLIGEPGVGKTAVVEGLAQRIMRGDVPSNLAEVRLIALDMGALIAGAKYRGEFEERLKAVLKEVEEAEGKVILFIDEIHLVLGAGRTEGSMDAANLFKPMLARGQLRCIGATTLEEYRKYVEKDAAFERRFQQVYVAEPSVADTISILRGLKEKYEGHHGVRIQDRALVVAAQLSSRYITGRHLPDKAIDLVDEACANVRVQLDSQPEEIDNLERKRIQLEVELHALEKEKDKASKARLVEVRKELDDLRDKLQPLMMKYKKEKERIDELRRLKQKREELLFAVQEAERRYDLARVADLKYGAIQELEAAIARLEGNADDNLMLTETVGPEHIAEVVSRWTGIPVTRLGQNEKARLIGLAERLHKRVVGQDQAVGAVAEAVLRSRAGLGRPQQPTGSFLFLGPTGVGKTELAKALAEQLFDDENLLVRIDMSEYMEQHSVSRLIGAPPGYVGHEEGGQLTEAVRRRPYSVVLFDEVEKAHISVFNTLLQVLDDGRLTDGQGRTVDFRNTVIIMTSNLGAEHLLSGLMGKVSMQVARDHVMQEVRKHFRPELLNRLDEIVVFDPLSHEQLRKVARLQMKDVASRLAERGVALAVTDAALDVVLAESYDPVYGARPIRRWLEKKVVTELSKMLIREEIDENSTVYIDAGPNGSGLAYKVEKNGGLVNAATGQKSDVLIQIPNGARSDAAQAVKKMKIEEIDDDDDEMDG

SEQ ID NO: 6400 - protein, 840 aa, Brachypodium distachyon
MNPDKFTHKTNEALAAAHEMALDAGHAQLTPLHLAAALAADRSGILRQAIAHASGGNDSAAESFERVAAAALKRLPSQAPPPDAVPPSTSLVKAIRRAQSAQKSRGDSHLAVDQLLIGLLEDSQISDALKEAGVSAARVKAEVEKLRGGDNRRVESASGDTNFQALKTYGRDLVEVAGKLDPVIGRDEEIRRVVRILSRRTKNNPVLIGEPGVGKTAVVEGLAQRIVRGDVPSNLLDVRLVALDMGALVAGAKYRGEFEERLKAVLKEVEEAEGKVILFIDEIHLVLGAGRTEGSMDAANLFKPMLARGQLRCIGATTLEEYRKYVEKDAAFERRFQQVFVAEPSVTDTVSILRGLKEKYEGHHGVRIQDRALVVAAQLSSRYIMGRHLPDKAIDLVDEACANVRVQLDSQPEEIDNLERKRIQLEVELHALEKEKDKASKARLIEVRKELDDLRDKLHPLQMKYRKEKERIDEIRNLKQRREELQFTLQEAERRMDLARVADLRYGALQEIDVAIAKLEGETGENLMLTETVGPDQIAEVVSRWTGIPVTRLGQNEKERLVGLDDRLHQRVVGQHEAVSAVAEAVLRSRAGLGRPQQPTGSFLFLGPTGVGKTELAKALAEQLFDDENLLVRIDMSEYMEQHSVARLIGAPPGYVGHEEGGQLTEQVRRRPYSVILFDEVEKAHVAVFNTLLQVLDDGRLTDGQGRTVDFRNTVIIMTSNLGAEHLLAGMMGNSMKVARDMVMQEVRRHFRPELLNRLDEIVIFDPLSHEQLRKVARFQMKDVAVRLAERGIALAVTDAALDIILSLSYDPVYGARPIRRWIENEDSNRALQDVDPRRD

SEQ ID NO: 6401 - protein, 911 aa, Glycine max
MNPEKFTHKTNEALASAHELAMSSGHAQLTPIHLAHALISDPNGIFVLAINSAGGGEESARAVERVLNQALKKLPCQSPPPDEVPASTNLVRAIRRAQAAQKSRGDTHLAVDQLILGILEDSQIGDLLKEAGVAVARVKSEVDKLRGKEGKKVESASGDTNFQALKTYGRDLVEQAGKLDPVIGRDEEIRRVVRILSRRTKNNPVLIGEPGVGKTAVVEGLAQRIVRGDVPSNLADVRLIALDMGALVAGAKYRGEFEERLKAVLKEVEEAEGKVILFIDEIHLVLGAGRTEGSMDAANLFKPMLARGQLRCIGATTLEEYRKYVEKDAAFERRFQQVFVAEPSVVDTISILRGLKERYEGHHGVRIQDRALVMAAQLSNRYITGRHLPDKAIDLVDEACANVRVQLDSQPEEIDNLERKRMQLEVELHALEKEKDKASKARLVEVRKELDDLRDKLQPLMMKYRKEKERVDEIRRLKKKREELLFALQEAERRYDLARAADLRYGAIQEVETAIQQLEGSTEENLMLTETVGPEQIAEVVSRWTGIPVTRLGQNEKERLIGLGDRLHSRVVGQDQAVNAVAEAVLRSRAGLGRPQQPTGSFLFLGPTGVGKTELAKALAEQLFDNENQLVRIDMSEYMEQHSVSRLIGAPPGYVGHEEGGQLTEAVRRRPYSVVLFDEVEKAHTSVFNTLLQVLDDGRLTDGQGRTVDFRNTVIIMTSNLGAEHLLSGLSGKCTMQVARDRVMQEVRRQFRPELLNRLDEIVVFDPLSHDQLRKVARLQMKDVASRLAEKGIALAVTDAALDYILAESYDPVYGARPIRRWLEKKVVTELSRMLVREEIDENSTVYIDAGPNGGELVYRVEKNGGVVNPTTGQKSDILIQIPNGHAPKTDAVQAVKKMKIEEIDDDEMEE

SEQ ID NO: 6402 - protein, 909 aa, Lotus japonicus
MNPDKFTHKTNEALAGAHELAMSSGHAQMTPLHLASTLISDPNGIFFQAISNSSGEESARAVERVLNQALKKLPSQSPPPDEIPASTTLIKAIRRAQAAQKSRGDTHLAVDQLILGILEDSQIGDLLKEAGVAAAKVKSELDKLRGKVGKKVESASGDTTFQALKTYGRDLVEQAGKLDPVIGRDEEIRRVVRILSRRTKNNPVLIGEPGVGKTAVVEGLAQRIVRGDVPSNLSDVRLIALDMGALVAGAKYRGEFEERLKAVLKEVEEAEGKVILFIDEIHLVLGAGRTEGSMDAANLFKPMLARGQLKCIGATTLEEYRKYVEKDAAFERRFQQVYVAEPSVPDTISILRGLKERYEGHHGVRILDRALVVAAQLSSRYITGRHLPDKAIDLVDEACANVRVQLDSQPEEIDNLERKRMQLEVELHALEKEKDKASKARLVNVRRELDDLRDKLQPLMMKYRKEKERVDEIRRLKQKREELLFAAQEAERRYDLARAADLRYGAIQEVESAIQQLEGSTDQENLMLTETVGPDQISEVVSRWTGIPVTRLGQNEKERLIGLGDRLHNRVVGQDQAVNAVAEAVLRSRAGLGRPQQPTGSFLFLGPTGVGKTELAKALAEQLFDDENQLVRIDMSEYMEQHSVSRLIGAPPGYVGHEEGGQLTEAVRRRPYSVVLFDEVEKAHTSVFNTLLQVLDDGRLTDGQGRTVDFRNTVVIMTSNLGAEHLLSGLSGKCSMQVARDKVMQEVRKHFRPELLNRLDEIVVFDPLSHEQLRKVARLQMKEVASRLAERGIAMAVTDAALDYILAESYDPVYGARPIRRWLERKVVTELSRMLIRDEIDENSTVYIDAGTKGSELVYRVEKNGGLVNAATGQKSDILIQIPNGPKSDAAQAVKKMRIEEIDDGEMEE

SEQ ID NO: 6403 - protein, 911 aa, Arabidopsis thaliana
MNPEKFTHKTNETIATAHELAVNAGHAQFTPLHLAGALISDPTGIFPQAISSAGGENAAQSAERVINQALKKLPSQSPPPDDIPASSSLIKVIRRAQAAQKSRGDTHLAVDQLIMGLLEDSQIRDLLNEVGVATARVKSEVEKLRGKEGKKVESASGDTNFQALKTYGRDLVEQAGKLDPVIGRDEEIRRVVRILSRRTKNNPVLIGEPGVGKTAVVEGLAQRIVKGDVPNSLTDVRLISLDMGALVAGAKYRGEFEERLKSVLKEVEDAEGKVILFIDEIHLVLGAGKTEGSMDAANLFKPMLARGQLRCIGATTLEEYRKYVEKDAAFERRFQQVYVAEPSVPDTISILRGLKEKYEGHHGVRIQDRALINAAQLSARYITGRHLPDKAIDLVDEACANVRVQLDSQPEEIDNLERKRMQLEIELHALEREKDKASKARLIEVRKELDDLRDKLQPLTMKYRKEKERIDEIRRLKQKREELMFSLQEAERRYDLARAADLRYGAIQEVESAIAQLEGTSSEENVMLTENVGPEHIAEVVSRWTGIPVTRLGQNEKERLIGLADRLHKRVVGQNQAVNAVSEAILRSRAGLGRPQQPTGSFLFLGPTGVGKTELAKALAEQLFDDENLLVRIDMSEYMEQHSVSRLIGAPPGYVGHEEGGQLTEAVRRRPYCVILFDEVEKAHVAVFNTLLQVLDDGRLTDGQGRTVDFRNSVIIMTSNLGAEHLLAGLTGKVTMEVARDCVMREVRKHFRPELLNRLDEIVVFDPLSHDQLRKVARLQMKDVAVRLAERGVALAVTDAALDYILAESYDPVYGARPIRRWMEKKVVTELSKMVVREEIDENSTVYIDAGAGDLVYRVESGGLVDASTGKKSDVLIHIANGPKRSDAAQAVKKMRIEEIEDDDNEEMIED

SEQ ID NO: 6404 - protein, 914 aa, Populus trichocarpa
MDPGKFTHKTNEALATAHELAVGAGHAQITPLHLAVALISDPSGILRQAVANAGDGENTAQAAERVFNQVLKKLPSQSPPPDEVPPSTSLIKVIRRSQALQKSRGDSYLAVDQMILGLLEDSQIRDLLKEVGVSASTVKSEVEKLRGKEGKKVENASGDTNFQALKTYGRDLVEGAGKLDPVIGRDEEIRRVVRILSRRTKNNPVLIGEPGVGKTAVAEGLAQRIVRGDVPSNLADVRLIALDMGALVAGAKYRGEFEERLKAVLKEVEEAEGKVILFIDEIHLVLGAGRTEGSMDAANLFKPMLARGQLRCIGATTLEEYRKYVEKDAAFERRFQQVYVAEPSVPDTISILRGLKEKYEGHHGVRIQDRALVVAAQLSSRYITGRHLPDKAIDLVDEACANVRVQLDSQPEEIDSLERKRMQLEVELHALEKEKDKASKARLAEVVKELDDLRDKLQPLLMKYKKEKERIDEIRRLKQKREEIHFSIQEAERRYDLARVADLRYGALEEVEAAIARLEGSTTDENLMLTETVGPEHIAEVVSRWTGIPVTRLGQNEKERLIGLADRLHHRVVGQDQAVNAVAEAVLRSRAGLGRPQQPTGSFLFLGPTGVGKTELAKTLAEQLFDNENQLVRIDMSEYMEQHSVSRLIGAPPGYVGHEEGGQLTEAVRRRPYSVVLFDEVEKAHISVFNTLLQVLDDGRLTDGQGRTVDFRNTVIIMTSNLGAEHLLSGLLGKCSMQVARDRVMQEVRKQFRPELLNRLDEIVVFDPLSHDQLRKVARLQMKDVASRLAERGIALAVTDAALDYILAESYDPVYGARPIRRWLERKVVTELSRMLVREEIDENSTVYIDAGPDGQDLVYRVEKNGGLVNATTGQKTDVLIQIPKAPRDDAAQKVKKMKIQEIVDNDDDDEMIE

SEQ ID NO: 6405 - protein, 911 aa, Arabidopsis lyrata
MNPEKFTHKTNETIATAHELAVNAGHAQFTPLHLAGALISDPTGIFPQAISSAGGENAAQSAERVINQALKKLPSQSPPPDDIPASSSLIKVIRRAQAAQKSRGDSHLAVDQLIMGLLEDSQIRDLLNEVGVATARVKSEVEKLRGKEGKKVESASGDTNFQALKTYGRDLVEQAGKLDPVIGRDEEIRRVVRILSRRTKNNPVLIGEPGVGKTAVVEGLAQRIVKGDVPNSLTDVRLISLDMGALVAGAKYRGEFEERLKAVLKEVEEAEGKVILFIDEIHLVLGAGKTEGSMDAANLFKPMLARGQLRCIGATTLEEYRKYVEKDAAFERRFQQVYVAEPSVPDTISILRGLKEKYEGHHGVRIQDRALINAAQLSARYITGRHLPDKAIDLVDEACANVRVQLDSQPEEIDNLERKRMQLEIELHALEREKDKASKARLIEVRKELDDLRDKLQPLTMKYRKEKERIDEIRRLKQKREELMFSLQEAERRYDLARAADLRYGAIQEVESAIAQLEGTSSEENVMLTENVGPEHIAEVVSRWTGIPVTRLGQNEKERLIGLADRLHKRVVGQNQAVNAVSEAILRSRAGLGRPQQPTGSFLFLGPTGVGKTELAKALAEQLFDDENLLVRIDMSEYMEQHSVSRLIGAPPGYVGHEEGGQLTEAVRRRPYCVILFDEVEKAHVAVFNTLLQVLDDGRLTDGQGRTVDFRNSVIIMTSNLGAEHLLSGLTGKVTMEVARECVMREVRKHFRPELLNRLDEIVVFDPLSHDQLRKVARLQMKDVAVRLAERGVALAVTDAALDYILAESYDPVYGARPIRRWMEKKVVTELSKMVVREEIDENSTVYIDAGAGGSDLVYRVESGGLVDASTGKKSDVLIHIANGPKRSDAAQAVKKMRIEEIDDDEEMVED

SEQ ID NO: 6406 - protein, 914 aa, Populus trichocarpa
MDPGKFTHKTNEALATAHELAVGAGHAQITPLHLAVALISDPSGILRQAVANAGDGENTAQAAERVFNQVLKKLPSQSPPPEEVPPSTSLIKVIRRSQALQKSRGDSYLAVDQMILGLLEDSQIRDLLKEVGVSASTVKSEVEKLRGKEGKKVENASGDTNFQALKTYGRDLVEGAGKLDPVIGRDEEIRRVVRILSRRTKNNPVLIGEPGVGKTAVAEGLAQRIVRGDVPSNLADVRLIALDMGALVAGAKYRGEFEERLKAVLKEVEEAEGKVILFIDEIHLVLGAGRTEGSMDAANLFKPMLARGQLRCIGATTLEEYRKYVEKDAAFERRFQQVYVAEPSVPDTISILRGLKEKYEGHHGVRIQDRALVVAAQLSSRYITGRHLPDKAIDLVDEACANVRVQLDSQPEEIDSLERKRMQLEVELHALEKEKDKASKARLAEVVKELDDLRDKLQPLLMKYKKEKERIDEIRRLKQKREEIHFSIQEAERRYDLARVADLRYGALEEVEAAIARLEGSTTDENLMLTETVGPEHIAEVVSRWTGIPVTRLGQNEKERLIGLADRLHHRVVGQDQAVNAVAEAVLRSRAGLGRPQQPTGSFLFLGPTGVGKTELAKTLAEQLFDNENQLVRIDMSEYMEQHSVSRLIGAPPGYVGHEEGGQLTEAVRRRPYSVVLFDEVEKAHISVFNTLLQVLDDGRLTDGQGRTVDFRNTVIIMTSNLGAEHLLSGLLGKCSMQVARDRVMQEVRKQFRPELLNRLDEIVVFDPLSHDQLRKVARLQMKDVASRLAERGIALAVTDAALDYILAESYDPVYGARPIRRWLERKVVTELSRMLVREEIDENSTVYIDAGPDGQDLVYRVEKNGGLVNATTGQKTDVLIQIPKAPRDDAAQKVKKMKIQEIVDNDDDDEMIE

SEQ ID NO: 6407 - protein, 910 aa, Manihot esculenta
MDPGKFTHKTNEALASAHELAISAGHAQITPLHLAVALISDPGAIFSQAISNAGGESASQAAQRVFNNAMKKLPSQSPPPDEVPPSTSLIKVIRRAQASQKAQGDSHLAVDQLILGLLEDSQIGDLLKESGIAAAKVKSEVQKLRGKEGRKVESASGDSTFQALKTYGRDLVEQAGKLDPVIGRDEEIRRVVRILSRRTKNNPVLIGEPGVGKTAVVEGLAQRIVRGDVPNNLADVRLIALDMGALVAGAKYRGEFEERLKAVLKEVEEAEGKVILFIDEIHLVLGAGRTEGSMDAANLFKPMLARGQLRCIGATTLEEYRKYVEKDAAFERRFQQVYVAEPSVNDTINILRGLKEKYEGHHGVRILDRALVVAAQLSSRYITGRHLPDKAIDLVDEACANVRVQLDSQPEEIDNLERKKIQLEVELHALEKEKDKVSKARLAEVVKELDDLRDKLQPLMMKYKKEKERIDEIRRLKQKKEEIQFAIQEAERRYDLARVADLRYGALEEVDAGIARLEGSTDENLMLTETVKPEHIAEVVSRWTGIPVTRLGQNEKERLIGLAERLHQRVVGQDQAVDAVAEAVLRSRAGLGRPQQPTGSFLFLGPTGVGKTELAKALAEQLFDDENQLVRIDMSEYMEQHSVARLIGAPPGYVGHEEGGQLTEAVRRRPYSVVLFDEVEKAHLSVFNTLLQVLDDGRLTDGQGRTVDFRNTVIIMTSNLGAEHLLSGLMGKCSMQVARDRVMQEVRRHFRPELLNRLDEIVVFDPLSHDQLIKVARLQMKDVAVRLAERGIALAVTDAALDYILAESYDPVYGARPIRRWLEKKVVTELSRMLVREEIDENSTVYIDAGSKGNDLVYTVEKNGGLVNAATGQKAEVLIQIPSVPRNDAAQAVKKMKIEEIIDDDEEMME

SEQ ID NO: 6408 - protein, 912 aa, Ricinus communis
MDPGKFTHKTNEALASAHELAISAGHAQLTPLHLAVALITDPNAIFSQAISNAGGESASQAAQRVLNNAIKKLPSQSPPPDEIPPSTSLIKVIRRAQALQKSRGDSHLAVDQLILGLLEDSQIGDLLKESGIAAGKVKSEVEKLRGKEGKKVESATADTNFQALKTYGRDLVEQAGKLDPVIGRDEEIRRVVRILSRRTKNNPVLIGEPGVGKTAVVEGLAQRIVRGDVPNNLNDVRLIALDMGALVAGAKYRGEFEERLKAVLKEVEEADGKVILFIDEIHLVLGAGRTEGSMDAANLFKPMLARGQLRCIGATTLEEYRKYVEKDAAFERRFQQVYVSEPSVVDTINILRGLKEKYEGHHGVRILDRALVVAAQLSSRYITGRHLPDKAIDLVDEACANVRVQLDSQPEEIDNLERKKIQLEVEHHALEKEKDKASKARLSEVVKELDDLRDKLQPLIMKYKKEKERIDEIRRLKQKREEIQFAIQEAERRYDLARVADLKYGALEEVDAAIARLEGSSTDENLMLTETVKPEHIAEVVSRWTGIPVTRLGQNEKERLIGLAERLHQRVVGQDQAVSAVAEAVLRSRAGLGRPQQPTGSFLFLGPTGVGKTELAKALAEQLFDDENQMVRIDMSEYMEQHSVSRLIGAPPGYVGHEEGGQLTEAVRRRPYSVVLFDEVEKAHLSVFNTLLQVLDDGRLTDGQGRTVDFRNTVIIMTSNLGAEHLLSGLTGKTSIEAARDRVMLEVRKHFRPELLNRLDEIVVFDPLSHDQLKKVARLQMKDVALRLAEMGIALAVTDAALDYILAESYNPVYGARPIRRWLEKKVVTQLSRMLLREEIDENTTVYIDAASNQDDLDYRVEKNGGLVNAATGRKAEVLIQIPSVPKSDAAQAVKKMRIEEIVDNDEDEMHE

SEQ ID NO: 6409 - protein, 911 aa, Pinus taeda
MNPEKFTHKTNEALAAGLEIATESGHAQYTPVHLAIALTEDKGGILRQAISSATGGEETVEAVQRVLRQALKKLPSQDPAPDSIPPNTSLIKSIRRAQSSQKSKGDSHLAVDHLILGVLEDSQVSDCFREAGVSIARVKSEVEKLRGEGKKVDTASGDTNFQALKTYGRDLVEDAGKLDPVIGRDEEIRRVVRILSRRTKNNPVLIGEPGVGKTAVVEGLAQRIVRGDVPSNLLEVRVIALDMGALVAGAKYRGEFEERLKAVLKEVEEAHGKVILFIDEIHLVLGAGRTEGSMDAANLFKPMLARGQLRCIGATTLEEYRKYVEKDAAFERRFQQVYVAEPSVADTISILRGLKEKYEGHHGVRILDRALVVAAQLSSRYITGRHLPDKAIDLVDEACANVRVQLDSQPEEIDTLERKRIQLEVELHALEKEKDKASKARLAEVHKELDDLRDKLQPLKMKYQKEKERVDEIRRLKQKREELQITLEEAKRRMDLARVADLQYGALQEIETAISRQEAGMGENLMLTESVGPDQIAEVVSRWTGIPVTRLGQNEKERLIGLADRLHERVVGQDEAVQAVAEAVLRSRAGLGRPQQPTGSFLFLGPTGVGKTELAKALAAQLFDDENQLVRIDMSEYMEQHSVARLIGAPPGYVGYEEGGQLTEAVRRRPYSVVLFDEVEKAHTSVFNTLLQMLDDGRLTDGQGRTVSFSNTVIIMTSNLGAEHLLAALSGRTTIKAARENVMQEVRRHFRPELLNRLDEIVVFDPLSHDELKKVARLQMKDVAIRLAERGVALGVTDAALDLVLQEAYDPVYGARPLRRWLERKVVTQLSRMLISGEIDENSTVYIDAVPEQQTLSYRVDRNGGIVNQNTGAKSDILIEIPNSAYFNADASQAVKKMRIEEIDDDEPMED

SEQ ID NO: 6410 - protein, 909 aa, Nicotiana tabacum
MNPEKFTHKTNEALAGALELALSAGHAQFTPLHMAVALISDHNGIFRQAIVNAGGNEEVANSVERVLNQAMKKLPSQTPAPDEIPPSTSLIKVLRRAQSSQKSRGDSHLAVDQLILGLLEDSQIGDLLKEAGVSASRVKSEVEKLRGKEGRKVESASGDTTFQALNTYGRDLVEQAGKLDPVIGRDEEIRRVVRILSRRTKNNPVLIGEPGVGKTAVVEGLAQRIVRGDVPSNLADVRLIALDMGALVAGAKYRGEFEERLKAVLKEVEEAEGKVILFIDEIHLVLGAGRTEGSMDAANLFKPMLARGQLRCIGATTLEEYRKYVEKDAAFERRFQQVYVAEPSVADTISILRGLKERYEGHHGVKIQDRALVVAAQLSSRYITGRHLPDKAIDLVDEACANVRVQLDSQPEEIDNLERKRIQLEVELHALEKEKDKASKARLIEVRKELDDLRDKLQPLMMRYKKEKERIDELRRLKQKRDELIYALQEAERRYDLARAADLRYGAIQEVETAIANLESTSAESTMLTETVGPDQIAEVVSRWTGIPVSRLGQNEKEKLIGLGDRLHQRVVGQDHAVRAVAEAVLRSRAGLGRPQQPTGSFLFLGPTGVGKTELAKALAEQLFDDDKLMIRIDMSEYMEQHSVSRLIGAPPGYVGHDEGGQLTEAVRRRPYSVVLFDEVEKAHPAVFNTLLQVLDDGRLTDGQGRTVDFTNSVIIMTSNLGAEYLLSGLMGKCTMETAREMVMQEVRKQFKPELLNRLDEIVVFDPLSHKQLRQVCRYQMKDVALRLAERGIALGVTEAALDVILTESYDPVYGARPIRRWLERKVVTELSKMLVKEEIDENSTVYIDAGVSGKDLTYRVEKNGGLVNAATGQKSDILIQLPNGPRSDAVQAVKKMRIEEIEDDEMED

SEQ ID NO: 6411 - protein, 912 aa, Mimulus guttatus
MNPDKFTHKTNEVLAAAHGLALNAGHAQFTPLHFAAALISEPHGIFRQAISGAGGSEESANAAERVINQAIKKLPTQNPPPDDIPASTSTIKIIRRAQSLQKSRGDTHLAVDQLILGLLEDSQIQDLLKEAGVTTTKVKSEVEKLRGKEGKKVESASGDSNFQALKTYGRDLVEQAGKLDPVIGRDEEIRRVVRILSRRTKNNPVLIGEPGVGKTAVVEGLAQRIVNGDVPSNLFDVRLIALDMGALIAGAKYRGEFEERLKSVLKEVEEAEGKVILFIDEIHLVLGAGRTEGSMDAANLFKPMLARGQLRCIGATTLEEYRKYVEKDAAFERRFQQVYVAEPSVPDTISILRGLKEKYEGHHGVKIQDRALIVASQLSARYITGRHLPDKAIDLVDEACANVRVQLDSQPEEIDNLERKRIHLEIELHALEKEKDKASKARLVEVKKELDDLRDKLQPLSMRYKKEKERIDELRRLKQKRDELLHALKEAERRYDLARAADLRYGAIQDVEASIATLESGATEDSMLTETVGPDQIAEVVSRWTGIPVTRLGQNDKERLIGLGDRLHKRVVGQDQAVTAVAEAVLRSRAGLGRPQQPTGSFLFLGPTGVGKTELAKALAEQLFDDDNLMIRIDMSEYMEQHSVARLIGAPPGYVGHEEGGQLTEGVRRRPYSVILFDEVEKAHPTVFNTLLQVLDDGRLTDGQGRTVDFTNTVIIMTSNLGAEYLLRGLMGKSTMESAREMVMQEVRKHFKPELLNRLDEIVVFDPLSHDQLRKVCRLQLKDVASRLAERGIALGVTETALDVILAESYDPVYGARPIRRWLEKKVVTELSKMLVREEIDENSTVYIDALLDGKELTYRVEKNGGLVNSATGEKSDVLIQLPNGRRSTDAAQAVKRMKIQEIDDDDLEMLE

SEQ ID NO: 6412 - protein, 911 aa, Solanum lycopersicum
MNPEKFTHKTNEAIAEAHELAVSAGHAQLTPLHMALALLSDHSGIFWQAIVNAAGSEETANGVERVFNQAKKKIPSQSPAPDQVPASTSLIKVLRRAQSLQKSRGDSHLAVDLLILGLLEDSQIADLLKDSGLSAARVKSEVEKLRGKDGKKVESATGDTTFQALKTYGRDLVEQAGKLDPVIGRDEEIRRVIRILSRRTKNNPVLIGEPGVGKTAVVEGLAQRIVRGDVPSNLADVRLIALDMGALIAGAKYRGEFEERLKAVLKEVEDAEGKVILFIDEIHLVLGAGRTEGSMDAANLFKPMLARGQLRCIGATTLEEYRKYVEKDAAFERRFQQVYVAEPSVPDTISILRGLKEKYEGHHGVKIQDRALVIAAQLSARYITGRHLPDKAIDLVDEACANVRVQLDSQPEEIDNLERKRIQLEVEHHALEKEKDKASKARLVEVRKELDDLRDKLQPLMMRYKKEKERVDELRRLKQKRDELTYALQEAERRYDLARAADLRYGAIQEVESAIANLESSTDESTMLTETVGPDQIAEVVSRWTGIPVSRLGQNEKEKLIGLADRLHLRVVGQDQAVKAVAEAVLRSRAGLGRPQQPTGSFLFLGPTGVGKTELAKALAEQLFDDDKLMVRIDMSEYMEQHSVARLIGAPPGYVGHEEGGQLTEAVRRRPYSVVLFDEVEKAHPAVFNALLQVLDDGRLTDGQGRTVDFTNTVIIMTSNLGAEYLLSGLSGKCTMEKAREMVMQEVRKQFKPELLNRLDEIVVFDPLSHEQLRQVCRHQLKDVASRLAERGIALGVTEAALDVILAQSYDPVYGARPIRRWLEKKVVTELSKMLVKEEIDENSTVYIDAGRGGKDLTYRVENNGGLVNAATGQKSDVLIQLPNGPRNDAAQAVKKMRIEEIDDEDDEMAD

SEQ ID NO: 6413 - protein, 912 aa, Solanum phureja
MNPEKFTHKTNEAIAEAHELAVSAGHAQLTPLHMALALLSDHSGIFWQAIVNAAGSEETANGVERVFNQAKKKIPSQSPAPDQVPASTSLIKVLRRAQSLQKSRGDSHLAVDLLILGLLEDSQIVDLLKDSGLSAARVKSEVEKLRGKDGKKVESATGDTTFQALKTYGRDLVEQAGKLDPVIGRDEEIRRVIRILSRRTKNNPVLIGEPGVGKTAVVEGLAQRIVRGDVPSNLADVRLIALDMGALVAGAKYRGEFEERLKAVLKEVEDADGKVILFIDEIHLVLGAGRTEGSMDAANLFKPMLARGQLRCIGATTLEEYRKYVEKDAAFERRFQQVYVAEPSVPDTISILRGLKEKYEGHHGVKIQDRALVIAAQLSARYITGRHLPDKAIDLVDEACANVRVQLDSQPEEIDNLERKRIQLEVEHHALEKEKDKASKARLVEVRKELDDLRDKLQPLMMRYKKEKERIDELRRLKQKRDELTYALQEAERRYDLARAADLRYGAIQEVEAAIANLESSTDESTMLTETVGPDQIAEVVSRWTGIPVSRLGQNEKEKLIGLADRLHQRVVGQDQAVKAVSEAVLRSRAGLGRPQQPTGSFLFLGPTGVGKTELAKALAEQLFDDDKLMVRIDMSEYMEQHSVARLIGAPPGYVGHEEGGQLTEAVRRRPYSVVLFDEVEKAHPTVFNALLQVLDDGRLTDGQGRTVDFTNTVIIMTSNLGAEYLLSGLSGKCTMEKAREMVMQEVRKQFKPELLNRLDEIVVFDPLSHDQLRQVCRHQLKDVAGRLAEMGIALGVTEAALDVILAQSYDPVYGARPIRRWLEKKVVTELSKMLVKEEIDENSTVYVDAGRGGKDLTYRVENNGGLVNAATGKKSDVLIQLPNGQRNDAAQAVKKMRIEEIDDEDDEMAAD

SEQ ID NO: 6414 - protein, 52 aa, Eschscholzia californica
MSGRGKGGKGLGKGGAKRHRKVLRDNIQGINKTSNPKVSKKRRCEEDQWSDL

SEQ ID NO: 6415 - protein, 409 aa, Mimulus guttatus
MAALNLSSSLHSPSSLRRFPNFHPSRSTPTISFYSLPKPSIPFPSTSLVQKTALISRRLNVVVSAVKNLSETELVPVSSENEFPSDSGVYAIYNDSDDLQFIGITRNLAASVLTHKKSVPELCFSVKVGVVEEPDKTALTEAWKSWMQEHIAASGKVPPGNEPGNTTWVKKAAPRKKPDLRLTPGSHVQLTVPLEDLIDRLVKENKVVAFIKGSRSAPLCGFSQRVVGILESQGVEYESVDVLDEEYNYGLRETLKKYSNWPTFPQVFVNGDLLGGCDILTSMHENGELAGLFKHSHIKKEKGVIKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6416 - protein, 54 aa, Amborella trichopoda
FRAFLFQFLCLKYQGDPKMSGRGKGGKGLGKGGAKRHRKVLRDNIQGNHKTGHS

SEQ ID NO: 6417 - protein, 133 aa, Brassica juncea
VRGDRTLLHTCEKTTSFFSLILKPFPEKKKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6418 - protein, 122 aa, Brassica juncea
DQKRIYSYIFFFKYFEEMSGRGKGGKGLGKGGAKRHRKVLRDNIQGITKPAIRRLARRGGVKRISGLIYEETRGVLKIFLENVIRDAVTYTEHARRKTVTAMDVVYALKRQRTALSTVSAAN

SEQ ID NO: 6419 - protein, 142 aa, Brassica oleracea
MSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGGWGFKIVFVKSNLRCDSILVISASLYAFVSSKYMKFTFDY

SEQ ID NO: 6420 - protein, 132 aa, Brassica rapa
THRTLLHTCEKTTSFFFSLILKTFPRKRKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6421 - protein, 99 aa, Hordeum vulgare
MARTKQTARKSTGGKAPRKQLATKAARKSAPATGGVKKPHRFRPGTVALREIRKYQKSTELLIRKLPFQRLVREIAQDFKTDLRFQSSAVSALQEADEA

SEQ ID NO: 6422 - protein, 139 aa, Brassica napus
STQSTRGHIALSSTRVKKQLPFFFSDFKNFFTRKIKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6423 - protein, 132 aa, Brassica napus
AIKSYLISSLAVSYQSTGYLESLQKLCEEMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6424 - protein, 137 aa, Brassica napus
VSPLFYIKTSLPPNLSTYYFLPSKVFNIEFSREKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6425 - protein, 64 aa, Manihot esculenta
  misc_feature (2)..(2): Xaa can be any naturally occurring amino acid
EXFFYLRLKSEETREREEIKDVWQRKGREGFGKREELRGTEKCSGIISRASPSLLFDGWPGVAV

SEQ ID NO: 6426 - protein, 133 aa, Gossypium hirsutum
TLVDPKRFGTSSHFTLKKSNFPENKKLSSKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6427 - protein, 138 aa, Vigna unguiculata
IHSKTEAQTNPKFSNSFAIFLCSLVLALIQSSNSKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6428 - protein, 143 aa, Zingiber officinale
NKPIHFFSNLSIIDYSSCRIRHEGAIQILPSEIRRRRGEAMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6429 - protein, 133 aa, Ipomoea nil
SRPSKSKSTCPIYLSLHQFKTLDFFFLSAKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6430 - protein, 134 aa, Ipomoea nil
  misc_feature (18)..(18): Xaa can be any naturally occurring amino acid
YGRGLSNQNLLVHFTSVXEFKTLDFFLHSAKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6431 - protein, 214 aa, Actinidia deliciosa
MASSSMPSTLGSSSSSIPLLRHTLTHTHTSPPRSPISFNRTSRISPKIIPSLHHHRPHPCPSIRAQTLDFSGTFFEGGFEGEEVPLTPLGSAITPVEDKEEPPCPPGLRKYETMAVLRPDLSEDERLNVTQKYEELLVAGGGMYVEVFNRGVIPLAYSIKKKNREGETNTYLDGIYLLFTYFTKPESMEVLEETLKTDDNVIRSSTFKIRKRKY

SEQ ID NO: 6432 - protein, 129 aa, Medicago truncatula
DSDSKPNPNFPNFSNLLRFSNFHLLKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6433 - protein, 133 aa, Medicago truncatula
YGRGTLKSNYNFKTLDPQIFYFVFSNFLLKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6434 - protein, 129 aa, Cucumis melo
  misc_feature (3)..(3): Xaa can be any naturally occurring amino acid
SKXKSKLTTDIVPHRCSSLTPQSPATMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6435 - protein, 177 aa, Elaeis guineensis
MVPSLRIAMIRTINGGKSNFQMRASSMKPSTIRIVIETLVPIRHEAKSLISYPRRQRSNFFLHLFPLHSTSIDAMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6436 - protein, 130 aa, Carica papaya
SESSHSIRSQLHFDLKTLRENHRVTEKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6437 - protein, 133 aa, Pinus taeda
AGDYCREQQSDWQLRFDLEVFWLWRFEGGKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6438 - protein, 129 aa, Raphanus sativus
FTSPVISSIAFRYPLRSIFQELRNQEMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6439 - protein, 130 aa, Secale cereale
GSHHQTGSARTHTSQAKRSSPEREAPEMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6440 - protein, 123 aa, Glycine max
NSNQNPKSSNSICTKFSSTKCLVVGKVARGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6441 - protein, 135 aa, Picea glauca
PPPPETHYSSRAAHQSATEIRTPDLPRFSTVKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6442 - protein, 156 aa, Helianthus annuus
  misc_feature (121)..(121): Xaa can be any naturally occurring amino acid
  misc_feature (129)..(129): Xaa can be any naturally occurring amino acid
  misc_feature (131)..(131): Xaa can be any naturally occurring amino acid
  misc_feature (133)..(136): Xaa can be any naturally occurring amino acid
  misc_feature (138)..(138): Xaa can be any naturally occurring amino acid
  misc_feature (140)..(140): Xaa can be any naturally occurring amino acid
  misc_feature (142)..(144): Xaa can be any naturally occurring amino acid
TRGNHFYTSIPSNQKRNMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGGXFVSLFCFXLXCXXXXMXLXLXXXYRNRDFYYIFNP

SEQ ID NO: 6443 - protein, 131 aa, Helianthus annuus
VRRPGTYSGITQIFQIKSQSQFHFISTTMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6444 - protein, 131 aa, Nicotiana tabacum
  misc_feature (91)..(91): Xaa can be any naturally occurring amino acid
RGPSIQSQNLLKKGLKMSGRGKGGKGLGKGGAKRHRKVLRDNIQGITKPAIRRLARRGGVKRISGLIYEETRGVLKIFLENVIRDACDLHXSTLGERLLLLWMLFMRLRDRVGLFMDLVVKFLDLGFGYFV

SEQ ID NO: 6445 - protein, 133 aa, Nicotiana tabacum
AITAGDQNPNQEYFFPYQVQISKPPKSLLEMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6446 - protein, 132 aa, Triphysaria pusilla
NNQQKYLITRTRVFSHFQLQLPKKLGLSEMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6447 - protein, 173 aa, Triticum aestivum
  misc_feature (5)..(5): Xaa can be any naturally occurring amino acid
AHSSXEVASQNHHQTRLHDTHHDGLPPGRVAEGPSLCPGRLPHLQFWHHNLPCSHLAATISISVSSKPSTMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6448 - protein, 119 aa, Triticum aestivum
MSGRGKGGKGLGKGGAKRHRKVLRDNIQGITKPAIRRLARRGGVKRISGLIYEETRGVLKIFLENVIRDAVTYTEARPPQDRHRHGRRLRAQAPGPHPLRLRRLGPVESTSRRQIPTSI

SEQ ID NO: 6449 - protein, 130 aa, Triticum aestivum
TSSRQHHRSSSTSIQITHQLKGRKPSAMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6450 - protein, 129 aa, Triticum aestivum
SSLPATKPRSKIPKSPLFLKLLGAAAMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6451 - protein, 135 aa, Triticum aestivum
TPHGRNSHHQTSSAHTHTSQAKGRSPEREAPEMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6452 - protein, 134 aa, Triticum aestivum
ERERERERERERESHHRSSSISISVSSKPSAMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6453 - protein, 134 aa, Triticum aestivum
HRCLEQRDQHRSSHLPKTSQPHRGEAERREKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6454 - protein, 130 aa, Triticum aestivum
SATAATTYLTKKDRSTSPRRRRERSEKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6455 - protein, 129 aa, Triticum aestivum
TSNPQSPIPNPLQSHLRDSSQQASPAMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6456 - protein, 130 aa, Triticum aestivum
RHTAATTTTSNTHTAAQPISPEKEESTMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6457 - protein, 130 aa, Triticum aestivum
TTPNHQPPPLLQPHIRLPAARRGSSATMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6458 - protein, 131 aa, Triticum aestivum
TTPLQQPPPATHTHTAAKRSSPEREESTMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6459 - protein, 132 aa, Triticum aestivum
IAVWNSGTTTSSKNTHTQKPISPEREASRMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6460 - protein, 142 aa, Triticum aestivum
RPRLLRPAQAQAQPPNHQPPPLLQSHIRSSAARSGSSATMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6461 - protein, 134 aa, Triticum aestivum
  misc_feature (1)..(2): Xaa can be any naturally occurring amino acid
XXREREREREREPLLNLLRPLAARTKERPSAMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6462 - protein, 182 aa, Triticum aestivum
MLPAAMAAGFERPPGQVCPRPSGLGRNLRSKTRWFAGFCNSHQVSHFATFFIDARAESHHSQHSSIPPERQAEAAAAAEMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6463 - protein, 136 aa, Triticum aestivum
SSLSGTDHHPPPPPLPTQGNPTQRQKEAAAAAKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6464 - protein, 132 aa, Triticum aestivum
DPRVRITASTTTSNTHRAAKRSSPEREAKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6465 - protein, 146 aa, Triticum aestivum
SACSMYPQSLPQNIVKALVPNSARGALPLLSKRTHPSELGGSAMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6466 - protein, 131 aa, Triticum aestivum
ILHLHLHHSQHKPIPPERQQRSESAAAKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6467 - protein, 130 aa, Triticum aestivum
TRPQRPPPATHTHTAAKRSSPEREASRMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6468 - protein, 150 aa, Triticum aestivum
NELSTCTQNNLSVIHARKAIIHFPRAEFATTVPPIPHLLAARRGSSAMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6469 - protein, 132 aa, Triticum aestivum
EPTSSRRHHRSSSISIQITHPLQGRKPSAMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6470 - protein, 132 aa, Triticum aestivum
ERERERERERERERGSSSVSISVSSKPSTMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6471 - protein, 132 aa, Triticum aestivum
RAPPPPSEKSPIPSSSSSRDAHSRAESEKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6472 - protein, 61 aa, Artemisia annua
MSSVTLSPTPSTLAVKLSLLWMLFMLSRDKAGLCMVSGVRWISIMSSLRCSLYGFTDLFCN

SEQ ID NO: 6473 - protein, 61 aa, Artemisia annua
MSSVTLSPTLSTLVVKLSLLWMLFMLSRDKAGLCMVSAVRKGISIMSSRCSLYGFMVVLCD

SEQ ID NO: 6474 - protein, 124 aa, Artemisia annua
MSGRGKGGKGLGKGGAKRHRKVLRDNIQGITKPAIRRLARRGGVKRISGLIYEETRGVLKIFLENVIRDAVTYTEHARRKTVTAMDVVYALKARQDFVWLRGLESQLVLCCRNALCMVFYGCIV

SEQ ID NO: 6475 - protein, 65 aa, Lactuca sativa
MSGRGKGGKGLGKGGAKRHRKVLRDNIQGITKPAIRRLARRGGVKRISGLIYEETRGVLKIFWKM

SEQ ID NO: 6476 - protein, 279 aa, Tropaeolum majus
YDNMKAFIRYMISSNIGEVASIFLTAALGIPEGMIPVQLLWVNLVTDGPPATALGFNPPDNDIMKKPPRRSDDSLITAWILFRYLVIGLYVGIATVGIFVIWYTHDTFMGIDLSEDGHTLVTYSQLAHWGQCTSWKGFTVSPFKAGTQVFKFDSNPCDYFQSGKIKASTLSLSVLVSIEMFNSLNALSEDGSLVTMPPWVNPWLLLAMSISFGLHGLILYVPFLAHIFGIVPLSLNEWLLVLAVSLPVILIDEVLKFIGRCRRTARYADSKKRSKHKAE

SEQ ID NO: 6477 - protein, 53 aa, Antirrhinum majus
NTSLTTCRVKMSGRGKGGKGLGKGGAKRHRKVLRDNIQGIQSRLFAVWLVVVE

SEQ ID NO: 6478 - protein, 196 aa, Malus domestica
MMLGEPHRPNPTVHVPPWLQLDDPTAEMYSPYPLSGVSVNSDGNASGADFNSPYYLDDALTTLQRFLPSNETDLDSDSDISGRESDAPVDAYSCDHFRMFDFKVRRCARGRSHDWTECPYAHPGEKARRRDPRKYHYSGTACPDFRKGHCKKGDTCEFAHGVFECWLHPARYRTQPCKDGTSCKRRVCFFAHTPEQ

SEQ ID NO: 6479 - protein, 131 aa, Brassica rapa
  misc_feature (39)..(39): Xaa can be any naturally occurring amino acid
HIALSSTRVKKQLPFFFSDFKNFPEKKKMSGRGKGGKGXGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6480 - protein, 142 aa, Hordeum vulgare
MSGRGKGGKGLGKGGAKRHRKVLRDNIQGITKPAIRRLARRGGVKRISGLIYEETRGVLKIFLENVIRDAVTYTEHARRKTVTAMDVVYTTQAPGTHPLRIRRLGRQPDLDSSRVDLVVDVTGTISLLLAVFCGIEWTAMEI

SEQ ID NO: 6481 - protein, 79 aa, Lactuca sativa
SSPSIVSERKSKKPEKRMSGRGKGGRDWERAEQNVTGKFSETTSKESRSRQFADWRGEVELSVSVASSMKKHVVCLRSF

SEQ ID NO: 6482 - protein, 140 aa, Nicotiana benthamiana
NRLRMSGRGKGGKGLGKGGAKRHRKVLRDNIQGITKPAIRRLARRGGVKRISGLIYEETRGVLKIFLENVIPDAVTYTEHARRKTVTAMDVVYALKRQGRTLYGFGGSQNGSAFFARSASYLPFFEKPWGASLPPPATKL

SEQ ID NO: 6483 - protein, 128 aa, Selaginella moellendorffii
ATESRVLRFGVPPSISSGNLLVAAAMSGRGKGGKGLGKGGAKRHRKHLRDNIQGITKPAIRRLARRGGVKRISGLIYEETRGVLKIFLENVIRDAVTYTEHARRKTVTAMDVVYALKRQGRTLYGFGG

SEQ ID NO: 6484 - protein, 138 aa, Picea glauca
VHTICSPQYHPFHASQSLSVYRFSWEIEKSEEFSKMSGRGKGGKGLGKGGAKRHRKVLRDNIQGITKPAIRRLARRGGVKRISGLIYEETRGVLKIFLENVIRDAVTYTEHARRKTVTAMDVVYSLKRQGRTLYGFGG

SEQ ID NO: 6485 - protein, 147 aa, Triticum aestivum
TRERERERERERERERERERDTSRLPTKQLLFFLPITLPRRGAAMSGRGKGGKGLGKGGTKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6486 - protein, 134 aa, Triticum aestivum
NQFGCIPPREKSPIPSSSSSRDAHSRAEREKMSGRVKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6487 - protein, 104 aa, Arabidopsis lyrata
MSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGGS

SEQ ID NO: 6488 - protein, 103 aa, Artemisia annua
MSGRGKGGKGLGKGGAKRHRKVLRDNIQGITKPAISRLARRGGVKRISGLIYEETRGVLKIFLENVIRDAVTYTEHARRKTVTAMDVVYALKRQGRTLYGFGG

SEQ ID NO: 6489 - protein, 102 aa, Unknown
  Sequence found in Organisms: Amborella trichopoda, Artemisia annua, Persea americana, Ocimum basilicum, Elaeis guineensis, Solanum tuberosum, Secale cereale
SGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6490 - protein, 103 aa, Artemisia annua
MSGRGKGGKGLVKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6491 - protein, 103 aa, Unknown
  Sequence found in Organisms: Brassica napus, Helianthus annuus
MSGRGKGGKGLGKGGAKRHRKVLRDNIQGITKPAIRRLARRGGVKRISGLIYEETRGVLKIFLENVIRDAVTYTEHAGRKTVTAMDVVYALKRQGRTLYGFGG

SEQ ID NO: 6492 - protein, 103 aa, Cicer arietinum
MSGRGKGGKGLGKGGAKRHRKVLRDNIQGITKPAIRRLARRGGVKRISGLIYEETRGVPKIFLENVIRDAVTYTEHARRKTVTAMDVVYALKRQGRTLYGFGG

SEQ ID NO: 6493 - protein, 103 aa, Unknown
  Sequence found in Organisms: Solanum lycopersicum, Solanum melongena, Tropaeolum majus, Orobanche aegyptiaca, Capsicum annuum, Solanum tuberosum, Solanum phureja
MSGRGKGGKGLGKGGAKRHRKVLRDNIQGITKPAIRRLARRGGVKRISGLIYEETRGVLKIFLENVIRDSVTYTEHARRKTVTAMDVVYALKRQGRTLYGFGG

SEQ ID NO: 6494 - protein, 103 aa, Jatropha curcas
MSGRGKGGKGLGKGGAKLHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6495 - protein, 103 aa, Lotus japonicus
MSGRGKGGKGLGKGGAKRHRKVLRDNIQGITKPAIRRLARRGGVKRISGLIYEETRGVLKIFLENVIRHAVTYTEHARRKTVTAMDVVYALKRQGRTLYGFGG

SEQ ID NO: 6496 - protein, 103 aa, Lotus japonicus
MSGRGKGGKGLGKGGAKRHRKVLRDNIQGITKPAIRRLARRGGVKRISGSIYEETRGVLKIFLENVIRDAVTYTEHARRKTVTAMDVVYALKRQGRTLYGFGG

SEQ ID NO: 6497 - protein, 103 aa, Medicago truncatula
MSGRGKGGKGLGKGGAKRHRKVLRDNIQGITKPAIRRLARRGGVKRISGLIYEETRGVLKIFLENVIRDAVTYTEHARRKTVTAMVVVYALKRQGRTLYGFGG

SEQ ID NO: 6498 - protein, 103 aa, Medicago truncatula
MSGRGKGGKGLGKGGAKRHRKVLRDNIQGITKPAIRRLARRGGVKRISGLIYEETRGVLKISLENVIRDAVTYTEHARRKTVTAMDVVYALKRQGRTLYGFGG

SEQ ID NO: 6499 - protein, 102 aa, Mimulus guttatus
MSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFG

SEQ ID NO: 6500 - protein, 103 aa, Pisum sativum
MSGRGKGGKGLGKGGAKRHRKVLRDNIQGITKPAIRRLARRGGVKRISGPIYEETRGVLKIFLENVIRDAVTYTEHARRKTVTAMDVVYALKRQGRTLYGFGG

SEQ ID NO: 6501 - protein, 103 aa, Physcomitrella patens
MSGRGKGGKGLGKGGAKRHRKVLRDNIQGITKPAIRRLARRGGVKRISGLIYEETRGVLKIFLEIVIRDAVTYTEHARRKTVTAMDVVYALKRQGRTLYGFGG

SEQ ID NO: 6502 - protein, 103 aa, Physcomitrella patens
MSGRGKGGKGLGKGGAKRHRKVLRDNIQGITKPAIRRLARRGGVKRISGLIYEETRSVLKIFLENVIRDAVTYTEHARRKTVTAMDVVYALKRQGRTLYGFGG

SEQ ID NO: 6503 - protein, 103 aa, Cajanus cajan
MSGRGKGGKGLGKGGAKRHRKVLRDNIQGITKPAIRRLARRGGVKRISGLIYEETRGVLKIFLENVIRDAVTYTEHARRKPVTAMDVVYALKRQGRTLYGFGG

SEQ ID NO: 6504 - protein, 103 aa, Unknown
  Sequence found in Organisms: Petunia hybrida, Pinus taeda, Picea glauca, Nicotiana tabacum
MSGRGKGGKGLGKGGAKRHRKVLRDNIQGITKPAIRRLARRGGVKRISGLIYEETRGVLKIFLENVIRDAVTYTEHARRKTVTAMDVVYSLKRQGRTLYGFGG

SEQ ID NO: 6505 - protein, 103 aa, Rhizophora mangle
MSGRGKGGKGLGKGGAKRHRKVLRDNIQGITKPAIRRLARRGGVKRISGLIHEETRGVLKIFLENVIRDAVTYTEHARRKTVTAMDVVYALKRQGRTLYGFGG

SEQ ID NO: 6506 - protein, 103 aa, Saccharum officinarum
MSGRGKGGKGLGKGGAKRHRKVLRDNIQGITKPAIRRLARRGGVKRISGLIYEETRGVLKIFLENVIRDAVTCTEHARRKTVTAMDVVYALKRQGRTLYGFGG

SEQ ID NO: 6507 - protein, 103 aa, Tragopogon dubius
MSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLCGFGG

SEQ ID NO: 6508 - protein, 103 aa, Unknown
  Sequence found in Organisms: Antirrhinum majus, Raphanus sativus
MSGRGKGGKGLGKGGAKRHRKVLRDNIQGITKPAIRRLARRGGVKRISGLIYEGTRGVLKIFLENVIRDAVTYTEHARRKTVTAMDVVYALKRQGRTLYGFGG

SEQ ID NO: 6509 - protein, 103 aa, Malus domestica
MTGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6510 - protein, 103 aa, Artemisia annua
  misc_feature (38)..(38): Xaa can be any naturally occurring amino acid
MSGRGKGGKGLGKGGAKRHRKVLRDNIQGITKPAIRRXARRGGVKRISGLIYEETRGVLKIFLENVIRDAVTYTEHARRKTVTAMDVVYALKRQGRTLYGFGG

SEQ ID NO: 6511 - protein, 103 aa, Brassica rapa
  misc_feature (79)..(79): Xaa can be any naturally occurring amino acid
MSGRGKGGKGLGKGGAKRHRKVLRDNIQGITKPAIRRLARRGGVKRISGLIYEETRGVLKIFLENVIRDAVTYTEHARXKTVTAMDVVYALKRQGRTLYGFGG

SEQ ID NO: 6512 - protein, 103 aa, Hordeum vulgare
MSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGS

SEQ ID NO: 6513 - protein, 103 aa, Unknown
  Sequence found in Organisms: Hordeum vulgare, Cynara scolymus
MSGRGKGGKGLGKGGAKRHRKVLRDNIQGITKPAIRRLARRGGVKRISGLIYEETRGVLKIFLENVIRDAVTYTEHARRKTVTAMDVVYTLKRQGRTLYGFGG

SEQ ID NO: 6514 - protein, 103 aa, Cenchrus ciliaris
  misc_feature (5)..(5): Xaa can be any naturally occurring amino acid
MSGRXKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6515 - protein, 103 aa, Cenchrus ciliaris
MSGRGKGGKGLGKGGAKRHLKVLRDNIQGITKPAIRRLARRGGVKRISGLIYEETRGVLKIFLENVIRDAVTYTEHARRKTVTAMDVVYALKRQGRTLYGFGG

SEQ ID NO: 6516 - protein, 103 aa, Cynara scolymus
MSGRGKGGKGLGKGGAKRHRKVLRDNIQGITKPAIRRLARRGGVKRISGLIYEETRGVLKIFLENVIRDAVTYTEHARRKTVTAMDVVYALKRGGRTLYGFGG

SEQ ID NO: 6517 - protein, 103 aa, Zingiber officinale
  misc_feature (48)..(48): Xaa can be any naturally occurring amino acid
MSGRGKGGKGLGKGGAKRHRKVLRDNIQGITKPAIRRLARRGGVKRIXGLIYEETRGVLKIFLENVIRDAVTYTEHARRKTVTAMDVVYALKRQGRTLYGFGG

SEQ ID NO: 6518 - protein, 103 aa, Actinidia deliciosa
MSGRGKGGKGLGKGGAKRHRKVLRDNIQGITKPAIRRLARRGGVKRISGLIYKETRGVLKIFLENVIRDAVTYTEHARRKTVTAMDVVYALKRQGRTLYGFGG

SEQ ID NO: 6519 - protein, 103 aa, Actinidia deliciosa
  misc_feature (95)..(95): Xaa can be any naturally occurring amino acid
MSGRGKGGKGLGKGGAKRHRKVLRDNIQGITKPAIRRLARRGGVKRISGLIYEETRGVLKIFLENVIRDAVTYTEHARRKTVTAMDVVYALKRQXRTLYGFGG

SEQ ID NO: 6520 - protein, 103 aa, Lactuca sativa
MSGRGKGGKGLGKGGAKRHRKVLRDNIQGITKPAIRRLARRGGVKRISGLIYEETRGVLKIFLENVIRDAVTYTEHARRKTVTAMDVVYALKRQGKTLYGFGG

SEQ ID NO: 6521 - protein, 103 aa, Lactuca sativa
MSGRGKGGKGLGKGGAKRHRKVLRDNIQGITKPAIRRLARRGGVKRISGLIYEETRVVLKIFLENVIRDAVTYTEHARRKTVTAMDVVYALKRQGRTLYGFGG

SEQ ID NO: 6522 - protein, 103 aa, Marchantia polymorpha
MSGRGKGGKGLGKGGAKRHRKVFRDNIQGITKPAIRRLARRGGVKRISGLIYEETRGVLKIFLENVIRDAVTYTEHARRKTVTAMDVVYALKRQGRTLYGFGG

SEQ ID NO: 6523 - protein, 103 aa, Medicago truncatula
  misc_feature (36)..(36): Xaa can be any naturally occurring amino acid
MSGRGKGGKGLGKGGAKRHRKVLRDNIQGITKPAIXRLARRGGVKRISGLIYEETRGVLKIFLENVIRDAVTYTEHARRKTVTAMDVVYALKRQGRTLYGFGG

SEQ ID NO: 6524 - protein, 103 aa, Cucumis melo
  misc_feature (90)..(90): Xaa can be any naturally occurring amino acid
MSGRGKGGKGLGKGGAKRHRKVLRDNIQGITKPAIRRLARRGGVKRISGLIYEETRGVLKIFLENVIRDAVTYTEHARRKTVTAMDVVYXLKRQGRTLYGFGG

SEQ ID NO: 6525 - protein, 103 aa, Allium cepa
  misc_feature (64)..(64): Xaa can be any naturally occurring amino acid
MSGRGKGGKGLGKGGAKRHRKVLRDNIQGITKPAIRRLARRGGVKRISGLIYEETRGVLKIFLXNVIRDAVTYTEHARRKTVTAMDVVYALKRQGRTLYGFGG

SEQ ID NO: 6526 - protein, 103 aa, Ostreococcus lucimarinus
MSGRGKGGKGLGKGGAKRHRKVLRDNIQGITKPAIRRLARRGGVKRISGLIYEETRGVLKVFLENVIRDAVTYTEHARRKTVTAMDVVYALKRQGRTLYGFGG

SEQ ID NO: 6527 - protein, 103 aa, Petunia hybrida
MSGRGKGGKGLGKGGAKRHRKVLRDNIQGITKPAIRRLARRGGVKRISGLIYEETRGVLKIFLENVIRDAVTYTEHARRKTGTAMDVVYALKRQGRTLYGFGG

SEQ ID NO: 6528 - protein, 103 aa, Petunia hybrida
MSGRGKGGKGLGKGGAKRHRKVLRDNIQGITKPAIRRLARRGRVKRISGLIYEETRGVLKIFLENVIRDAVTYTEHARRKTVTAMDVVYALKRQGRTLYGFGG

SEQ ID NO: 6529 - protein, 103 aa, Raphanus sativus
MSGRGKGGKGLGKGGAKRHRKVLRDNIQGITKPAIRRLARRGGVKRISGLICEETRGVLKIFLENVIRDAVTYTEHARRKTVTAMDVVYALKRQGRTLYGFGG

SEQ ID NO: 6530 - protein, 103 aa, Raphanus sativus
MSGRGKGGKGLGKGGAKRHRKVLRDNIQGITKPAIRRLARRGGVKRISGLIYEETRGALKIFLENVIRDAVTYTEHARRKTVTAMDVVYALKRQGRTLYGFGG

SEQ ID NO: 6531 - protein, 103 aa, Raphanus sativus
MSGRGKGGKGLGKGGAKRHRKVLRDNIQGITKPAIRRLARRGGVKRISGLIYEETRGVLKIFMENVIRDAVTYTEHARRKTVTAMDVVYALKRQGRTLYGFGG

SEQ ID NO: 6532 - protein, 103 aa, Raphanus sativus
MSERGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6533 - protein, 104 aa, Secale cereale
AMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6534 - protein, 103 aa, Euphorbia esula
MSGRGKGGKGLGKGGAKRHRKVLRDNIQGITKPAIRRLARRGGVKRFSGLIYEETRGVLKIFLENVIRDAVTYTEHARRKTVTAMDVVYALKRQGRTLYGFGG

SEQ ID NO: 6535 - protein, 103 aa, Saccharum officinarum
  misc_feature (102)..(102): Xaa can be any naturally occurring amino acid
MSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFXG

SEQ ID NO: 6536 - protein, 103 aa, Saccharum officinarum
MSGRGKGGKGLGKGGAKRHRKVLRDNIQGITKPAIRRLARRGGVKRISGLIYEETRGVLKIFLENVIRDAVTYTEHARRKTVTAMDVVYALKRQGRTFYGFGG

SEQ ID NO: 6537 - protein, 103 aa, Saccharum officinarum
  misc_feature (85)..(85): Xaa can be any naturally occurring amino acid
MSGRGKGGKGLGKGGAKRHRKVLRDNIQGITKPAIRRLARRGGVKRISGLIYEETRGVLKIFLENVIRDAVTYTEHARRKTVTAXDVVYALKRQGRTLYGFGG

SEQ ID NO: 6538 - protein, 103 aa, Saccharum officinarum
MSGRGKGGKGLGKGGAKRHRKVLRDNIQGITKPAIRRLARRGGVKRISGLIYEETRGVLKIFLENVIRDAVTYTEHARRKTVIAMDVVYALKRQGRTLYGFGG

SEQ ID NO: 6539 - protein, 103 aa, Tamarix hispida
  misc_feature (98)..(98): Xaa can be any naturally occurring amino acid
MSGRGKGGKGLGKGGAKRHRKVLRDNIQGITKPAIRRLARRGGVKRISGLIYEETRGVLKIFLENVIRDAVTYTEHARRKTVTAMDVVYALKRQGRTXYGFGG

SEQ ID NO: 6540 - protein, 103 aa, Nicotiana tabacum
MSGRGKGGKGLGKGGAKRHREVLRDNIQGITKPAIRRLARRGGVKRISGLIYEETRGVLKIFLENVIRDAVTYTEHARRKTVTAMDVVYALKRQGRTLYGFGG

SEQ ID NO: 6541 - protein, 103 aa, Triphysaria pusilla
  misc_feature (59)..(59): Xaa can be any naturally occurring amino acid
MSGRGKGGKGLGKGGAKRHRKVLRDNIQGITKPAIRRLARRGGVKRISGLIYEETRGVXKIFLENVIRDAVTYTEHARRKTVTAMDVVYALKRQGRTLYGFGG

SEQ ID NO: 6542 - protein, 103 aa, Juglans hindsii x Juglans regia
MSGRGKGGKGLGKGGAKRHRKVLRDNIQGITKPGIRRLARRGGVKRISGLIYEETRGVLKIFLENVIRDAVTYTEHARRKTVTAMDVVYALKRQGRTLYGFGG

SEQ ID NO: 6543 - protein, 103 aa, Rosa hybrid cultivar
MSGRGKGGKGLGKGGAKRHRKVLRDNIQGITKPAIRRLGRRGGVKRISGLIYEETRGVLKIFLENVIRDAVTYTEHARRKTVTAMDVVYALKRQGRTLYGFGG

SEQ ID NO: 6544 - protein, 101 aa, Unknown
  Sequence found in Organisms: Arabidopsis lyrata, Artemisia annua, Gerbera hybrid cultivar, Lactuca sativa, Zinnia violacea
GRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6545 - protein, 102 aa, Artemisia annua
SGRGKGGKGLGKGGAKRHRKVLRDNIQGITKPAIRRLARRGGVKRISGLIYEETRGVLKILLENVIRDAVTYTEHARRKTVTAMDVVYALKRQGRTLYGFGG

SEQ ID NO: 6546 - protein, 103 aa, Pinus taeda
MSGRGKGGKGLGKGGAKRHRKVLRDNIQGITKPAIRRLARRGGVKRISGLIYEETRGVLKIFLENVIKDAVTYTEHARRKTVTAMDVVYSLKRQGRTLYGFGG

SEQ ID NO: 6547 - protein, 102 aa, Solanum tuberosum
SGRGKGGKGLGKGGAKRHRKVLRDNIQGITKPAIRRLARRGGVKRISGLIYEETRGVLKIFLENVIRDSVTYTEHARRKTVTAMDVVYALKRQGRTLYGFGG

SEQ ID NO: 6548 - protein, 103 aa, Solanum lycopersicum
MSGRGKGGKGLGKGGAKRHRKVLRDNIQGITKPAIRRLARRGGVKRISGLIYEETRGVLKIFLENVIRDSVTYTEHARRKTVTAMDVVYALKRQGRTLYGLGG

SEQ ID NO: 6549 - protein, 103 aa, Artemisia annua
  misc_feature (70)..(70): Xaa can be any naturally occurring amino acid
  misc_feature (73)..(73): Xaa can be any naturally occurring amino acid
MSGRGKGGKGLGKGGAKRHRKVLRDNIQGITKPAIRRLARRGGVKRISGLIYEETRGVLKIFLENVIRDXVTXTEHARRKTVTAMDVVYALKRQGRTLYGFGG

SEQ ID NO: 6550 - protein, 103 aa, Artemisia annua
  misc_feature (41)..(41): Xaa can be any naturally occurring amino acid
  misc_feature (59)..(59): Xaa can be any naturally occurring amino acid
MSGRGKGGKGLGKGGAKRHRKVLRDNIQGITKPAIRRLARXGGVKRISGLIYEETRGVXKIFLENVIRDAVTYTEHARRKTVTAMDVVYALKRQGRTLYGFGG

SEQ ID NO: 6551 - protein, 103 aa, Musa acuminata
  misc_feature (67)..(67): Xaa can be any naturally occurring amino acid
  misc_feature (101)..(101): Xaa can be any naturally occurring amino acid
MSGRGKGGKGLGKGGAKRHRKVLRDNIQGITKPAIRRLARRGGVKRISGLIYEETRGVLKIFLENVXRDAVTYTEHARRKTVTAMDVVYALKRQGRTLYGXGG

SEQ ID NO: 6552 - protein, 103 aa, Hordeum vulgare
MSGRGKGGKGLGKGGAKRHRKVLRDNIQGITKPAIRRLARRGGVKRISGLIYEETRGVLKIFLENVIRDAVTYTEHARRKTVTDMDVVYSLKRQGRTLYGFGG

SEQ ID NO: 6553 - protein, 103 aa, Manihot esculenta
  misc_feature (18)..(19): Xaa can be any naturally occurring amino acid
MSGRGKGGKGLGKGGAKXXRKVLRDNIQGITKPAIRRLARRGGVKRISGLIYEETRGVLKIFLENVIRDAVTYTEHARRKTVTAMDVVYALKRQGRTLYGFGG

SEQ ID NO: 6554 - protein, 103 aa, Unknown [sequence omitted]

SEQ ID NO: 6555 - protein, 103 aa, Cynara scolymus
MSGPLKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6556 - protein, 105 aa, Lactuca sativa
KKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6557 - protein, 103 aa, Eragrostis curvula
MSGRGKGGKGLGKGGAKRHRKVLRDNIQCITKPAIRRLARRGGVKRISGLIYEETRGVLKIFLENVIRDAVTYTEHARRKTVTAMDVVYALKRQGRNLYGFGG

SEQ ID NO: 6558 - protein, 103 aa, Medicago truncatula
MSGRGKGGKGLGKGGAKRHRKVLRDNIQGITKPAIRRLARKGGVQRISGLIYEETRGVLKIFLENVIRDAVTYTEHARRKTVTAMDVVYALKRQGRTLYGFGG

SEQ ID NO: 6559 - protein, 103 aa, Nicotiana benthamiana
  misc_feature (52)..(52): Xaa can be any naturally occurring amino acid
MSGRGKGGKGLGKGGAKRHRKVLRDNIQGFTKPAIRRLARRGGVKRISGLIXEETRGVLKIFLENVIRDAVTYTEHARRKTVTAMDVVYALKRQGRTLYGFGG

SEQ ID NO: 6560 - protein, 103 aa, Petunia hybrida
MSGRGKGGKRLGKGGAKRHRKVLRDNIQGITKPAIRRLARRGGVKRISGLIYEETRGVLKIFLENVIRDAVTYTEHARRKTVTAMDVVYSLKRQGRTLYGFGG

SEQ ID NO: 6561 - protein, 103 aa, Petunia hybrida
MSGRGKGGKGLGKGGAKRHRKVLRDNIQGITKPAIRRLARRGGVKRISGLMYEETRGVLKIFLENVIRDAVTYTEHARRKTVTAMDVVYSLKRQGRTLYGFGG

SEQ ID NO: 6562 - protein, 103 aa, Pinus taeda
  misc_feature (68)..(68): Xaa can be any naturally occurring amino acid
MSGRGKGGKGLGKGGAKRHRKVLRDNIQGITKPAIRRLARRGGVKRISGLIYEETRGVLKIFLENVIXDAVTYTEHARRKTVTAMDVVYSLKRQGRTLYGFGG

SEQ ID NO: 6563 - protein, 103 aa, Solanum tuberosum
MSGHGKGGKGLGKGGAKRHRKVLRDNIQGITKPAIRRLARRGGVKRISGLIYEETRGVLKIFLENVIRDSVTYTEHARRKTVTAMDVVYALKRQGRTLYGFGG

SEQ ID NO: 6564 - protein, 103 aa, Pseudoroegneria spicata
  misc_feature (2)..(2): Xaa can be any naturally occurring amino acid
  misc_feature (65)..(65): Xaa can be any naturally occurring amino acid
MXGRGKGGKGLGKGGAKRHRKVLRDNIQGITKPAIRRLARRGGVKRISGLIYEETRGVLKIFLEXVIRDAVTYTEHARRKTVTAMDVVYALKRQGRTLYGFGG

SEQ ID NO: 6565 - protein, 105 aa, Raphanus sativus
GKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6566 - protein, 103 aa, Secale cereale
MSWRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFSG

SEQ ID NO: 6567 - protein, 103 aa, Saccharum officinarum
MSGRGKGGKGLGKGGAKRHRKVLRDNIQGITKPAIRRLARRGGVKRISGLIYEETRGVLKIFLENVIRDAVTYTEHARRKTVTVMDVVYALKRQGLTLYGFGG

SEQ ID NO: 6568 - protein, 103 aa, Saccharum officinarum
MSGRGKGGKGLGKGGAKRHRKVLRDNIQGITNPAIRKLARRGGVKRISGLIYEETRGVLKIFLENVIRDAVTYTEHARRKTVTAMDVVYALKRQGRTLYGFGG

SEQ ID NO: 6569 - protein, 103 aa, Saccharum officinarum
MSGRGKGGKGLGKGGAKRHRKVLRDNIQGITKPAIRRLARRGGVKRISGLIYEETRGVLKIFLENVIRDAVTYTEHARRKTVPAMDVVYALKRQGRTLYGFGE

SEQ ID NO: 6570 - protein, 103 aa, Juglans hindsii x Juglans regia
  misc_feature (44)..(44): Xaa can be any naturally occurring amino acid
  misc_feature (98)..(98): Xaa can be any naturally occurring amino acid
MSGRGKGGKGLGKGGAKRHRKVLRDNIQGITKPAIRRLARRGGXKRISGLIYEETRGVLKIFLENVIRDAVTYTEHARRKTVTAMDVVYALKRQGRTXYGFGG

SEQ ID NO: 6571 - protein, 103 aa, Pinus taeda
MSGRGKGGKGLGKGGAKRHRKVLRDNIQGITKPAIRRLARRGGVKRIIGLIYEETRGVLKIFLENVIRDAVTYTEHARRKTVTAMDVVYSLKRQGRTLYGFGG

SEQ ID NO: 6572 - protein, 61 aa, Artemisia annua
MLSVMLSPTPSTLVVKLSLLWMLFMLLRDKAGLSMVSGVRLISIMLSLRCSLYGFMVVLCN

SEQ ID NO: 6573 - protein, 52 aa, Saccharum officinarum
MSGRGKGGKGLGKGGAKRHRKVLRDNIQGITKPAIRRLARRGGVKRISGLIY

SEQ ID NO: 6574 - protein, 136 aa, Triticum aestivum
  misc_feature (16)..(16): Xaa can be any naturally occurring amino acid
SSLSGTDRRDNQPPPXQLLHLHLSQLQGRKRSAISGRGKGGKGLGKGGAKRHRKVLRDNIQGITKPAIRRLARRGGVKRISGLIYEETRGVLKIFLENVIRDVVTYTEHARRKTVTAMDVVYALKRQGRTLYGFGG

SEQ ID NO: 6575 - protein, 89 aa, Triticum aestivum
PRKLTSPPQTRAEEAMSGRGKGGKGLGKGGAKRHRKVLRDNIQGITKPAIRRLARRGGVKRISGLIYEGDPRRAQDLPRERHPRRRHLH

SEQ ID NO: 6576 - protein, 163 aa, Triticum aestivum
  misc_feature (107)..(107): Xaa can be any naturally occurring amino acid
  misc_feature (119)..(119): Xaa can be any naturally occurring amino acid
  misc_feature (131)..(132): Xaa can be any naturally occurring amino acid
  misc_feature (156)..(156): Xaa can be any naturally occurring amino acid
RSSGSTSARSSRSAAMSGRGKGGKGLGKGGAKRHRKVLRDNIQGITKPAIRRLARRGGVKRISGLIYEETRGVLKIFLENVIRDAVTYTEHARRKTVTAMDVVYALXRQGRTSTASAVXRRRRILSRRLQXXNLMEPDFYSFPVYSIVVGTNLSAXRFLNKKK

SEQ ID NO: 6577 - protein, 106 aa, Raphanus sativus
CEKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6578 - protein, 100 aa, Unknown
  Sequence found in Organisms: Persea americana, Orobanche aegyptiaca
MSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYG

SEQ ID NO: 6579 - protein, 103 aa, Malus domestica
MSGRGKGGKVFGKGGAKRHRKILRDNIQGITKPAIRRLARRGGVKRISGLIYEETRGVLKIFLENVIRDAVTYTEHARRKTVTAMDVVYALKRQGRTLYGFGG

SEQ ID NO: 6580 - protein, 103 aa, Zea mays
MSGRPLGGKGLGKGGAKRHRKVLRDNIQGITKPAIRRLARRGGVKRISGLIYEETRGVLKIFLENVIRDAVTYTEHARRKTVTAMDVVYALKRQDRTLYGFGG

SEQ ID NO: 6581 - protein, 103 aa, Pinus taeda
MSGRGKGGKGLGKGGAKRHRKVLRDNIQGITKPAIRRLARRGGVKRISGLIYEETRGVLKVFLEHVIRDAVTYTEHARRKTVTAMDVVYALKRQGKTLYGFGG

SEQ ID NO: 6582 - protein, 104 aa, Pinus taeda
RMSGRGKGGKGLGKGGAKRHRKVLRDNIQGITKPAIRRLARRGGVKRIIGLIYEETRGVLKIFLENVIRDAVTYTEHARRKTVTAMDVVYSLKRQGRTLYGFGG

SEQ ID NO: 6583 - protein, 103 aa, Rosa hybrid cultivar
MSGRGKGGKGLGKGGALPHRKVLRDNIQGITKPAIRRLGRRGGVKRISGLIYEETRGVLKIFLENVIRDAVTYTEHARRKTVTAMDVVYALKRQGRTLYGFGG

SEQ ID NO: 6584 - protein, 103 aa, Glycine max
MSGRGKGGKGLGKGGAKRHRKVLRDNIQGITKPAIRRLARRGGVKRISGLIYEETRGVLMIFLENVICDVVTYTEHARRKTVTAMDVVYALKRQGRTLYGFGG

SEQ ID NO: 6585 - protein, 103 aa, Saccharum officinarum
MSGPGKGAKGLGKGGAKRHRKVLRDNIQGITKPPIRRLARRGGVKRISGLIYEETRGVLKIFLENVIRDAVTYTEHARRKTVTAMDVVYALKRQGRTLYGFGG

SEQ ID NO: 6586 - protein, 100 aa, Nicotiana tabacum
RGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6587 - protein, 103 aa, Volvox carteri
MSGRGKGGKGLGKGGAKRHRKVLRDNIQGITKPAIRRLARRGGVKRISGLIYEETRTVLKNFLENVIRDSVTYTEHARRKTVTAMDVVYALKRQGRTLYGFGG

SEQ ID NO: 6588 - protein, 103 aa, Zinnia violacea
MSGRGKGGKGLGKGGAKRHRKVLRDNNQGITKPAIRRLARRGGVKRISGLIYEETRGVLKIILENVIRDAVTYTEHARRKTVTAMDVVYALKKQGRTLYGFGG

SEQ ID NO: 6589 - protein, 61 aa, Artemisia annua
DIKTFSFNQKTQKGNHVRTWEGRKGTRQRRSKASQESVKRQHSRITNPRLDGWRDEEESRG

SEQ ID NO: 6590 - protein, 59 aa, Artemisia annua
MSGLGKGGKGLGKGGAKRHRKVLRDNIQGYHQASYPSSCSKRWCQTYLWFDLRRNSRCS

SEQ ID NO: 6591 - protein, 66 aa, Artemisia annua
GRGKGGKGLGKGGAKRHRKVLRDNIQGITKPAIRRLARRGGVKRISGLIYEETRGVLKILFGECDP

SEQ ID NO: 6592 - protein, 65 aa, Gerbera hybrid cultivar
TPQILRSRIDLKKSENVGTWKRRKRIRKGRRQASPESSPGQHPGNHLSRRSGVWPEEAALFLLAV

SEQ ID NO: 6593 - protein, 64 aa, Amborella trichopoda
MSLESVTLQKFPLMNEPRVCKISKPSYRGSSTIKNFLQKIGVSKPQFKKKSNMKNNTTSINLKP

SEQ ID NO: 6594 - protein, 126 aa, Gossypium hirsutum
ISQRSAFIAASLATLSWKLHKIKMTGRGKGGKGLGKGGAKRHRKVLRDNIQGITKPAIRRLARRGGVKRISGLIYEETRGVLKVFLENVIRDAVTYTEHAKRKTVTAMDVVYALKRQGRTLYGFGG

SEQ ID NO: 6595 - protein, 147 aa, Ipomoea nil
  misc_feature (8)..(9): Xaa can be any naturally occurring amino acid
  misc_feature (13)..(13): Xaa can be any naturally occurring amino acid
  misc_feature (20)..(20): Xaa can be any naturally occurring amino acid
  misc_feature (38)..(38): Xaa can be any naturally occurring amino acid
  misc_feature (59)..(59): Xaa can be any naturally occurring amino acid
  misc_feature (65)..(65): Xaa can be any naturally occurring amino acid
GGGLLTDXXHYYXIKALRWXHARFAVDLDFPKIRHEDXNSEFSEESGRGKGGKGLGKGXAKRHRXVLRDNIQGITKPAIRRLARRGGVKRISGLIYEETRGVLKIFLENVIRDAVTYTEHARRKTVTAMDVVYALKRQGRTLYGFGG

SEQ ID NO: 6596 - protein, 45 aa, Rosa hybrid cultivar
NSISYLPSKSNSLFSNFSGENVRPRQGRQGFGQMSTQASQEGSEG

SEQ ID NO: 6597 - protein, 56 aa, Volvox carteri
MARTKQTARKSTGGKAPRKQLATKAARKTPATGGVKKPHRYRPGTVRHHTYLHSIS

SEQ ID NO: 6598 - protein, 157 aa, Volvox carteri
MAPKKEEKPASQAAEAPEVKAEAKPKAVKAPKKKEKKAPAKKVAKEPSAGGEDGDKKSKKKAKVAKSETYKLYIYKVLKQVHPDTGISSKAMSIMNSFINDIFEKVATEASKLSRYNKKPTVTSREIQTAVRLVLPGELAKHAVSEGTKAVTKFTSA

SEQ ID NO: 6599 - protein, 107 aa, Lactuca sativa
NKNKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6600 - protein, 107 aa, Helianthus annuus
NKQTMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6601 - protein, 106 aa, Tropaeolum majus
MSGRGKGGKGLGKGGAKRHRKVLRDNIQGITKPAIRRLARRGGVKRISGLIYEETRGVLKIFLENVIRDSVTYTEHARRKTVTAMDVVYALKRQGRTLYGFGGLRS

SEQ ID NO: 6602 - protein, 105 aa, Ocimum basilicum
  misc_feature (21)..(21): Xaa can be any naturally occurring amino acid
APRSGRGKGGKGLGKGGAKRXRKVLRDNIQGITKPAIRRLARRGGVKRISGLIYEETRGVLKIFLENVIRDAVTYTEHARRKTVTAMDVVYALKRQGRTLYGFGG

SEQ ID NO: 6603 - protein, 880 aa, Mimulus guttatus
MSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLDGCLLLSTCLLMPHIFHVSKFSKNNKIFLRRWISPLTELMLKKCVQLTGRERKKMEPQILTVKPQGFYLIPNTYKNCITRRRHVSVPRCCRRLPEHSGEARAPKRRDVLITPLLALGAYALRTAVAKADDKPALEGGAQIPQPSQQGAVGSQEEAAADPAAKEEVINSRIYDATVIGEPMALGKDKSKVWEKMLDARVVYLAEAEQVPVPDDKELELEIVKKLNKRCVESDRPIALALEAFPCNLQEQLNQYMDKRIDGQTLKSFVTHWPPQRWQEYEPLLTYCINNGIRLVACGVPLEVLRTVQAEGVLGLSKVDRKKYAPPAGSGFISGFPSISRRSSMDNNFPNQSATFGPMSYLSVQARAVEDYTMSQIILQAVSDVGSTGMLVVVTGASHVTYGSRGTGLPARISRKMQKKNQVVILLDPERQYIRREGEAPIADFLWYSAARTCNRNCFDRAEIARVMNAAGRKRDALPQDLQNGLDLGLVSPEVLQNFFDLEKYPLISELTNRFQGFRERLLADPRFLQRLAIEETISITTTLLAQYQKRKENFFEEIDYVVTDTLRGIVVDFFTVWLPAPTLSFLSNVDDMNPPGSVEALKGLLGSIPDNAFQKNLAGKDWNLNHRIASVFVGGFKLAGVGFISSIGAVASSNVLYAIRKLLSSSFDNKQGNRRSPVLKTALVYASFLGTSANLRYQFIAGIVEHRISEQFSDQTLLVNMISFVARTINSYWGTQQWIDLARYTGLQSRKNEEVQSQIPDPSTNTASECNTVEDTTTIDETNKQ

SEQ ID NO: 6604 - protein, 140 aa, Avena sativa
PTSSSRSSSGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGIPSGLRSLCLFVLSVFRISVLCVSCLGAMACSL

SEQ ID NO: 6605 - protein, 144 aa, Avena sativa
NNPPKKSSTRRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGKASRLVRSFQGIGRRISAVAVISICLLLLNGGSDV

SEQ ID NO: 6606 - protein, 145 aa, Avena sativa
ISHLTPEKKSPISTRPSPSSSGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGVGFSVSVRVLGFRLCVCCLGALVCSL

SEQ ID NO: 6607 - protein, 137 aa, Avena sativa
NSPISTCSSPSSSGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGVGFSVSVRVLGFRLRVCCLGALVCSL

SEQ ID NO: 6608 - protein, 129 aa, Avena sativa
NNPPKKSSTRRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGKASGLVRSFEGSLVGSLQLL

SEQ ID NO: 6609 - protein, 59 aa, Saccharum officinarum
MSGRGKGGKGLGKGGAKRHRKVLRDNIQGITKPAIRRLARRGGVKRISGLRYKKTLAVR

SEQ ID NO: 6610 - protein, 120 aa, Triticum aestivum
  misc_feature (98)..(98): Xaa can be any naturally occurring amino acid
  misc_feature (104)..(104): Xaa can be any naturally occurring amino acid
  misc_feature (118)..(118): Xaa can be any naturally occurring amino acid
HHPPPLEFDLFAPPDMSGRGKGGKGLGKGGAKRHRKVLRDNIQGITKPAIRRLARRGGVKRISGLIYEETRGVLKIFLENVIRDAVTYTEHARRKTVXAMDVVXRSSARGAPFKASAXRR

SEQ ID NO: 6611 - protein, 133 aa, Triticum aestivum
QHQSPIIWPPSERGERPVRGGGDVGARQGRQGSRQGWSQAPPEGAPRQHPGHHQAGDPEAGSEGRREAHLGAHLRGDPRRAQDLPRELIRDAVTYTEHARRKTVTAMDVVYALKRQGPHLYASEVGPLRTGEC

SEQ ID NO: 6612 - protein, 99 aa, Artemisia annua
MSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLY

SEQ ID NO: 6613 - protein, 102 aa, Festuca arundinacea
ARGGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6614 - protein, 99 aa, Unknown
  Sequence found in Organisms: Festuca arundinacea, Senecio madagascariensis
GKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6615 - protein, 100 aa, Euphorbia esula
RGKGGKGLEKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6616 - protein, 103 aa, Saccharum officinarum
MSGRGKARKGLGKGGAKRHRKVLRDNIQGITKPAIRRLARRGGVKRISGLIYEETRGVLKIFLENVIRDAVTYTEHARRKTVTDMDVVYALKRQGRTLYGYGG

SEQ ID NO: 6617 - protein, 103 aa, Nicotiana tabacum
MSGRGKGGKGLGKGGAKRHRKVLRDNIQGITKPAIRRLARRGGVKRISGLIYEETRGVLKVFLEHVIRDAVTYTEHARRKTVTALDVVYVLKRQGRTLYGFGG

SEQ ID NO: 6618 - protein, 108 aa, Brassica napus
KNISSMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6619 - protein, 108 aa, Secale cereale
PNPATMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6620 - protein, 108 aa, Triphysaria pusilla
FNQLKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6621 - protein, 108 aa, Triticum aestivum
RREAKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6622 - protein, 106 aa, Brassica napus
RAGHLGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6623 - protein, 63 aa, Cicer arietinum
MSGRGKGGKGFGKGGAKRPRKVFRDNIQGITKPAIRRLVRRGGVKRISGLIYEETRGVLKIFL

SEQ ID NO: 6624 - protein, 123 aa, Avena sativa
GKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGAVAEVLARGQETGGEDNCSRSVFYA

SEQ ID NO: 6625 - protein, 156 aa, Avena sativa
KSTSPVATGEAGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGSSGMEEVREWCCCCSLGFVCRWCGMCVSDVSCCCVLFMFGCCTRMMS

SEQ ID NO: 6626 - protein, 159 aa, Avena sativa
LRTNHRTQTSQPHRRSEGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGSSGMEEVSECCCCWLGFVCRLSRMLMLFPVSVLFMFGCCSRMMS

SEQ ID NO: 6627 - protein, 131 aa, Avena sativa
KSTSPVATGEAGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGRPPRRATRGLQGWQKLANVVVG

SEQ ID NO: 6628 - protein, 114 aa, Eucalyptus gunnii
  misc_feature (48)..(48): Xaa can be any naturally occurring amino acid
  misc_feature (77)..(77): Xaa can be any naturally occurring amino acid
  misc_feature (79)..(79): Xaa can be any naturally occurring amino acid
  misc_feature (104)..(104): Xaa can be any naturally occurring amino acid
MSGRGKGGKGLGKGGAKRHRKVLRDNIQGITKPAIRRLARRGGVKRIXGLIYEETRGVLKIFLENVIRDAVTYTEHXRXTDRHRHGRRLRPQEAGPHPVRLRRXSVGGSGPGTY

SEQ ID NO: 6629 - protein, 56 aa, Allium cepa
  misc_feature (43)..(43): Xaa can be any naturally occurring amino acid
LQSISKTLISSVKCQEEEREVRDWERRSQEAQKSVEGQHPRNXQPCYPSSCSSWWS

SEQ ID NO: 6630 - protein, 162 aa, Pinus taeda
  misc_feature (81)..(81): Xaa can be any naturally occurring amino acid
MSGRGKGGKGLGKGGAKRHRKVLRDNIQGITKPAIRRLARRGGVKRISGLIYEETRGVLKIFLENVIRDAVTYTEHARRKXVTAMNVVYALKRQGRSLHGFGAASCASRPHQNEGIAAEEELAEYPLIHPEAAAPRKNFSALEGSTFIQRSICSPRIAITLF

SEQ ID NO: 6631 - protein, 121 aa, Secale cereale
  misc_feature (10)..(10): Xaa can be any naturally occurring amino acid
  misc_feature (56)..(56): Xaa can be any naturally occurring amino acid
  misc_feature (97)..(97): Xaa can be any naturally occurring amino acid
  misc_feature (109)..(109): Xaa can be any naturally occurring amino acid
TTAPPIPLAXQLQEDRRRPCPGAAREARVSVRARQAPPEGVRDNIQGITKPAIRRXARRGGVKRISGLIYEETRGVLKIFLENVIRDAVTYTEHARXKTVTAMDVVYAXKRQGRTLYGFGG

SEQ ID NO: 6632 - protein, 148 aa, Saccharum officinarum
  misc_feature (116)..(116): Xaa can be any naturally occurring amino acid
  misc_feature (120)..(120): Xaa can be any naturally occurring amino acid
  misc_feature (133)..(133): Xaa can be any naturally occurring amino acid
  misc_feature (139)..(139): Xaa can be any naturally occurring amino acid
PNPQFPTSPPSPSDHVRARQGRQGAGQGWREAPPQGPPRQHPGHHEVGDLEAGEEGRREAHLGAHLRGDTRRAQDLPRERHPRRRHLHGARPPQDRHRHGRRLRAQAPGLHPLWIXRLRXAPPPLVAVAKVLXHGQEIXGGESILPIC

SEQ ID NO: 6633 - protein, 59 aa, Camellia sinensis
MRRLAGVLKIFLENVIRDAVTYTEHARRKTVTAMDVVYALKRQGRTLYGLGVEFVAGVL

SEQ ID NO: 6634 - protein, 118 aa, Triphysaria pusilla
SSFKIISQFKFPNLKQQNPKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTL

SEQ ID NO: 6635 - protein, 90 aa, Triticum aestivum
PTSKQKFPNPLVSAAKMSGRGKGGKGLGKGGAKRHRKVLRDNIQGITKPAIRRLARRGGVKRISGLIYEETRGVLKIFLGERHPRRRHLH

SEQ ID NO: 6636 - protein, 134 aa, Triticum aestivum
  misc_feature (57)..(57): Xaa can be any naturally occurring amino acid
  misc_feature (102)..(102): Xaa can be any naturally occurring amino acid
HRSSDSTTARTSRSAAMSGRGKGGKGLGKGGAKRHRKVLRDNIQGITKPAIRRLPRXGGVKRISGLIYEETRGVLKIFLENVIRNAVTYTEHARRKDRHRHXRRLRAQAPGTHPLRFRGVGPANSKSLMEPRLV

SEQ ID NO: 6637 - protein, 98 aa, Artemisia annua
KGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6638 - protein, 100 aa, Artemisia annua
RVRGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6639 - protein, 103 aa, Avena sativa
MSGRGKGGKGLGKGGAKRHRKILRDNIQGITKPAIRRLARRGGVKRISGLIYEETRGVLKTFLENVIRDAVTYTEHAKRKTVTSLDVVYALKRQGRTLYGFGG

SEQ ID NO: 6640 - protein, 103 aa, Liriodendron tulipifera
  misc_feature (10)..(10): Xaa can be any naturally occurring amino acid
  misc_feature (37)..(37): Xaa can be any naturally occurring amino acid
  misc_feature (47)..(47): Xaa can be any naturally occurring amino acid
  misc_feature (84)..(84): Xaa can be any naturally occurring amino acid
  misc_feature (90)..(90): Xaa can be any naturally occurring amino acid
MSGRGKGGKXLGKGGAKRHRKVLRDNIQGITKPAIRXLARRGGVKRXSGLIYEETRGVLKIFLENVIRDAVTYTEHARRKTVTXMDVVYXLKRQGRTLYGFGG

SEQ ID NO: 6641 - protein, 103 aa, Zea mays
MSGRGKGGKGLGKGGALRHRKVLRDNIQGITNLTIQRLARRGGVKRISGLIYEETRGVLKIFLENVIRDAVTYTEHARRKTVTAMDVVYALKRQGRTLYGFGG

SEQ ID NO: 6642 - protein, 103 aa, Medicago truncatula
MSGRGKGGKGLGKGGAKRHRKILRDNIQGITKPAIRRLARRGGVKRISGLIYEETRGVLKVFLENVIRDAVTYTEHAKRKTVTSLDVVYALKRQGRTLYGFGG

SEQ ID NO: 6643 - protein, 101 aa, Avena sativa
IRHEGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6644 - protein, 98 aa, Rosa hybrid cultivar
MSGRGKGGKGLGKGGAKRHRKVLRDNIQGITKPAIRRLARRGGVKRISGLIYEETRGVLKIFLENVIRDAVTYTEHARRKTVTAMDVVYALKRQGRTL

SEQ ID NO: 6645 - protein, 102 aa, Triticum aestivum
  misc_feature (97)..(97): Xaa can be any naturally occurring amino acid
MSGRGKGGKGLGKGGAKRHRKVLRDNIQGITKPAIRRLARRGGVKRISGLIYEETRGVLKIFLENVIRDAVTYTEHARRKTVTAMDVVYALKRQGRXSTVGG

SEQ ID NO: 6646 - protein, 108 aa, Nicotiana tabacum
KKGLKMSGRGKGGKGLGKGGAKRHRKVLRDNIQGITKPAIRRLARRGGVKRISGLIYEETRGVLKIFLENVIRDAVTYTEHARRKTVTAMDVVYSLKRQGRTLYGFGG

SEQ ID NO: 6647 - protein, 107 aa, Triticum aestivum
  misc_feature (39)..(39): Xaa can be any naturally occurring amino acid
  misc_feature (49)..(49): Xaa can be any naturally occurring amino acid
SSATMSGRGKGGKGLGKGGAKRHRKVLRDNIQGITKPAXRRLARRGGVXRISGLIYEETRGVLKIFLENVIRDAVTYTEHARRKTVTAMDVVYALKRQGRTLYGFGG

SEQ ID NO: 6648 - protein, 106 aa, Populus trichocarpa
MIAAAWRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6649 - protein, 106 aa, Triticum aestivum
SATMSGRGKGGKGLGKGGAKRHRKVLRDNIHGITKPAIRRLARRGGVKRISGLIYEETRGVLKIFLENVIRDAVTYTEHARRKTVTAMDVVYALKRQGRTLYCFCG

SEQ ID NO: 6650 - protein, 140 aa, Triticum aestivum
  misc_feature (11)..(11): Xaa can be any naturally occurring amino acid
  misc_feature (101)..(101): Xaa can be any naturally occurring amino acid
  misc_feature (114)..(114): Xaa can be any naturally occurring amino acid
  misc_feature (132)..(132): Xaa can be any naturally occurring amino acid
ESLLLPNRATXSGRGKGGKGLGKGGAKRHRKVLRDNIQGITKPAIRRLARRGGVKRISGLIYEETRGVLKIFLENVIRDAVTYTRSTARRKTVTRHGRRLXAQAPGPHPLRLRXARFVVVPAAVQLPRLLSXDVCCWVDE

SEQ ID NO: 6651 - protein, 103 aa, Artemisia annua
NVRKRKGRKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6652 - protein, 98 aa, Rhizophora mangle
MSGRGKGGKGLGRGGAKRHRKVLRDNIQGITKPAIRRLARRGGVKRISGLIYEETRGVLKIFLENVIRDAVTYTEHARRKTVTAMDVVYALKRQGRTL

SEQ ID NO: 6653 - protein, 103 aa, Hordeum vulgare
MSGRGKGGKGLGKGGAKRHRKVLRDNIQGITKPAIRRLARRGGVKRISGLIYEETRGVLKIYLENVIRDAVTYTEHARRKTVIGMDVLYALNRQGRTLYCFGG

SEQ ID NO: 6654 - protein, 103 aa, Hordeum vulgare
MSGRGKGGKGLGKGGAKRHRKVLRDNIQGITKPAIRRLARRGGVKRISGLIYEETRGVLKIFLKNFIRDADTYTEHARRKTVTVMDVVYALKRQGQTLYGLGG

SEQ ID NO: 6655 - protein, 103 aa, Hordeum vulgare
MSGRGKGGKGLGKGGAKRHRKVLRDNIQGITKPAIRRGGRRGGVNRISGLIYEETRGVLKIFLENVIRDAVSYTEHARRKTVTVMDVVYTLKRQGRTLYGFGG

SEQ ID NO: 6656 - protein, 97 aa, Centaurea maculosa
GGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6657 - protein, 98 aa, Zea mays
MGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6658 - protein, 103 aa, Zea mays
MSGHGKGGKGLSQGGAQRHREVLRDNIQGITKPAIRRLARRGGVKRISGLIYEETRGVLKIFLENVIRDAVTYTEHARRKTVTAMDVVYSLKRQGRTLYGFGG

SEQ ID NO: 6659 - protein, 103 aa, Zea mays
MSGRGKGRKGLGKGGAKRHRKVLRDNIQGITKPAIRRLARRGGVKRISGLIYQETFGVLKIFLENVIRDAVTYTEHARLKTVTAMDVVYALKRQGRTLYCCGG

SEQ ID NO: 6660 - protein, 103 aa, Saccharum officinarum
MSVRGKGGGGLGKGGAKRHRKVLRDNIQGITKPAIRRLARRGGVKRISGLIYEETRGVLKIFLENVIRDAVTYTEHARRKTVTVMDVVYALKRQGLTLYRFGS

SEQ ID NO: 6661 - protein, 97 aa, Triphysaria pusilla
SGRGKGGKGLGKGGAKRHRKVLRDNIQGITKPAIRRLARRGGVKRISGLIYEETRGVLKIFLENVIRDAVTYTEHARRKTVTAMDVVYALKRQGRTL

SEQ ID NO: 6662 - protein, 103 aa, Triphysaria pusilla
  misc_feature (19)..(19): Xaa can be any naturally occurring amino acid
  misc_feature (26)..(26): Xaa can be any naturally occurring amino acid
  misc_feature (31)..(31): Xaa can be any naturally occurring amino acid
  misc_feature (73)..(73): Xaa can be any naturally occurring amino acid
  misc_feature (96)..(97): Xaa can be any naturally occurring amino acid
MSGRGKGGKGLGKGGAKRXRKVLRDXIQGIXKPAIRRLARRGGVKRISGLIYEETRGVLKIFLENVIRDAVTXTEHARRKTVTAMDVVYALKRQGXXLYGFGG

SEQ ID NO: 6663 - protein, 152 aa, Avena sativa
KGGKGLGKGGAKRHRKVLRDNIQGITKPAIRRLARRGGVKRISGLIYEETRGVLKIFLENVIRDAVTYTEHARRKTVTAMDVVYALKRQGRTLYGFGTEIRSVLAESSDRRRLASLLRVCHGLWCSCSRQYLAVVCSLCLVWCLDLYLGRNC

SEQ ID NO: 6664 - protein, 123 aa, Avena sativa
KGGKGLGKGGAKRHRKVLRDNIQGITKPAIRRLARRGGVKRISGLIYEETRGVLKIFLENVIRDAVTYTEHARRKTVTAMDVVYALKRQGRTLYGFGLRRRRLLQIPMCLVRLCSRVLRSRMF

SEQ ID NO: 6665 - protein, 116 aa, Lactuca sativa
KQKSNPEKSQVEENRRCQEEEKEARDWEREEQNVIVRFSGTISKVSRSRRLARRGGVKRISGLIYEETRGVLKIFLENVIRDAVTYTEHARRKTVTAMDVVYALKRQGRTLYGFGG

SEQ ID NO: 6666 - protein, 64 aa, Lactuca sativa
GNKFKFLPREKSREKTCQEEDEARDWEREEPNVIVRFSGTTSKVSPSRRFAVWPDEEVSSVSVG

SEQ ID NO: 6667 - protein, 122 aa, Eragrostis curvula
  misc_feature (21)..(21): Xaa can be any naturally occurring amino acid
RKTTFLLSQSSSPPSSKQPCXGRGTGSKGLGKGGAKRHRKVLRDNIQGITKPAIRRLARRGGVKRISGLIYEETRGVLKIFLENVIRDAVTYTEHARRKTFTAMDVVYSLKRQGRTLYGFGG

SEQ ID NO: 6668 - protein, 127 aa, Helianthus annuus
  misc_feature (10)..(11): Xaa can be any naturally occurring amino acid
  misc_feature (18)..(18): Xaa can be any naturally occurring amino acid
  misc_feature (25)..(25): Xaa can be any naturally occurring amino acid
  misc_feature (31)..(31): Xaa can be any naturally occurring amino acid
  misc_feature (33)..(33): Xaa can be any naturally occurring amino acid
  misc_feature (56)..(56): Xaa can be any naturally occurring amino acid
GGDQLFLSNXXTRLAFVXSKSYCTXSGRGKXGXGLAKVGAKRHRKVLRDNIQGITXPAIRRLARRGGVKRISGLIYEETRGVLKIFLENVIRDAVTYTEHARRKTVTAMDVVYALKRQGRTLYGFGG

SEQ ID NO: 6669 - protein, 109 aa, Panax ginseng
NSLPFEKSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6670 - protein, 110 aa, Medicago truncatula
FSNFLAKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6671 - protein, 110 aa, Helianthus annuus
KTHTKNKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6672 - protein, 109 aa, Triticum aestivum
RPRQPAMSGRGKGGKGLGKGGAKRHRKVLRDNIQGITKPAIRRLARRGGVKRVSGLIYEETRGVLKIFLENVIRDAVTYTEHARRKTVTAMDVVYALKRQGRTLYGFGG

SEQ ID NO: 6673 - protein, 108 aa, Solanum tuberosum
LLLLVMSGRGKGGKGLGKGGAKRHRKVLRDNIQGITKPAIRRLARRGGVKRISGLIYEETRGVLKVFLENVIRDAVTYTEHAKRKTVTAMDVVYALKRQGRTLYGFGG

SEQ ID NO: 6674 - protein, 104 aa, Unknown
  Sequence found in Organisms: Phaseolus coccineus, Pinus taeda
MSGRGKSGGKGLGKGGAKRHRKILRDNIQGITKPAIRRLARRGGVKRISGLIYEETRGVLKIFLENVIRDSVTYTEHAKRKTVTSLDVVYALKRQGRTLYGFGA

SEQ ID NO: 6675 - protein, 96 aa, Unknown
  Sequence found in Organisms: Artemisia annua, Allium cepa
GKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6676 - protein, 96 aa, Unknown
  Sequence found in Organisms: Artemisia annua, Orobanche aegyptiaca, Triphysaria pusilla, Zinnia violacea
MSGRGKGGKGLGKGGAKRHRKVLRDNIQGITKPAIRRLARRGGVKRISGLIYEETRGVLKIFLENVIRDAVTYTEHARRKTVTAMDVVYALKRQGR

SEQ ID NO: 6677 - protein, 65 aa, Artemisia annua
MSGRGKGGKGLGKGGAKRHRKVLRDNIQGITKPAIRRLARRGGVKRISGLIYEETRGVLKIFWRM

SEQ ID NO: 6678 - protein, 118 aa, Hordeum vulgare
PPPTTSQTHRSKGTAAVESGRGKGGKGLGKGGAKRHRKVLRDNIQGITKPAIRRLARRGGVKRISGLIYETRGVLKIFLENVIRDAVTYTEHARRKTVTAMDVVYALSTLYGFGGYQI

SEQ ID NO: 6679 - protein, 103 aa, Avena sativa
MTGRGKGGKGLGKGGAKRHRKILRDNIQGITKPAIRRLARRGGVKRISGLIYEETRGVLKVFLENVIRDAVTYTEHAKRKTVTSLDVVYALKRQGRTIYGFGG

SEQ ID NO: 6680 - protein, 103 aa, Hordeum vulgare
MSGRGEGGKGLRKGGAKRHRKVLRDNIQGITKPAIRRLAMRGGVKRICGLIYEETRGVLKILLENVIRDAVTYTEHARRKTVTAMDVVYALKRQGRTLYGLCG

SEQ ID NO: 6681 - protein, 103 aa, Theobroma cacao
  misc_feature (20)..(20): Xaa can be any naturally occurring amino acid
  misc_feature (27)..(27): Xaa can be any naturally occurring amino acid
  misc_feature (40)..(40): Xaa can be any naturally occurring amino acid
  misc_feature (76)..(76): Xaa can be any naturally occurring amino acid
  misc_feature (78)..(78): Xaa can be any naturally occurring amino acid
  misc_feature (94)..(94): Xaa can be any naturally occurring amino acid
MSGRGKGGKGLGKGGAKRHXKVLRDNXQGITKPAIRRLAXRGGVKRISGFIYEETRGVLKIFLENVIRDAVTYTEXAXRKTVTAMDVVYALKRXGRTLYGFGG

SEQ ID NO: 6682 - protein, 128 aa, Vigna unguiculata
GSSPLSHYSSQQPFSYFSFFNHSVNMSGRGKGGKGLGKGGAKRHRKILRDNIRGITKPAIRRLARRGGVKRISGLIYEETRGVLKIFLENVIRDSVTYTEHAKRKTVTALDVVYALKRSGRTLYGFGA

SEQ ID NO: 6683 - protein, 94 aa, Mesembryanthemum crystallinum
  misc_feature (30)..(30): Xaa can be any naturally occurring amino acid
RAAGLGTSVNLNLQISPSENVGPWKGRKGXWAKVAQSVTGKVLRDNIQGITKPAIRRLARRGGVKRINGLIYEETRRVLKIFLENVIRDAVTYT

SEQ ID NO: 6684 - protein, 130 aa, Zea mays
  misc_feature (43)..(43): Xaa can be any naturally occurring amino acid
QSPSTFPKNPPFSSRRGERERQGTGSDDVGARQGRQRSGQGRXKAPPEGLRDNIQGITKPAIRRLAWRGGVKRISGVIFEETRGVLKIFLEKVIRDAVTYTEHARRKTVTAMDVVFALKRQGRTLYGFGG

SEQ ID NO: 6685 - protein, 103 aa, Zea mays
MSGRGKGGKGLGKGGAKRHRKILRDNIQGITKPAIRRLARRGGVKRISGLIYEETRTVLKSFLEGVIRDAVTYTEHAKRKTVTSLDVVYALKRQGRTLYGFGG

SEQ ID NO: 6686 - protein, 82 aa, Zea mays
MSGRGKGGKGLGKGGAKRHRQVLRDNIQGIAKPAIRTLARRGGVKRILRAHLRGDPRRAQAPPRERHPRRPSPTPSTPAARL

SEQ ID NO: 6687 - protein, 195 aa, Zea mays
HKSSSSSSPSANSKSQRPNSRRCLAAATAGRVWARAAPSATARCCVTTIQGIHQAVPSAGWRGGAASSASPGSSTRRPAACSRSSSRTSSATPSPTPSTPAARLLTAMDVVYSLKSRGPHPLTVSAVRSPLSRWRITWWRWQSSCVLGPLSLCCLSPLLFPWWLDRTVPVSCPCAVKSPCSPQLYCSFFSVTKKK

SEQ ID NO: 6688 - protein, 99 aa, Zea mays
MSGRGKGGKGLGKGGAKRHRKVLRDNIQGITKPAIRRLARRGGVKRISGLIYEETRGVLKIFLENVIRDAVTYTEHARRKTVTAMDVFFFLKRQGRTLY

SEQ ID NO: 6689 - protein, 103 aa, Arachis hypogaea
MSGRGKGGKGLGKGGAKRHRKVLCDNIQGITKPAICRLACRGGVKRISGFIYEETRGVFKIFLENVIRDAVTYTEHARRKTVTAMDVVYAFKRQGRTFYGFGG

SEQ ID NO: 6690 - protein, 103 aa, Glycine max
MPGRGKGGKGLGKGGAKRHRKVLRNNIQGITKPAIRCLARRGGVKRISGLIYEETRGILKIFLENVIRDAVTYTEHARRKIVIAMDVVYALKRQGKTLYGFGG

SEQ ID NO: 6691 - protein, 63 aa, Saccharum officinarum
MSGLGNGGKGLGKGGAKRHRKVLRDNIQGITKPGIRRLARRGGVKRISGLIYEETRGVLKIFL

SEQ ID NO: 6692 - protein, 126 aa, Triticum aestivum
  misc_feature (94)..(94): Xaa can be any naturally occurring amino acid
  misc_feature (105)..(105): Xaa can be any naturally occurring amino acid
  misc_feature (111)..(111): Xaa can be any naturally occurring amino acid
SGRGKGGKGLGKGGAKRHRKVLRDNIQGITKPAIRRLARRGGVKRISGLIYEETRGVLKIFLRERHPRRRHLHGARPPQDRHRHGRPLRAQSAXGRTSTVPAAKXHFLPQXLAAPPQSTLRPACGP

SEQ ID NO: 6693 - protein, 99 aa, Triticum aestivum
AAGRKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6694 - protein, 111 aa, Raphanus sativus
SFGIYLGEMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6695 - protein, 111 aa, Triticum aestivum
VLLSNPAAMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6696 - protein, 111 aa, Triticum aestivum
THTHREAKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6697 - protein, 108 aa, Euphorbia esula
  misc_feature (37)..(37): Xaa can be any naturally occurring amino acid
  misc_feature (45)..(45): Xaa can be any naturally occurring amino acid
  misc_feature (56)..(56): Xaa can be any naturally occurring amino acid
GTRKKMSGRGKGGKGLGKGGAKRHRKVLRDNIQGITXPAIRRLAXRGGVKRISGLXYEETRGVLKIFLENVIRDAVTYTEHARRKTVTAMDVVYALKRQGRTLYGFGG

SEQ ID NO: 6698 - protein, 104 aa, Zea mays
MSGRGKSGGKGLGKGGAKRHRKILRDNIQGITKPAIRRLARRGGVKRISGLIYEETRGVLKIFLENVIRDSVTYTEHAKRKTVTSLDVVYALKRQGRTIYGFGA

SEQ ID NO: 6699 - protein, 132 aa, Ipomoea nil
YGRGRPHSEPLLALFCNLRLTLLFTSPHKMSGPGKGGKGLGKGGAKRHRKILRDNIQGITKPAIRRLARRGGVKRISGLIYEETRGVLKIFLENVIRDSVTYTEHAKRKTVTALGVVYALKRSGRTLYGFGA

SEQ ID NO: 6700 - protein, 89 aa, Zea mays
  misc_feature (43)..(43): Xaa can be any naturally occurring amino acid
  misc_feature (70)..(70): Xaa can be any naturally occurring amino acid
IQLTHRLTPPTASENLPIPSGLRGEDVGARQGREGPGQGRREXRKVLRDNIQGITKPAIRRLARRGGVNXSPGSSTRRAAASSRSSWRT

SEQ ID NO: 6701 - protein, 157 aa, Cucumis melo
  misc_feature (8)..(8): Xaa can be any naturally occurring amino acid
MSKKEKKXSSSLHSFLPPIPYLFKNPILQFCTVIIIKSHPKRIIYQSLQFSKLYFKTLVPNSARGGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6702 - protein, 103 aa, Ipomoea batatas
MSGPGKGGKGLGKGGAKRHRKILRDNIQGITKPAIRRLARRGGVKRISGLIYEETRGVLKIFLENVIRDSVTYTEHAKRKTVTALGVVYALKRSGRTLYGFGA

SEQ ID NO: 6703 - protein, 95 aa, Unknown
  Sequence found in Organisms: Salvia sclarea, Tragopogon dubius
MSGRGKGGKGLGKGGAKRHRKVLRDNIQGITKPAIRRLARRGGVKRISGLIYEETRGVLKIFLENVIRDAVTYTEHARRKTVTAMDVVYALKRQG

SEQ ID NO: 6704 - protein, 103 aa, Brassica rapa
MSGRGKGGKGLGKGGAKRHRKILRDNIQGITKPAIRRLARRGGVKRISAMIYEETRGVLKTFLEGVIRDAVTYTEHAKRKTVTSLDVVYALKRQGRTLYGFGG

SEQ ID NO: 6705 - protein, 103 aa, Hordeum vulgare
MTGRGKGGKGLGKGGAKRHRKVLRDNIQGITKPAIRRLARRGGVKRISAMIYEETRGVLKSFLEGVIRDAVTYTEHAKRKTVTSLDVVYALKRQGRTLYGFGG

SEQ ID NO: 6706 - protein, 103 aa, Theobroma cacao
MSGRGKGGKGLGKGGAKRHRKILRDNIQGITKPAIRRLARRGGVKRISAMIYEETRGVLKSFLEGVIRDAVTYTEHAKRKTVTSLDVVYALKRQGRTLYGFGG

SEQ ID NO: 6707 - protein, 103 aa, Saccharum officinarum
  misc_feature (4)..(4): Xaa can be any naturally occurring amino acid
  misc_feature (7)..(9): Xaa can be any naturally occurring amino acid
  misc_feature (14)..(14): Xaa can be any naturally occurring amino acid
  misc_feature (16)..(16): Xaa can be any naturally occurring amino acid
  misc_feature (25)..(25): Xaa can be any naturally occurring amino acid
  misc_feature (42)..(42): Xaa can be any naturally occurring amino acid
MSGXGKXXXGLGKXGXKRHRKVLRXNIQGITKPAIRRLARRXGVKRISGLIYEETRGVLKIFLENVIRDAVTYTEHARRKTVTAMDVVYALKRQGRTLYGFGG

SEQ ID NO: 6708 - protein, 112 aa, Gossypium hirsutum
SLNFGWISKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6709 - protein, 112 aa, Taraxacum officinale
FNSFPKKKKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6710 - protein, 112 aa, Raphanus sativus
FFLLILCEKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6711 - protein, 111 aa, Solanum lycopersicum
LLYNFIRKMSGRGKGGKGLGKGGAKRHRKVLRDNIQGITKPAIRRLARRGGVKRISGLIYEETRGVLKIFLENVIRDSVTYTEHARRKTVTAMDVVYALKRQGRTLYGFGG

SEQ ID NO: 6712 - protein, 111 aa, Triticum aestivum
  misc_feature (49)..(49): Xaa can be any naturally occurring amino acid
SSFRWELSMSGRGKGGKGLGKGGAKRHRKVLRDNIQGITKPAIRRLARXGGVKRISGLIYEETRGVLKIFLENVIRDAVTYTEHARRKTVTAMDVVYALKRQGRTLYGFGG

SEQ ID NO: 6713 - protein, 94 aa, Unknown
  Sequence found in Organisms: Artemisia annua, Bruguiera gymnorhiza
MSGRGKGGKGLGKGGAKRHRKVLRDNIQGITKPAIRRLARRGGVKRISGLIYEETRGVLKIFLENVIRDAVTYTEHARRKTVTAMDVVYALKRQ

SEQ ID NO: 6714 - protein, 103 aa, Brassica napus
MTGRGKGGKGLGKGGAKRHRKILRDNIQGITKPAIRRLARRGGVKRISAMIYEETRGVLKAFLEGVIRDAVTYTEHAKRKTVTSLDVVYALKRQGRTLYGFGG

SEQ ID NO: 6715 - protein, 102 aa, Heritiera littoralis
VRPWEGWQGLGKGGTKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6716 - protein, 103 aa, Unknown
  Sequence found in Organisms: Hordeum vulgare, Avena sativa, Picea glauca, Saccharum officinarum, Triticum aestivum
MTGRGKGGKGLGKGGAKRHRKILRDNIQGITKPAIRRLARRGGVKRISAMIYEETRGVLKTFLEGVIRDAVTYTEHAKRKTVTSLDVVYALKRQGRTLYGFGG

SEQ ID NO: 6717 - protein, 94 aa, Adiantum capillus-veneris
GLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6718 - protein, 103 aa, Zea mays
MSGRGKGGKGLGKGGAKRHGKILRDNIQGITKPAIRRPARRGGVKRISGLIYEETRTVLKSFLEGVIRDAVTYTEHAKRKTVTSLDVVYALKRQGRTLYGFGG

SEQ ID NO: 6719 - protein, 103 aa, Zea mays
MSGRGKGGKGLGKGGAKRHRKVLRDNIQSITKQAIRTLARRGGVKRISGLIYQDTRGVLKIFHENVIRDAVTYTEHARRKTVTAMDVVYSLERQGRTLYSFGG

SEQ ID NO: 6720 - protein, 103 aa, Zea mays
MSGRGKGGKGLGKGGAKRHRKVLRDNIQGITKPAIRKLARRGGVKHISGLIYEETRGVLKIFLENVIHDAVTYTEHARHKTVTAMDVVYTLNRQGRTLYCFFC

SEQ ID NO: 6721 - protein, 103 aa, Picea glauca
MTGRGKGGKGLGKGGAKRHRKILRDNIQGITKPAIRRLARRGGVKRISAMIYEETRGVLKTFLESVIRDAVTYTEHAKRKTVTSLDVVYALKRQGRTLYGFGG

SEQ ID NO: 6722 - protein, 103 aa, Picea glauca
MTGRGKGGKGLGKGGAKRHRKILRDNIQGITKPAIRRLARRGGVKRISAMIYEETRGVLKSFLESVIRDAVTYTEHAKRKTVTSLDVVYALKRQGRTLYGFGG

SEQ ID NO: 6723 - protein, 103 aa, Unknown
  Sequence found in Organisms: Picea glauca, Tamarix hispida
MTGRGKGGKGLGKGGAKRHRKILRDNIQGITKPAIRRLARRGGVKRISAMIYEETRGVLKSFLEGVIRDAVTYTEHAKRKTVTSLDVVYALKRQGRTLYGFGG

SEQ ID NO: 6724 - protein, 103 aa, Saccharum officinarum
MSGRGKGGKGLGKGSTKRHRKVLRDNMQGITKPAIRMLARRGGVKRISGLIYEETRGVLKIFLENVIRDAVNYTEHARRKTVTGMDVVYALKRQGRTLYSYSG

SEQ ID NO: 6725 - protein, 384 aa, Hordeum vulgare
TSSCPFLPPPLSSPFAFPHDDLLDLYLPADPFFLPPPPPFPAPTPHAFLLHDLTDRVAALELAARAAAPQPARRKYTYAAASPGGRKVKWTAEDKPRGGGRSLKWEAELASPNDDGFDRKWKWEAKSKPGAGGKTKTKWGTEIKGKGSLEPWSHAYTWEEDFSASDDDEDADYPEERRRPEQKKEPKKIKAAAKEEKKPARKSVHIEEIPEDNTAGCDAIRKAFAMGNGKGKAKELSPQDAALLIQMNYRAHLAHRSQVLRCLRDLAVAKAKLKELRSLFYNLSYRRRLSHDHEERQRFSEKIIVLLLTVDALEGPDFMVRTAKKSMLEELESMLEIVDPQPPGKQRSFSRRKFDLPEGGAIPNEKTAGVNNAVRVINTGKGKQ

SEQ ID NO: 6726 - protein, 109 aa, Camellia sinensis
RIIQLNFTRNVGRGRRKVGREEREARKVLRDNIQGITKPAIRRLARRGGVKRISGLIYEETRGVLKIFLENVIRDAVTYTEHARRKTVTAMDVVYALKRQGRTLYGFGG

SEQ ID NO: 6727 - protein, 81 aa, Hordeum vulgare
MSGRGKGGKGLGKGGAKRHRKVLRDNIQGITKPAIRRLARRGGVKRISGLIYEETRGVLKIFLKNVFRNAVTYTEHARRKT

SEQ ID NO: 6728 - protein, 78 aa, Taraxacum officinale
MCEAYHRFDLRGNSRSFEDLSRQCHHRRRSLHRARTPENCRRHGCGVCAQETRPNSVRIQWIRCLSRKSELVKYLSYF

SEQ ID NO: 6729 - protein, 77 aa, Arachis hypogaea
GIGHYGRGIISILLYGGLVNLTSAERKLVAMSGRGKGGKGLLTGGAKRHRKVLRDNIQGMREARHSPSRKAWWCQAY

SEQ ID NO: 6730 - protein, 139 aa, Picea glauca
TRQHLIRHYYYYSTSKASSFTTNTLNSLHFSHPSINMTGRGKGGKGLGKGGAKRHRKILRDNIQGITKPAIRRLARRGGVKRISAMIYEETRGVLKSFLESVIRDAVTYTEHAKRKTVTSLDVVYALKRQGRTLYGFGG

SEQ ID NO: 6731 - protein, 115 aa, Helianthus annuus
AGIIQTTPFTHSIQFLERETMSGRGKGGKGLGKGGAKRHRKVLRDNIQGITKPAIRRLARRGVVKRISGLIYEETRGVLKIFLENVIRDAVTYTEHARRKTVTAMDVVYALKRQG

SEQ ID NO: 6732 - protein, 217 aa, Volvox carteri
MAGRGKGKTAGKKAVSRSAKAGLQFPVGRIARYLKKGKYAERIGAGAPVYLAAVLEYLTAEVLELAGNAARDNKKNRIVPRHIQLAIRNDEELGKLLGDVTIASGGVLPNIHAVLLPKKSGGKGLGKGGAKRHRKVLRDNIQGITKPAIRRLARRGGVKRISGLIYEETRTVLKNFLENVIRDSVTYTEHARRKTVTAMDVVYALKRQGRTLYGFGG

SEQ ID NO: 6733 - protein, 125 aa, Triticum aestivum
  misc_feature (17)..(17): Xaa can be any naturally occurring amino acid
  misc_feature (60)..(60): Xaa can be any naturally occurring amino acid
  misc_feature (70)..(70): Xaa can be any naturally occurring amino acid
  misc_feature (83)..(83): Xaa can be any naturally occurring amino acid
  misc_feature (91)..(91): Xaa can be any naturally occurring amino acid
  misc_feature (93)..(93): Xaa can be any naturally occurring amino acid
  misc_feature (109)..(109): Xaa can be any naturally occurring amino acid
  misc_feature (112)..(112): Xaa can be any naturally occurring amino acid
  misc_feature (119)..(119): Xaa can be any naturally occurring amino acid
  misc_feature (123)..(123): Xaa can be any naturally occurring amino acid
MSGRGKGGKGLGKGGAXRHRKVLRDNIQGITKPAIRRLARRGGVKRISGLIYEETRGVLXIFLENVIRDXRHLHRARPSQDRXRHGRRVRXQXPGPHPLRSFGRAERHXAPXGVDPGCXLAVXSG

SEQ ID NO: 6734 - protein, 128 aa, Triticum aestivum
  misc_feature (4)..(4): Xaa can be any naturally occurring amino acid
TTTXQPHQLHQTTTSHFHKPPTSINMTGRGKGGKGLGKGGAKRHRKILRDNIQGITKPAIRRLARRGGVKRISAMIYEETRGVLKTFLEGVIRDAVTYTEHAKRKTVTSLDVVYALKRQGRTLYGFGG

SEQ ID NO: 6735 - protein, 133 aa, Triticum aestivum
GDNTKQLFSLNTTNNYPHHTSSSQTPPHFNMTGRGKGGKGLGKGGAKRHRKILRDNIQGITKPAIRRLARRGGVKRISAMIYEETRGVLKTFLEGVIRDAVTYTEHAKRKTVTSLDVVYALKRQGRTLYGFGG

SEQ ID NO: 6736 - protein, 113 aa, Brassica juncea
  misc_feature (104)..(104): Xaa can be any naturally occurring amino acid
MSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGGXFRWFQFQIL

SEQ ID NO: 6737 - protein, 113 aa, Beta vulgaris
ARGKNKRREKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6738 - protein, 113 aa, Manihot esculenta
SLALISINEKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6739 - protein, 113 aa, Cucumis melo
FLHYFKSIKKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6740 - protein, 113 aa, Fragaria vesca
KDPNSKTESKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6741 - protein, 113 aa, Helianthus annuus
AGKPKFTTNTMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6742 - protein, 113 aa, Helianthus annuus
HASANLQSAIMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6743 - protein, 113 aa, Helianthus annuus
NKNTTKKSNTMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6744 - protein, 112 aa, Beta vulgaris
  misc_feature (57)..(57): Xaa can be any naturally occurring amino acid
KTEQKRREKMSGRGKGGKGLGKGGAKRHRKVLRDNIQGITKPAIRRLARRGGVKRIXGLIYEETRGVLKIFLENVIRDAVTYTEHARRKTVTAMDVVYALKRQGRTLYGFGG

SEQ ID NO: 6745 - protein, 112 aa, Picea glauca
FWLSAEKERMSGRGKGGKGLGKGGAKRHRKVLRDNIQGITKPAIRRLARRGGVKRISGLIYEETRGVLKIFLENVIRDAVTYTEHARRKTVTAMDVVYSLKRQGRTLYGFGG

SEQ ID NO: 6746 - protein, 111 aa, Solanum tuberosum
  misc_feature (20)..(20): Xaa can be any naturally occurring amino acid
CTRKTSQKMSGRGKGGKGLXKGGAKRHRKVLRDNIQGITKPAIRRLARRGGVKRISGLIYEETRGVLKIFLENVIRDSVTYTEHARRKTVTAMDVVYALKRQGRTLYGFGG

SEQ ID NO: 6747 - protein, 110 aa, Volvox carteri
FISHQVTMSGRGKGGKGLGKGGAKRHRKVLRDNIQGITKPAIRRLARRGGVKRISGLIYEETRTVLKNFLENVIRDSVTYTEHARRKTVTAMDVVYALKRQGRTLYGFGG

SEQ ID NO: 6748 - protein, 107 aa, Avena sativa
MSTVTGGRGKGGKGLGKGGAKRHRKVFRDNIQGITKPAIRRLARRGGVKRISGLIYEETRTVLKSFLENVIRDAVTYTEHARRKTVTSMDVVYALKRQGRTLYGFGG

SEQ ID NO: 6749 - protein, 114 aa, Brassica rapa
NHLNFPRKFKKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6750 - protein, 114 aa, Taraxacum officinale
TDPFLENKSEKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6751 - protein, 114 aa, Elaeis guineensis
LLSSYSFSIDAMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6752 - protein, 114 aa, Triticum aestivum
NSICPELQAAVMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6753 - protein, 114 aa, Triticum aestivum
QIPQRRPQRPAMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6754 - protein, 86 aa, Triticum aestivum
  misc_feature (1)..(1): Xaa can be any naturally occurring amino acid
XHFICPLPPNLKLLNKLTSSQNVWTVVKAVEKASERAGVNVTVRFYETTFKGITKPAIRRLARRGGVKAYLWPDLRGDPRCSKDFP

SEQ ID NO: 6755 - protein, 94 aa, Artemisia annua
MSGRGKGGKGLGKGGAKRHRKVLRDNIQGITKPAIRRLARRGGVKRISGLIYEETRGVLKIFLENVIRDAVTYTEHARRKTVTVMDVVYALKRQ

SEQ ID NO: 6756 - protein, 93 aa, Unknown
  Sequence found in Organisms: Brassica napus, Eschscholzia californica
LGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6757 - protein, 103 aa, Hordeum vulgare
MTGRGKGGKGLSKGGAKRHRKILRDNIQGITKPGIRRLARRGGVKRISAMIYEETRGVLKIFLEGVIRDAVTYTEHAKRKTVTSLDVVYALKRQGRTLYGFGG

SEQ ID NO: 6758 - protein, 103 aa, Theobroma cacao
MSGRGKGGKGLGKGGSKRHRKVLRDNIQGITKPAIRRLARRGGVKRIFGLIYEEVRTVLKSFLESVIKDAVTYTEHAKRKTVTSLDVVYALKRQGRTLYGFGG

SEQ ID NO: 6759 - protein, 103 aa, Cucumis melo
MTGRGKGGKGLGKGGAKRHRKILRDNIQGITKPAIRRLARRGGVKRISAMIYEETRGVLKSFLEGVIRDAVTYTEHAKRKTVTSLDVIYALKRQGRTLYGFGG

SEQ ID NO: 6760 - protein, 96 aa, Carica papaya
MSGRGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6761 - protein, 113 aa, Solanum tuberosum
AFLLKNFFRKMSGRGKGGKGLGKGGAKRHRKVLRDNIQGITKPAIRRLARRGGVKRISGLIYEETRGVLKIFLENVIRDSVTYTEHARRKTVTAMDVVYALKRQGRTLYGFGG

SEQ ID NO: 6762 - protein, 94 aa, Picea glauca
GLGKGGAKRHRKVLRDNIQGITKPAIRRLARRGGVKRISGLIYEETRGVLKIFLENVIRDAVTYTEHARRKTVTAMDVVYSLKRQGRTLYGFGG

SEQ ID NO: 6763 - protein, 97 aa, Helianthus annuus
MCGRGKGGKGLGKGGAKRHRKVLRDNIQGITKPAIRRLARRGGVKRISGLIYEETRGVLKIFLENVIGDAVTYTEHARRKTVAAMDVVYAWKRQGRT

SEQ ID NO: 6764 - protein, 111 aa, Helianthus annuus
  misc_feature (18)..(19): Xaa can be any naturally occurring amino acid
  misc_feature (40)..(40): Xaa can be any naturally occurring amino acid
LNNLQSAIMSGRGKGGKXXGKGGAKRHRKVLRDNIQGITXPAIRRLARRGGVKRISGLIYEETRGVLKIFLENVIRDAVTYTEHARRKTVTAMDVVYALKRQGRTLYGFGG

SEQ ID NO: 6765 - protein, 115 aa, Artemisia annua
MSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGGWVCLGLGFKSCC

SEQ ID NO: 6766 - protein, 115 aa, Arabidopsis thaliana
KTQILKLSGKTKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6767 - protein, 115 aa, Vigna unguiculata
SSVSEKKEKSSAMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6768 - protein, 115 aa, Festuca arundinacea
QILHQPPPTSATMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6769 - protein, 115 aa, Lactuca sativa
NEINFISRDKKKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6770 - protein, 115 aa, Lactuca sativa
TKTKTREISVYEMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6771 - protein, 115 aa, Lactuca sativa
TKIKFISIDKKKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6772 - protein, 115 aa, Medicago truncatula
PKFKVFQKSRLKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6773 - protein, 115 aa, Triticum aestivum
AVKRSSPEREAKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6774 - protein, 150 aa, Triphysaria pusilla
  misc_feature (125)..(125): Xaa can be any naturally occurring amino acid
MEATPKAKKGAAGRKAGGPKKKSVSRSVKAGLQFPVGRIGRFLKKGRYSQRVGSGAPVYMAAVLEYLAAEVLELAGNAARDNKKSRIIPRHLLLAVRNDEELGKLLAGVTIAHGGVIPNINPVLXPKKSDKVAEKAPKSPSKATKSPRKA

SEQ ID NO: 6775 - protein, 114 aa, Solanum tuberosum
ETSSSSNFSVKMSGRGKGGKGLGKGGAKRHRKVLRDNIQGITKPAIRRLARRGGVKRISGLIYEETRGVLKIFLENVIRDSVTYTEHARRKTVTAMDVVYALKRQGRTLYGFGG

SEQ ID NO: 6776 - protein, 114 aa, Pseudoroegneria spicata
  misc_feature (11)..(12): Xaa can be any naturally occurring amino acid
SSAARRGSSAXXSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6777 - protein, 114 aa, Triticum aestivum
VSISVSSKPSTMSGRGKGGKGLGKGGAKRHRKVLRDNIQGITKPAIRRLARRGGVKRISGLIYEETRGVLKIFLENVIRDAVTYTEHAHRKTVTAMDVVYALKRQGRTLYGFGG

SEQ ID NO: 6778 - protein, 98 aa, Eucalyptus gunnii
GERTSLEKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6779 - protein, 133 aa, Hordeum vulgare
MARTKQTARKSTGGKAPRKQLATKAARKSAPATGGAAPLPPRHRRAPGDPQVPEEHGAAHPQAPLPAPGAGDRAGLQDRPPLPELRRLRAPGGRRGLPRRPLRGHQPLRHPRQARHHHAQGHPARPPHPWREG

SEQ ID NO: 6780 - protein, 73 aa, Solanum phureja
MKLHNLLIIDFSISLFESLFFVFFKVITEIMYIETLKLNPPRCNSISPIRYILIYVRWMYKCRCISFVLISRC

SEQ ID NO: 6781 - protein, 126 aa, Triticum aestivum
  misc_feature (116)..(116): Xaa can be any naturally occurring amino acid
  misc_feature (118)..(118): Xaa can be any naturally occurring amino acid
VPLQIHPIQSARSQLQGRRKPSTMSGRGKGGKGLGKGGAKRHRKVLRDNIQGITKPAIRRLARRGGVKRISGLIYEETRGVLKIFPGRTHPATPSPTPSTPARKTVTAMDFVYPSXRXAAPSTVRR

SEQ ID NO: 6782 - protein, 120 aa, Hordeum vulgare
LQSHPRSSRAIQRASPAVSGRGKGGKGLGKGGAKRHRKVLRDNIQGITKPAIRRLARRGGVKRISGLIYEETRGVLKIFLENVIRNAVTYTDHARRKTVPAMDVLYTLNRHGYTVYGKGG

SEQ ID NO: 6783 - protein, 130 aa, Hordeum vulgare
PITIIERLCASIPSLTQPTKHSPHLQHDWTRGKGGKGLGKGGAKRHRKILRDNIQGITKPAIRRLARRGGVKRISAMIYEETRGVLKSFLEGVIRDAVTYTEHAKRKTVTSLDVVYALKRQGRTLYGFGG

SEQ ID NO: 6784 - protein, 83 aa, Lactuca sativa
MVLRDNIEGIIKPAIHRLVRRGDVKRISGLIYEETRGVLKIFLENVICDAVTYTEHARRKTVTAMDVVYALKRQGRTLYGFGG

SEQ ID NO: 6785 - protein, 133 aa, Zea mays
EQILFLEVSSTKFKVNGAKLSARSGLGKGGKGLGKGGAKRHRKVLRDNIQGITKPAILTLARGGELKRISGLIYDETRGVLKIFLENVIRDAITYTEHARRKTVTAMDVVYALKRQGCTLYGFRGQVAPLPVA

SEQ ID NO: 6786 - protein, 108 aa, Fragaria vesca
  misc_feature (45)..(47): Xaa can be any naturally occurring amino acid
  misc_feature (49)..(52): Xaa can be any naturally occurring amino acid
  misc_feature (58)..(58): Xaa can be any naturally occurring amino acid
  misc_feature (61)..(61): Xaa can be any naturally occurring amino acid
  misc_feature (69)..(69): Xaa can be any naturally occurring amino acid
  misc_feature (77)..(78): Xaa can be any naturally occurring amino acid
NSPVKNVRARQGRQGIGQRRSQASQEGSPGQHPGHHQARHSPFGXXXRXXXXSGLIYXETXGVLKIFLXNVIRDAVXXTEHARRKTVTAMDVVYALKRQGRTLYGFGG

SEQ ID NO: 6787 - protein, 108 aa, Triphysaria pusilla
FPITANKFQKKKMSGRGKGGKGLGKGGAKRHRKVLRDNIQGITKPAIRRLARRGGVKRISGLIYEETRGVLKIFLENVIRDAVTYTEHARRKMVFQVGRCICSQEARP

SEQ ID NO: 6788 - protein, 125 aa, Triticum aestivum
  misc_feature (113)..(113): Xaa can be any naturally occurring amino acid
QRQGQPHRGEEGRSEKMSGRGKGGKGLGKGGAKRHRKVLRDNIQGITKPAIRRLARRGGVKRISGLIYEEDPRRCSRSSSRILFFISSPTPSTPAARPSPPWTSLSPQSAKEXTSTDSGGKPPPN

SEQ ID NO: 6789 - protein, 92 aa, Artemisia annua
MSGRGKGGKGLGKGGAKRHRKVLRDNIQGITKPAIRRLARRGGVKRISGLIYEETRGVLKIFLENVIRDAVTYTEHARRKTVTAMDVVYALK

SEQ ID NO: 6790 - protein, 93 aa, Hordeum vulgare
KGGKGLGKGGAKRHRKVLRDNIQGITKPAIRRLARRGGVKRISGLIYETRGVLKIFLENVIRDAVTYTEHARRKTVTAMDVVYALSTLYGFGG

SEQ ID NO: 6791 - protein, 103 aa, Malus domestica
MTGRGKGGMGLGKGGAKPHRKVLRDNIQGITKPAIRRLALIGGVKRITGLIYEETRGVLKIFLENVILDAVTYTEHAMRNTVTAMDVVYALNRQGMTLYGFGG

SEQ ID NO: 6792 - protein, 103 aa, Phaseolus coccineus
MSGRGKGGKGLGKGGAKRPRKVFRDNIQGITKPPIRRLPRRGGVKRISGLIYEEPRGVLKFFLENVIRDAVTSTDHVRRKTVTAMDVVYPLKSQGRTLYGFGG

SEQ ID NO: 6793 - protein, 94 aa, Festuca arundinacea
ARGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6794 - protein, 111 aa, Avena sativa
PISTCSSPSSSGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGLC

SEQ ID NO: 6795 - protein, 110 aa, Medicago truncatula
MSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLMVSAVRRLLLLE

SEQ ID NO: 6796 - protein, 305 aa, Lactuca sativa
MAAARPLVTVQSLESDMATDSAGIPLPQVMKASIRPDIVNFVHSNISKNSRQPYAVSRKAGHQTSAESWGTGRAVSRIPRVPGGGTHRAGQGAFGNMCRGGRMFAPTRIWRRWHRKINVNQKRYAVVSAIAASAVPSLVMARGHRIESVPELPLVVSDSAEGVEKTQNAIKVLKQIGAYADAEKAKDSVGIRPGKGKMRNRRYISRKGPLIVYGTEGAKLVKAFRNIPGVEIANVERLNLLKLAPGGHLGRFIIWTKSAFEKLDSIYGSFDKTSEKKRGYVLPRAKMENADLARIINSDEVQSVV

SEQ ID NO: 6797 - protein, 116 aa, Brassica juncea
RGNHLNFPRKFKKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6798 - protein, 116 aa, Gossypium hirsutum
HEFGREKKKEGTKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6799 - protein, 116 aa, Festuca arundinacea
GTRQPHKSTSPEKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6800 - protein, 116 aa, Lactuca sativa
TTKKIKSIYEEKNMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6801 - protein, 116 aa, Medicago truncatula
GISSQSQREKLKAMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6802 - protein, 116 aa, Secale cereale
PLLPNHIPRRGAAMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6803 - protein, 116 aa, Secale cereale
SQHHRRKKERSEKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6804 - protein, 116 aa, Helianthus annuus
  misc_feature (2)..(2): Xaa can be any naturally occurring amino acid
IXPGTTHYSNPNTMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6805 - protein, 116 aa, Triphysaria pusilla
SNQNSFYNFCRTKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6806 - protein, 115 aa, Raphanus sativus
FSAPNFLNRKIKMSGRGKGGKGLGKGGAKRHRKVLRDNIQGITKPAIRRLARRGGVKRISGLIYEETRGVLKIFLENVIRDAVTCTEHARRKTVTAMDVVYALKRQGRTLYGFGG

SEQ ID NO: 6807 - protein, 115 aa, Picea glauca
LFIIWFIAEKGRMSGRGKGGKGLGKGGAKRHRKVLRDNIQGITKPAIRRLARRGGVKRISGLIYEETRGVLKIFLENVIRDAVTYTEHARRKTVTAMDVVYSLKRQGRTLYGFGG

SEQ ID NO: 6808 - protein, 115 aa, Solanum lycopersicum
LETTSSSNFSVKMSGRGKGGKGLGKGGAKRHRKVLRDNIQGITKPAIRRLARRGGVKRISGLIYEETRGVLKIFLENVIRDSVTYTEHARRKTVTAMDVVYALKRQGRTLYGFGG

SEQ ID NO: 6809 - protein, 105 aa, Artemisia annua
MSGRGKGGKGLGKGGAKRHRKVLRDNIQGITKPAIRRLARRGGVKRISGLIYEETRGVLKIFLENVIRDAVTYTEHARRKTVTAMDVVYVLKKARQDSLWFWGLI

SEQ ID NO: 6810 - protein, 113 aa, Helianthus annuus
  misc_feature (51)..(51): Xaa can be any naturally occurring amino acid
  misc_feature (63)..(63): Xaa can be any naturally occurring amino acid
  misc_feature (78)..(78): Xaa can be any naturally occurring amino acid
QSQSQFHFTTMSGRGKGGKGLGKGGAKRHRKVLRDNIQGITKPAIRRLARXGGVKRISGLIYXETRGVLKIFLENVIXDAVTYTEHARRKTVTAMDVVYALKRQGRTLYGFGG

SEQ ID NO: 6811 - protein, 104 aa, Triticum aestivum
MSGRGKGGKGLGKGGAKRHRKVLRDNIQGITKPAIRRLARRGGVKRISGLIYEETRGVLKIFLENVIRDAVTYTEHARRKTVTGHGLRLRPQSAKGRTLYGFGG

SEQ ID NO: 6812 - protein, 118 aa, Hordeum vulgare
MSGRGKGGKGLGKGGAKRHRKVLRDNIQGITKPAIRRLARRGGVKRISGLIYEETRGVLKIFLENVIHDTDTYTEHAHRKTGTAMDVEYTLKRHGQTLYRLSGYGLKALSRLQSPAPF

SEQ ID NO: 6813 - protein, 124 aa, Hordeum vulgare
APPPLPGPTPANPTGQTDRTRGGVGEDVRERQGRQRAGERLNRTPPESAARQHPGDHEAGDPAAGAAGRRESHLRAHLRRDPRRAQDLPRERHPRRRHLHRARPPQDRHRHGRRLRAQAPRPHP

SEQ ID NO: 6814 - protein, 141 aa, Hordeum vulgare
GGVALTGEKRDDVAPWKGRQGARQGRRQAPPVGAPEQHSGHHQAGHPWSRAQGRRQAHLGAHLRGDPRRAQNLTRERHPRRRHLHRARPPQDRHRHGRRLRTQAPGAHPLRTWTLGHQPNPESFSGCGRWCNSSISFAGAV

SEQ ID NO: 6815 - protein, 51 aa, Theobroma cacao
MSVRGKGGKGLGKGGAKRHRRVLRDDIRGISKPAIGRLVRRGGVKRFSGLF

SEQ ID NO: 6816 - protein, 122 aa, Zea mays
MSGHGKGGKGLGKGGAKRHSEVLRDNIQSITKPAILTLARRGGVKRISGLIYEETRGVLQDLPRERHPRRRRLHRARSPQDRHRRGCRLRSQAPGPASSTASAAKPPPLLMIRYDGRGRSCV

SEQ ID NO: 6817 - protein, 122 aa, Zea mays
MFLLRTRSSTFPPRPGAPRAARGMGKGRAKRRRKVLHDNIQGISKPAHPSAGQQGRRQAHFWAHLRGNPRRAQDLPRERHPPRRHLHRARPPQDCHRHGCRLHAQAPGPDALRLRLLRRLPF

SEQ ID NO: 6818 - protein, 52 aa, Saccharum officinarum
MSGRGKGGKGLGKGGAKRHQKVLRDNIHGITKPAIRRLALRGGVKRISGLIY

SEQ ID NO: 6819 - protein, 126 aa, Saccharum officinarum
  misc_feature (23)..(23): Xaa can be any naturally occurring amino acid
  misc_feature (32)..(33): Xaa can be any naturally occurring amino acid
  misc_feature (37)..(39): Xaa can be any naturally occurring amino acid
  misc_feature (41)..(41): Xaa can be any naturally occurring amino acid
  misc_feature (44)..(44): Xaa can be any naturally occurring amino acid
  misc_feature (46)..(46): Xaa can be any naturally occurring amino acid
  misc_feature (48)..(51): Xaa can be any naturally occurring amino acid
  misc_feature (53)..(54): Xaa can be any naturally occurring amino acid
  misc_feature (63)..(64): Xaa can be any naturally occurring amino acid
  misc_feature (117)..(117): Xaa can be any naturally occurring amino acid
ANSNPTIFVAHTTVTRVFFPLRXRCLGAARAXXGWQXXXEXPPXGXPXXXXGXXKPAIRRLAXXGGVKRISGLIYEETRGVLKIFLENVIRDAVTYTEHARRKTVTAMDVVYALKRXGRTLYGFGG

SEQ ID NO: 6820 - protein, 58 aa, Saccharum officinarum
MDVVYALKRQGRTLYGFCGYARPAPYLRSGVISGSWSPFGAVVNCYGLVPTVVCRLVV

SEQ ID NO: 6821 - protein, 105 aa, Triticum aestivum
  misc_feature (6)..(6): Xaa can be any naturally occurring amino acid
SQSRRXKEASTMSGRGKGGKGLGKGGAKRHRKVLRDNIQGITKPAIRRLARRGGVKRISGLIYEETRGVLKIFLENVIRDAVTYTEHARRKTVTAMDVVYARFTS

SEQ ID NO: 6822 - protein, 129 aa, Triticum aestivum
  misc_feature (119)..(120): Xaa can be any naturally occurring amino acid
KDKSTSPRRREEKRSEKMSGRGKGGKGLGKGGAKRHRKVLRDNIQGITKPAIRRLAKEGRREAHLGAHLRGDPRRAQDLPRERHPRRRHLHRHPPARPHRHGLLYLSNAKDAPSTVPEXXRTTTRLGLP

SEQ ID NO: 6823 - protein, 54 aa, Triticum aestivum
MIYEETRGVLKSFLEGVIRDAVTYTEHAKRKTVTSLDVVYALKRQGRTLYGFGG

SEQ ID NO: 6824 - protein, 103 aa, Hordeum vulgare
MTGRGKGGKGLSKGGAKRHRKILRDNIQGITKRGIRRLARRGGVKRISAMIYEETRGVLKTFLEGVIRDAVTYTEHAKRKTVTSLDVVYALKRQGRTLYGFGG

SEQ ID NO: 6825 - protein, 99 aa, Hordeum vulgare
GKGGKGLGKGGAKRHRKILRDNIQGITKPAIRRLARRGGVKRISAMIYEETRGVLKTFLEGVIRDAVTYTEHAKRKTVTSLDVVYALKRQGRTLYGFGG

SEQ ID NO: 6826 - protein, 91 aa, Manihot esculenta
MSGRGKGGKGLGKGGAKRHRKVLRDNIQGITKPAIRRLARRGGVKRISGLIYEETRGVLKIFLENVIRDAVTYTEHARRKTVTAMDVVYAL

SEQ ID NO: 6827 - protein, 101 aa, Cenchrus ciliaris
GRGKGGKGLGKGGAKRHRKVLRDNIQGITKPAIRRLARRGGLKRFSGFIYGGGGGVIKIFLENVIRDAVTYTEHARRKTVTPMDVVYALKRQGRPLYGFGG

SEQ ID NO: 6828 - protein, 91 aa, Eucalyptus gunnii
KGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6829 - protein, 92 aa, Prunus persica
AKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6830 - protein, 117 aa, Persea americana
RERRREEERAKKAEMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6831 - protein, 117 aa, Brassica rapa
SLQNSLLHSKAKKKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6832 - protein, 117 aa, Vigna unguiculata
DRECCCHRDFARKKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6833 - protein, 117 aa, Festuca arundinacea
HEEEIPLFSEGAAAMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6834 - protein, 117 aa, Festuca arundinacea
GTRQPHKSTSPEKKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6835 - protein, 117 aa, Zingiber officinale
ARGPNRLQLRIRSIMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6836 - protein, 117 aa, Lactuca sativa
GIVLAYTENINTNKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6837 - protein, 117 aa, Medicago truncatula
PNFIFLFSNFHLLKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6838 - protein, 117 aa, Raphanus sativus
TTTENLLYFLKGKKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6839 - protein, 117 aa, Helianthus annuus
PQINTLSNRNLTATMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6840 - protein, 117 aa, Helianthus annuus
NHSYYNKILLLEPTMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6841 - protein, 117 aa, Triticum aestivum
IRHEHPSSQSHSTAMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6842 - protein, 117 aa, Triticum aestivum
TTSSNTPPHRGQAKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6843 - protein, 117 aa, Triticum aestivum
RSSSISISVSSKEAMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6844 - protein, 117 aa, Triticum aestivum
RQVNLPAEKKGEAKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6845 - protein, 117 aa, Triticum aestivum
LQSHLRSSQLASPAMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6846 - protein, 160 aa, Triticum aestivum
  misc_feature (108)..(108): Xaa can be any naturally occurring amino acid
  misc_feature (115)..(115): Xaa can be any naturally occurring amino acid
  misc_feature (117)..(117): Xaa can be any naturally occurring amino acid
  misc_feature (123)..(123): Xaa can be any naturally occurring amino acid
  misc_feature (141)..(141): Xaa can be any naturally occurring amino acid
SSGSTSARSSRSAAMSGRGKGGKGLGKGGAKRHRKVLRDNIQGITKPAIRRLARRGGVKRISGAHLRGDPAACSRSSSRTSSATPSPTPSTPRPQRPSPPWTPLRLKXQRGTSYXSXGKPADXPFSLAACRFQNLMDPTVXSLSCVLHCLLGTNLSAKKK

SEQ ID NO: 6847 - protein, 90 aa, Artemisia annua
MSGRGKGGKGLGKGGAKRHRKVLRDNIQGITKPAIRRLARRGGVKRISGLIYEETRGVLKIFLENVIRDAVTYTEHARRKTVTAMDVVYA

SEQ ID NO: 6848 - protein, 91 aa, Actinidia deliciosa
MSGRGKGGKGLGKGGANRHRKVLRDNIQGITKPAIRRLARRGGVKRISGLIYEETRGVLKIFLENVIRDAVTYTEHARRKTVTAMDVVYAL

SEQ ID NO: 6849 - protein, 92 aa, Nuphar advena
WLGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6850 - protein, 92 aa, Pinus taeda
MSGRGKGGKGLGKGGAKRHRKVLRDNIQGITKPAIRRLARRGGVKRIIGLIYEETRGVLKIFLENVIRDAVTYTEHARRKTVTAMDVVYSLK

SEQ ID NO: 6851 - protein, 90 aa, Sesamum indicum
GGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6852 - protein, 90 aa, Saccharum officinarum
MSGRGKGGKGLGKGGAKRHRKVLRDNIQGITKPAIRRLARRGGVKRISGLIYEETRGVTYTEHARRKTVTAMDVVYALKRQGRTLYGFGG

SEQ ID NO: 6853 - protein, 93 aa, Saccharum officinarum
LGKGGAKRHRKVLRDNIQGITKPAIRRLARRGGVKRISGLIYEETRGVLKIFLENVIRDAVTYTEHARRKTRTVMDVVYALKRQGPTLYGFGG

SEQ ID NO: 6854 - protein, 103 aa, Saccharum officinarum
MSGRGKGRKGAGKGRAKRHRKGLPEHLQGNNKPAIRRLAKKGGVKRISGLIYEETRGVLKIFLENVIRDAVTYTEHARRKTVTAMDVVYALKRHGRTLYGFGG

SEQ ID NO: 6855 - protein, 94 aa, Helianthus annuus
PGGKGLGKGGAKRHRKVLRDNIQGITKPAIRRLARRGGVKRISGLIYDETRGVLKIFLENVIRDAVTYTEHARRKTVTAMDVVYALKCHGRTLY

SEQ ID NO: 6856 - protein, 103 aa, Triticum aestivum
MSGRGKGAKGLGKGGAKRHRKILRDNIQGITKPAIRRLARRGGVKRIAGLVYGETRGVLHIFLEEVIRDVVAYTQHARRKTVTAMDVVFALKRHGRTLYGFGV

SEQ ID NO: 6857 - protein, 218 aa, Hordeum vulgare
MAVTFSDLHSADGLKALEAHLAGKTYISGDAITKDDVKVFAAVPVKPSAEFPNAARWYDAVAAAVSPRFPGQASGVSASSAPAAAAPAASKDEDDDDDMDLFGDETEEDKKAAAEREAAKPAKKKESGKSSVLMDIKPWDDETDMKKLEEAVRGVQMEGLTWGASKLMPVGYGIKKLQIMLTIIDDLVSVDTLIEEVLCEAPINEYVQSCDIVAFNKI

SEQ ID NO: 6858 - protein, 118 aa, Brassica juncea
TQLFSNFNNLSSREKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6859 - protein, 118 aa, Festuca arundinacea
HEAKNPHHPKEQLAAMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6860 - protein, 118 aa, Lotus japonicus
VRAPKFRNPQNFLGKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6861 - protein, 118 aa, Raphanus sativus
KTTTENLLYFLKGKKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6862 - protein, 118 aa, Rosa hybrid cultivar
FHQIQSSSPSNFPVKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6863 - protein, 118 aa, Secale cereale
PRVRNKPSSSERESKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6864 - protein, 118 aa, Helianthus annuus
FQIKSQFQFHFISTTMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6865 - protein, 118 aa, Triticum aestivum
KTSQPHRGEAERREKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6866 - protein, 118 aa, Triticum aestivum
QNNPIQSPKREKRRKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6867 - protein, 118 aa, Triticum aestivum
RPSDSTSARSSRSSAMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6868 - protein, 118 aa, Triticum aestivum
PSPPNCICSALQATIMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6869 - protein, 118 aa, Triticum aestivum
PHESFFSQTKTNPDTMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6870 - protein, 118 aa, Triticum aestivum
DLHPLAARTKERPSAMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6871 - protein, 117 aa, Persea americana
  misc_feature (11)..(13): Xaa can be any naturally occurring amino acid
  misc_feature (26)..(26): Xaa can be any naturally occurring amino acid
VWASIQSNPQXXXEMSGRGKGGKGLXKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6872 - protein, 117 aa, Lactuca sativa
  misc_feature (58)..(58): Xaa can be any naturally occurring amino acid
LQSFQSEKAKTREKMSGRGKGGKGLGKGGAKRHRKVLRDNIQGITKPAIRRLARRGGXKRISGLIYEETRGVLKIFLENVIRDAVTYTEHARRKTVTAMDVVYALKRQGRTLYGFGG

SEQ ID NO: 6873 - protein, 115 aa, Fragaria vesca
  misc_feature (9)..(9): Xaa can be any naturally occurring amino acid
  misc_feature (15)..(15): Xaa can be any naturally occurring amino acid
  misc_feature (18)..(18): Xaa can be any naturally occurring amino acid
  misc_feature (21)..(21): Xaa can be any naturally occurring amino acid
SEFISSQNXPAKMSXRGXGGXGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6874 - protein, 55 aa, Allium cepa
  misc_feature (2)..(2): Xaa can be any naturally occurring amino acid
  misc_feature (15)..(15): Xaa can be any naturally occurring amino acid
  misc_feature (23)..(23): Xaa can be any naturally occurring amino acid
  misc_feature (38)..(38): Xaa can be any naturally occurring amino acid
  misc_feature (46)..(46): Xaa can be any naturally occurring amino acid
  misc_feature (49)..(49): Xaa can be any naturally occurring amino acid
YXPPPRPFGKKIFKXPPFQPLKXGGGKPKKKGLGGKAXPPPPGRGXGAXGPRPFL

SEQ ID NO: 6875 - protein, 97 aa, Triticum aestivum
MSGRGKGGKGLGKGGAKRHRKVLRDNIQGITKPAIRRLARRGGVKRISGLIYEETRGVLKIFLENVIRDAVTYTEHARRKTVTAMDVVPSAPATQVG

SEQ ID NO: 6876 - protein, 119 aa, Persea americana
ARVFFRSHRSISNLCTMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6877 - protein, 119 aa, Brassica rapa
DHQKFTLLLSLNTCEEMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6878 - protein, 119 aa, Vitis vinifera
VWDFLSETLENSKAVKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6879 - protein, 119 aa, Lactuca sativa
SAGAAKSNQEKTSVEEMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6880 - protein, 119 aa, Lactuca sativa
PIPQQRKSNPFPKRKIMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6881 - protein, 119 aa, Lotus japonicus
KTLILTFSENFNFLGKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6882 - protein, 119 aa, Secale cereale
PRSKIPKSHLFRSCSAMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6883 - protein, 119 aa, Euphorbia esula
  misc_feature (2)..(3): Xaa can be any naturally occurring amino acid
AXXKKKKKRKRKKKTKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6884 - protein, 119 aa, Helianthus annuus
QTKSSYLLLSRKPNLRMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6885 - protein, 119 aa, Triphysaria pusilla
  misc_feature (11)..(11): Xaa can be any naturally occurring amino acid
QFSLCRLHFFXFNQLKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6886 - protein, 119 aa, Triticum aestivum
HRSPDSTSARSSRSSAMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6887 - protein, 119 aa, Triticum aestivum
LDPHPLAARTKKRSSAMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6888 - protein, 119 aa, Triticum aestivum
QRQVDLTEEKKGEARKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6889 - protein, 119 aa, Triticum aestivum
EFSSTKFKVTAAKLSAMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6890 - protein, 174 aa, Cenchrus ciliaris
LTPTSTPIHSSEESTSVGEHVWARQGRLGSRKGRREAPPEGAPRQLPWHHKAGDAAAGEEGGREAHLLAHLLGDPRRAHDLPRERHPRRPHLHRARPPQDRLRHGCRLLAQARGPHSSTASAARLMRSSPSLSPSCVSGDVGSGSQVLRSRKFHTRLFSSALAVLCLSRDTVMK

SEQ ID NO: 6891 - protein, 63 aa, Zea mays
MDVVFFSSARAAPSTVSAVRSPLSLWRISRCRWRACCVLALLSLPCLDRSCCLWGLYPLNTIF

SEQ ID NO: 6892 - protein, 117 aa, Saccharum officinarum
NPQFPTSPPSSSGHVGARQGRQGAGQGRREAPPQGPPRQHPRHHETRRSRRLPRRAAVNRISGLIYKKTRAVFKIFFKNVIRDAVTYTEHARRRTVTAMDVVYALKRKGRTFYGFGG

SEQ ID NO: 6893 - protein, 107 aa, Triticum aestivum
YLQLRTPLQLQNKFNMSGRGKGGKGLGKGGAKRHRKVLRDNIQGITKPAIRRLARRGGVKRISGLIYEETRGVLKVFLENVIRDAVTYTEHAKRKTVTAMDLVYALK

SEQ ID NO: 6894 - protein, 89 aa, Unknown
  Sequence found in Organisms: Brassica napus, Festuca arundinacea, Gerbera hybrid cultivar
GAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6895 - protein, 103 aa, Hordeum vulgare
MSGPGEVGKGLGKGGAKRHRKVMRDNIQGIIKPAIRRLTRRGGVKRISGLIYEETRGVLKIFLETVIQGTVTYTKHARCKTVAAMDVVYALKRQGRTLYGFAG

SEQ ID NO: 6896 - protein, 89 aa, Hordeum vulgare
MSGRGKGGKGLGKGGAKRHRKVLRDNIQGITKPAIRRLARRGGVKRISGLIYEETRGVLKIFLENVIRDAVTYTEHARRKTVTAMDVVY

SEQ ID NO: 6897 - protein, 118 aa, Gossypium hirsutum
NSQFSVKKESLRFFKMSGRGKGGKGLGKGGAKRHRKVLRDNIQGITKPAIRRLARRGGVKRISGLIYEETRGVLKIFLENVIRDAVTYTEHARRKTVTAIDVVYALKRQGRTLYGFGG

SEQ ID NO: 6898 - protein, 118 aa, Solanum tuberosum
FRTLETSSSSNFSVKMSGRGKGGKGLGKGGAKRHRKVLRDNIQGITKPAIRRLARRGGVKRISGLIYEETRGVLKIFLENVIRDSVTYTEHARRKTVTAMDVVYALKRQGRTLYGFGG

SEQ ID NO: 6899 - protein, 91 aa, Picea glauca
KGGAKRHRKVLRDNIQGITKPAIRRLARRGGVKRISGLIYEETRGVLKIFLENVIRDAVTYTEHARRRTVTAMDVVYSLKRQGRTLYGFGG

SEQ ID NO: 6900 - protein, 118 aa, Solanum lycopersicum
FKTLETSSSSNFSVKMSGRGKGGKGLGKGGAKRHRKVLRDNIQGITKPAIRRLARRGGVKRISGLIYEETRGVLKIFLENVIRDSVTYTEHARRKTVTAMDVVYALKRQGRTLYGFGG

SEQ ID NO: 6901 - protein, 120 aa, Artemisia annua
HKQQSINPNTTKFNYKKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6902 - protein, 120 aa, Artemisia annua
TTHTNNNPNTPKFKKSKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6903 - protein, 120 aa, Phaseolus coccineus
MSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGGLNSSSFVFPWFHSYECF

SEQ ID NO: 6904 - protein, 120 aa, Brassica napus
GHNSLQNSLLHSKAKKKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6905 - protein, 120 aa, Vigna unguiculata
RTRGLESEKREEKRSAKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6906 - protein, 120 aa, Festuca arundinacea
HEAKSPKKSPSSQGAAAMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6907 - protein, 120 aa, Festuca arundinacea
GTRQPPPHKSSSPEKEEMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6908 - protein, 120 aa, Vitis vinifera
NPNQDFNPHPSILQLRTMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6909 - protein, 120 aa, Lactuca sativa
GTPEIKTNSRVSIPYKEMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6910 - protein, 120 aa, Lactuca sativa
DIHSTKFVEITKAEKEKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6911 - protein, 120 aa, Lactuca sativa
GIIQVQTQFNFIFLLVKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6912 - protein, 120 aa, Lactuca sativa
HLNSKLFKSVPTERVADMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6913 - protein, 120 aa, Rosa hybrid cultivar
TQSISKNPRSEIRSLIKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6914 - protein, 120 aa, Helianthus annuus
PPPNSSPINQTHNLKSTMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6915 - protein, 120 aa, Helianthus annuus
QKPKPQFSNLIIHRLKKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6916 - protein, 120 aa, Helianthus annuus
DTLKTKPNLPYTLIFQNMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6917 - protein, 120 aa, Triticum aestivum
FGTGQQPPPATHSSQAKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6918 - protein, 120 aa, Triticum aestivum
HRSLNPTRAAAPRGSSAMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6919 - protein, 120 aa, Triticum aestivum
PKLQHPHHSLLLPDPSTMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6920 - protein, 120 aa, Triticum aestivum
RANPPARSSKEGRKPLTMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6921 - protein, 120 aa, Triticum aestivum
SSTSIRSQLEPRRDLSAMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6922 - protein, 120 aa, Triticum aestivum
EFGTRPHESLLPPNRATMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6923 - protein, 120 aa, Triticum aestivum
HHRPSDSTSARSSRSSAMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6924 - protein, 119 aa, Secale cereale
PPSPSNPICSELQAAIMSGRGKGGKGLGKGGAKRHRKVLRDNIQGITKPAIRRLARRGGVKRISGLIYEETRGVLKIFLENVIRDAVTYTEHARRKTVTTMDVVYALKRQGRTLYGFGG

SEQ ID NO: 6925 - protein, 105 aa, Triphysaria pusilla
SPKKLGLSEMSGRGKGGKGLGKGGAKRHRKVLRDNIQGITKPAIRRLARRGGVKRISGLIYEETRGVLKIFLENVIRDAVTYTEHARRKTVTAMDVVYALKRQGR

SEQ ID NO: 6926 - protein, 119 aa, Triticum aestivum
QQQAKISRSPLVSAAKMSGRGKGGKGLGKGGAKRHRKVLRDNIQGITKPAIRRLARRGGVKRISGLIYEESRGVLKIFLENVIRDAVTYTEHARRKTVTAMDVVYALKRQGRTLYGFGG

SEQ ID NO: 6927 - protein, 118 aa, Elaeis guineensis
  misc_feature (12)..(12): Xaa can be any naturally occurring amino acid
  misc_feature (19)..(19): Xaa can be any naturally occurring amino acid
  misc_feature (68)..(68): Xaa can be any naturally occurring amino acid
YDFPSKSRARKXESEMSGXGKGGKGLGKGGAKRHRKVLRDNIQGITKPAIRRLARRGGVKRISGLIYXETRGVLKIFLENVIRDAVTYTEHARRKTVTAMDVVYALKRQGRTLYGFGG

SEQ ID NO: 6928 - protein, 64 aa, Hordeum vulgare
MRDAVTYTEHAPPKDRHRHGRRLRTQAPGAHPLRTWTLGHQPNPESFSGCGRWCNSSISFAGAV

SEQ ID NO: 6929 - protein, 113 aa, Triticum aestivum
HHPPPLEFDLFAPPDMSGRGKGGKGLGKGGAKRHRKVLRDNIQGITKPAIRRLARRGGVKRISGLIYEGDPRRAQDLSPRTSSATPHLHGARPAQDRHSMDVSTRSKRQRPTL

SEQ ID NO: 6930 - protein, 92 aa, Artemisia annua
TLDRAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6931 - protein, 89 aa, Pisum sativum
GAKRHRKVLRDNIQGITKPAIRRLARRGGVKRISGLIYEETRGVLEIFLENVIRDAVTYTEHARRKTVTAMDVVYALKRQGRTLYGFGG

SEQ ID NO: 6932 - protein, 88 aa, Pisum sativum
AKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6933 - protein, 89 aa, Unknown
  Sequence found in Organisms: Pinus taeda, Picea glauca
GAKRHRKVLRDNIQGITKPAIRRLARRGGVKRISGLIYEETRGVLKIFLENVIRDAVTYTEHARRKTVTAMDVVYSLKRQGRTLYGFGG

SEQ ID NO: 6934 - protein, 103 aa, Hordeum vulgare
MSGRSKGGMGLGKGGAIRHRKVLRDNIHGITKPAIRRLALRGGVNRISGLIYQETLGVLKIYLENVIRDAVTYTEHSRRKTVIGMDVLYALNRQGRTLYCFGG

SEQ ID NO: 6935 - protein, 92 aa, Populus trichocarpa
MSGRGKGGKGLGKGGAKRHRKVLRDNIQGITKPAIRRLARRGGVKRLSGLIYEETRGVLKIFLENVIRDAVTYTEHARRKTVTAMDAVYAFD

SEQ ID NO: 6936 - protein, 111 aa, Avena sativa
GKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGCLQGWMKLANVVV

SEQ ID NO: 6937 - protein, 113 aa, Avena sativa
SSGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGPSLCWRVIRVVTC

SEQ ID NO: 6938 - protein, 111 aa, Avena sativa
GKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGRIGLSLARSLPPD

SEQ ID NO: 6939 - protein, 121 aa, Brassica oleracea
TYYFLPSKVFNIEFSREKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6940 - protein, 121 aa, Brassica rapa
HIENTQANLNLKLSEKRKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6941 - protein, 121 aa, Gossypium hirsutum
  misc_feature (7)..(7): Xaa can be any naturally occurring amino acid
QFSIYLXRSSIDFSLAFIMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6942 - protein, 121 aa, Gossypium hirsutum
KFSIYLHRSSIDFSLAFIMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6943 - protein, 121 aa, Taraxacum officinale
ISFNHKPDPKSSLELLSTMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6944 - protein, 121 aa, Taraxacum officinale
  misc_feature (7)..(7): Xaa can be any naturally occurring amino acid
AGNPQKXIQVERINREREMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6945 - protein, 121 aa, Zingiber officinale
  misc_feature (2)..(2): Xaa can be any naturally occurring amino acid
HXGSPPRISCTSNTSFVEMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6946 - protein, 121 aa, Lactuca sativa
GGDHSTQFIIFFIILLEKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6947 - protein, 121 aa, Lactuca sativa
AGKRKSNSFLERESERKKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6948 - protein, 121 aa, Lactuca sativa
AGNTRNQTNSRVSIPYEEMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6949 - protein, 121 aa, Lactuca sativa
SAGNKINSFLTREKLRENMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6950 - protein, 121 aa, Elaeis guineensis
AQQNFPNCPSLKQSVQGTMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6951 - protein, 121 aa, Raphanus sativus
NSNFDSSSAPNFLNRKKNMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6952 - protein, 121 aa, Raphanus sativus
DILHTCEKQAFFFREKKKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6953 - protein, 121 aa, Triticum aestivum
PNPLQSHLRNSSQQASPAMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6954 - protein, 121 aa, Triticum aestivum
DHTAATTTTTSSTHSEAKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6955 - protein, 121 aa, Triticum aestivum
RSNTHTEKPISPEREASTMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6956 - protein, 121 aa, Triticum aestivum
SHRRSSGSTSARSSRSAAMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6957 - protein, 109 aa, Triticum aestivum
  misc_feature (56)..(56): Xaa can be any naturally occurring amino acid
STSARSSRSAAMSGRGKGGKGLGKGGAKRHRKVLRDNIQGITKPAIRRLARRGGVXRISGLIYEETRGVLKIFLENVIRDAVTYTEHARRKTVTAMDVVYALKRQGRTL

SEQ ID NO: 6958 - protein, 114 aa, Triticum aestivum
RRNTHTHREAKMSGRGKGGKGLGKGGAKRHRKVLRDNIQGITKPAIRRLARRGGVKRISGLIYEETRGVLKIFLENVIRDAVTYTEHARRKTVTTMDVVYALKATGPHLYGSGG

SEQ ID NO: 6959 - protein, 120 aa, Nicotiana benthamiana
HEVSIQTKNPRSKFCVKMSGRGKGGKGLGKGGAKRHRKVLRDNIQGITKPAIRRLARRGGVKRISGLIYEETRGVMKIFLENVIRDAVTYTEHARRKTVTAMDVVYALKRQGRTLYGFGG

SEQ ID NO: 6960 - protein, 120 aa, Picea glauca
HEASLFEQQRNLLLRVNMSGRGKGGKGLGKGGAKRHRKVLRDNIQGITKPAIRRLARRGGVKRISGLIYEETRGVLKIFLENVIRDAVTYTEHARRKTVTAMDVVYSLKRQGRTLYGFGG

SEQ ID NO: 6961 - protein, 120 aa, Solanum lycopersicum
STFKTLETSSSTNFSVKMSGRGKGGKGLGKGGAKRHRKVLRDNIQGITKPAIRRLARRGGVKRISGLIYEETRGVLKIFLENVIRDSVTYTEHARRKTVTAMDVVYALKRQGRTLYGFGG

SEQ ID NO: 6962 - protein, 119 aa, Actinidia deliciosa
MSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFWWLDSSRSVFRFSSSASL

SEQ ID NO: 6963 - protein, 118 aa, Pinus taeda
VTVDFSFTSHLFSDIMSGRGKGGKGLGKGGAKRHRKVLRDNIQGITKPAIRRLARRGGVKRISGLIYEETRGVLKVFLEHVIRDAVTYTEHARRKTVTAMDVVYALKRQGKTLYGFGG

SEQ ID NO: 6964 - protein, 118 aa, Helianthus annuus
RGSQINTLSIQSPATMSGRGKGGKGLGKGGAKRHRKVLRDNIQGITKPAIRRLATRGGVKRISGLIYQETRGVLKIFLENVIRDAVTYTEHARRKTVTAMDVVYALKRPGRTLYGFGG

SEQ ID NO: 6965 - protein, 88 aa, Zea mays
MTWSGALTSSTATSSSTVTQRQQGHKRDGQPDDPDDGADEGDEDGEQREGQAQEPPERPALPVAAAAHRPPLTSRPASPSLSGSAVAF

SEQ ID NO: 6966 - protein, 91 aa, Avena sativa
GTRAKRHWKVLRDNIQGITKPAIRRLARRGGVKRISGLIYEETRGVLKIFLENVIRDAVTYTEHARRKTVTAMDVVYALKRQGRTLYGFGG

SEQ ID NO: 6967 - protein, 91 aa, Picea glauca
GTRAKRHRKVLRDNIQGITKPAIRRLARRGGVKRISGLIYEETRGVLKIFLENVIRDAVTYTEHARRKTVTAMDVVYSLKRQGRTLYGFGG

SEQ ID NO: 6968 - protein, 103 aa, Gerbera hybrid cultivar
MSGCGKGGKGLGKGGAKRPRKVFRGNIQGIPKPAIRRLARKGGVKRISGFIYEKTRGVFKIFLENVICDAVTYPEPARRKTVPPMDVVYALKRQGRAFYGFGG

SEQ ID NO: 6969 - protein, 115 aa, Avena sativa
KIPKSILLPRERDSRAAGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFG

SEQ ID NO: 6970 - protein, 89 aa, Tragopogon dubius
MSGRGKGGKGLEKGGAKRHRKVLRDNIQGITKPAIRRLARRGGVKRISGLVYEETRGVLKIFLENVIRDAVTYTEHARRKTVTAMDVVY

SEQ ID NO: 6971 - protein, 87 aa, Brassica juncea
MSGRGKGGKGLGKGGAKRHRKVLRDNIQGITKPAIRRLARRGGVKRISGLIYEETRGVLKIFLENVIRDAVTYTEHARRKTVTAMDV

SEQ ID NO: 6972 - protein, 100 aa, Brassica napus
RGKGGKGLGKGGAKRHRKGLRDNIQGITKPAIRCFARGGGVKGFSGLIFEETRGVLKFFLENVFRDAVTYPEHARGKTVTAMDVVFALKRQGGTLYGFGG

SEQ ID NO: 6973 - protein, 103 aa, Gossypium hirsutum
MTGRGTGGKGLGKGGAKRDRKILRDNIQGITKPAIRRLARRGGVKRISAMIYEETRGALNTFLEGVIRDTATYTEHAKRKTVTSIDVVYALKRQGRTLYRFGG

SEQ ID NO: 6974 - protein, 87 aa, Cycas rumphii
KRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6975 - protein, 88 aa, Picea glauca
AKRHRKVLRDNIQGITKPAIRRLARRGGVKRISGLIYEETRGVLKIFLENVIRDAVTYTEHARRKTVTAMDVVYSLKRQGRTLYGFGG

SEQ ID NO: 6976 - protein, 89 aa, Triticum aestivum
GAKRHRKVLRDNIQGITKPAIRRLARRGGVKRISGLIYEETRGVLKIFLENVIRDAITYTEHARRKTVTAMDVVYALKRQGRTLYGFRG

SEQ ID NO: 6977 - protein, 68 aa, Ipomoea nil
  misc_feature (6)..(8): Xaa can be any naturally occurring amino acid
  misc_feature (19)..(19): Xaa can be any naturally occurring amino acid
  misc_feature (22)..(22): Xaa can be any naturally occurring amino acid
  misc_feature (31)..(31): Xaa can be any naturally occurring amino acid
  misc_feature (63)..(63): Xaa can be any naturally occurring amino acid
  misc_feature (65)..(66): Xaa can be any naturally occurring amino acid
TFKSKXXXPIYLSLHQFKXLDXFFLSAKMSXRGKGGKGLGKGGAKRHRKVLRRQHPGDHEAGXSXXGS

SEQ ID NO: 6978 - protein, 126 aa, Saccharum officinarum
LQSRRLQSTTPRKSTTHPSGRSHVWARQGRQGARQGRREASPEGAARQHPGHHQTGDPAAGAEGRRQTASRGLIYKETRGVFKIFLKNVIRNAVTYTKNARRRTVTALNLFYPLNRKGRTFYGFGG

SEQ ID NO: 6979 - protein, 150 aa, Hordeum vulgare
MSGRGKGGKGLGKGGAKRHRKVLRDNIQGITKPAILLLARRGGEKRISGLIYEETRGVLKILLENEIRYADTYTKHAHRKTGTNMDVEYALKQTRTNPVQLRRLICWCCYTQTTTTAKPLYGMHNRIQHSIIFDILNTFTFFIDAYTLIK

SEQ ID NO: 6980 - protein, 145 aa, Zea mays
EEPFKGTGRRRPRRTRPRRRRGAARAAPGRARAAPSATARCCATTSRASRSRRSVGWPGGAASSAFLGSSTRKPAACSISSSRTSSATPSPTPSTPAARTVTAFFFFYALKRQGWRLDGFCCFASPPPDALILPPWSVVCPSWPV

SEQ ID NO: 6981 - protein, 67 aa, Zea mays
QGLCTFPKIPHFLPGEESVKDRAPIATMSESGKGGKGLVKAGAKRHRKVLRDNIKSITKPAHPEAAS

SEQ ID NO: 6982 - protein, 142 aa, Zea mays
NNNNNPHNGTILLLRPRSSRFRRCRGATRAARGCAKGGAKRHREVLRDNIQGITKPAIRRLAKRGGVKRISGLIYEETRGVLKIFLENDIHDAVTYTEHSRRKIDLRQGCRLHTQATGPHAQRIRRLGRLPFGRFDMKGVGC

SEQ ID NO: 6983 - protein, 49 aa, Helianthus annuus
FPRERKCRKKKKEARDWEKEEQNDSVRFFEATFRELRSRQSVGLHDVVV

SEQ ID NO: 6984 - protein, 46 aa, Helianthus annuus
  misc_feature (9)..(9): Xaa can be any naturally occurring amino acid
EREMSGEEXEATDWENEERNDTVRFFRTTFRELRSRQSAGLHNVVP

SEQ ID NO: 6985 - protein, 65 aa, Triticum aestivum
  misc_feature (50)..(50): Xaa can be any naturally occurring amino acid
MSGRGKGGKGLGKGGAKRHRKVLRDNIQGITKPAIRRLARRGGVKRISGXIYEESRGVLKIFLEN

SEQ ID NO: 6986 - protein, 122 aa, Gossypium hirsutum
THASEKSQFPLEKIFDFSKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6987 - protein, 122 aa, Cryptomeria japonica
  misc_feature (1)..(1): Xaa can be any naturally occurring amino acid
XPRFIQFVCIHRILKREGKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6988 - protein, 122 aa, Festuca arundinacea
ARGNSPVSLAARSKSRSSAMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6989 - protein, 122 aa, Festuca arundinacea
HEANPQSPSHPEATADSSTMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6990 - protein, 122 aa, Festuca arundinacea
GTRPHSKKIPKSSEGAAAAMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6991 - protein, 122 aa, Lactuca sativa
FILHLFLRNLKFKNLFHLTMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6992 - protein, 122 aa, Lactuca sativa
FGGDHSSSTQFNFISLPVKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6993 - protein, 122 aa, Lactuca sativa
RGSITIGINFIFREKKNKKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6994 - protein, 122 aa, Lactuca sativa
GNIITSIVSERKSKSPEKKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6995 - protein, 122 aa, Lotus japonicus
HIRFPLNEITEREHHPTTTMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6996 - protein, 122 aa, Elaeis guineensis
TSSLRKSCTGAEKGRSFKKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6997 - protein, 122 aa, Secale cereale
TAPPTPVRSSAARRGPSATMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6998 - protein, 122 aa, Triphysaria pusilla
AARAGRYSNQQLTSFRRKKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 6999 - protein, 122 aa, Triticum aestivum
AATTKTSQPHRGEGRRREKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 7000 - protein, 122 aa, Triticum aestivum
KLQHPHESFFSQTKTNPATMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 7001 - protein, 122 aa, Triticum aestivum
GIRHEVFPITHLSELTGAAMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 7002 - protein, 122 aa, Triticum aestivum
QQPPPPATKPSSPERESSRMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 7003 - protein, 122 aa, Triticum aestivum
PRPPPAATTTSSNTHTAAKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 7004 - protein, 122 aa, Triticum aestivum
ALLDLLHPPAARAKKRSSAMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 7005 - protein, 122 aa, Triticum aestivum
PTKFPTTKSSTGDRPQQPAMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 7006 - protein, 122 aa, Triticum aestivum
GTRHRSSHPTLARSSRSSAMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 7007 - protein, 122 aa, Triticum aestivum
TTPPPNPTRAAAPRGSSATMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 7008 - protein, 122 aa, Triticum aestivum
ARGNNHHQQQPSQARRRERMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 7009 - protein, 122 aa, Triticum aestivum
RNTIHPPVRSGGDRQPAAEMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 7010 - protein, 122 aa, Triticum aestivum
SHHRSSDSTTSARSSRSSAMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 7011 - protein, 121 aa, Brassica oleracea
  misc_feature (103)..(103): Xaa can be any naturally occurring amino acid
DLNLKLKPSKSRESFQKIMSGRGKGGKGLGKGGAKRHRKVLRDNIQGITKPAIRRLARRGGVKRISGLIYEETRGVLKIFLENVIRDAVTYTEHARRKTVTAXDVVYALKRQGRTLYGFGG

SEQ ID NO: 7012 - protein, 121 aa, Nicotiana benthamiana
GISNQILFSFQFNYFTNKMSGRGKGGKGLGKGGAKRHRKVLRDNIQGITKPAIRRLARRGGVKRISGLIYEETRGVLKIFLENVIRDAVTYTEHARRKTVTAMDVVYSLKRQGRTLYGFGG

SEQ ID NO: 7013 - protein, 121 aa, Picea glauca
SQFFTYLFIIWFIAEKGRMSGRGKGGKGLGKGGAKRHRKVLRDNIQGITKPAIRRLARRGGVKRISGLIYEETRGVLKIFLENVIRDAVTYTEHARRKTVTAMDVVYSLKRQGRTLYGFGG

SEQ ID NO: 7014 - protein, 121 aa, Picea glauca
IVIIHFHCLRAGQESLTRMSGRGKGGKGLGKGGAKRHRKVLRDNIQGITKPAIRRLARRGGVKRISGLIYEETRGVLKIFLENVIRDAVTYTEHARRKTVTAMDVVYSLKRQGRTLYGFGG

SEQ ID NO: 7015 - protein, 121 aa, Picea glauca
GTGIHHFIFVIESRAEVSMSGRGKGGKGLGKGGAKRHRKVLRDNIQGITKPAIRRLARRGGVKRISGLIYEETRGVLKIFLENVIRDAVTYTEHARRKTVTAMDVVYSLKRQGRTLYGFGG

SEQ ID NO: 7016 - protein, 113 aa, Zea mays
MSGRGKGGKGLGKGGAKRHRKVLRDNIQGVTKPAIRRLARRGGVKRISGLIYEETRGVLKIFLENVIRDAVTYTEHVRRKTPTAMHVVYTLKRQVRTLYGFWRLKGQGGPPAA

SEQ ID NO: 7017 - protein, 118 aa, Mimulus guttatus
MSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLIIIGIINIIIQAKCLYDLQF

SEQ ID NO: 7018 - protein, 117 aa, Carthamus tinctorius
IHYIGRERERESLKMSGRGKGGKGLGKGGAKRHRRVLRDNIQGITKPAIRRLGRRGGVKRIIGLIYEETRGVLKIFLQNVIRDAITYTEHARRKTVTAMDVVYALKRQGRTLYGFGG

SEQ ID NO: 7019 - protein, 123 aa, Brassica juncea
QFNSNFDSYFSIKTFSIEKKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 7020 - protein, 123 aa, Brassica juncea
YAGTHNSLQNSLLHSKAKKKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 7021 - protein, 123 aa, Brassica rapa
DNSTLTSILIQHQTCSIGKKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 7022 - protein, 123 aa, Brassica rapa
QTESITLVIFFDSRESFQRKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 7023 - protein, 123 aa, Gossypium hirsutum
KFPISPSKSFKFLNFHSISKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 7024 - protein, 123 aa, Gossypium hirsutum
SFPISLSKSFKFLNFHSISKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 7025 - protein, 123 aa, Gossypium hirsutum
FTRPKNSQFSVTKELFDFSKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 7026 - protein, 123 aa, Vigna unguiculata
AKLFACIFSSVSEKKEKSSAMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 7027 - protein, 123 aa, Festuca arundinacea
HEADSSRSPLEARSKARSSAMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 7028 - protein, 123 aa, Zingiber officinale
KFRRSRSLQKSVDRSLDSAAMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 7029 - protein, 123 aa, Ipomoea nil
AIKNLRSSDFLSLEEKYFLKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 7030 - protein, 123 aa, Lactuca sativa
SHSSLDQNTNSASHLELVSTMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 7031 - protein, 123 aa, Lactuca sativa
SHSSLNHNSNSASNLELVSTMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 7032 - protein, 123 aa, Raphanus sativus
DTSKTHKANLNFKNFPEKRKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 7033 - protein, 123 aa, Raphanus sativus
IVNRILLSSPFHYSELRNQDMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 7034 - protein, 123 aa, Helianthus annuus
  misc_feature (7)..(7): Xaa can be any naturally occurring amino acid
  misc_feature (12)..(12): Xaa can be any naturally occurring amino acid
  misc_feature (17)..(17): Xaa can be any naturally occurring amino acid
AGTLFSXNPLKXTILQXNFKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 7035 - protein, 123 aa, Helianthus annuus
AGDTQKPKPQSQISSPPLRKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 7036 - protein, 123 aa, Triticum aestivum
TTPPIRQFLAARTKASSSATMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 7037 - protein, 123 aa, Triticum aestivum
CRNSARATAPPPFPSQSNSKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 7038 - protein, 123 aa, Triticum aestivum
PATKPRSKIPKSPLFPSYSAMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 7039 - protein, 123 aa, Triticum aestivum
ETSSRRRHSSSSISISVSSKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 7040 - protein, 123 aa, Triticum aestivum
TRPTVPPIPHLLAARRGSSAMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 7041 - protein, 123 aa, Triticum aestivum
HDRSLDPHPLAARTKQRSSAMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 7042 - protein, 123 aa, Triticum aestivum
TTAPPIPHSLAARTKERPSAMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 7043 - protein, 123 aa, Triticum aestivum
  misc_feature (3)..(8): Xaa can be any naturally occurring amino acid
ALXXXXXXQPHRGEEGRSEKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 7044 - protein, 123 aa, Triticum aestivum
TKSPNPSSSPGKRERERAAEMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 7045 - protein, 122 aa, Cucumis melo
HTSIISAFISSDFPSNKATMSGRGKGGKGLGKGGAKRHRKVLRDNIQGITKPAIRRLARRGGVKRISGLIYEETRGVLKIFLENVIRDAVTYTEHARRKTVTAMDVAYALKRQGRTLYGFGG

SEQ ID NO: 7046 - protein, 122 aa, Raphanus sativus
  misc_feature (4)..(4): Xaa can be any naturally occurring amino acid
  misc_feature (8)..(8): Xaa can be any naturally occurring amino acid
  misc_feature (18)..(18): Xaa can be any naturally occurring amino acid
  misc_feature (116)..(116): Xaa can be any naturally occurring amino acid
GLTXHLIXLTFDSRVSFXKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRXLYGFGG

SEQ ID NO: 7047 - protein, 122 aa, Raphanus sativus
QFNSNFDSFSAPNFLNRKKMSGRGKGGKGLGKGGAKRHRKVLRDNIQGITKPAIRRLARRGGVKRISGPIYEETRGVLKIFLENVIRDAVTYTEHARRKTVTAMDVVYALKRQGRTLYGFGG

SEQ ID NO: 7048 - protein, 86 aa, Pisum sativum
RHRKVLRDNIQGITKPAIRRLARRGGVKRISGLIYEETRGVLKIFLENVIRDAVTYTEHARRKTVTAMDVVYALKRQGRTLYGFGG

SEQ ID NO: 7049 - protein, 80 aa, Pisum sativum
MLLHIPSMLGGRLLLPWMLSMLLRDKEEPSMDSEVEDDSLFCLFSKCCCVVSKCDCNFPALLMMFRLICDMQFSVKWNLY

SEQ ID NO: 7050 - protein, 63 aa, Saccharum officinarum
MSGRCNGGKGLCNGGAKRHRKVLRDNIQGITKPAIRKLSRMGGVKRISGLIYKETRGVLKISL

SEQ ID NO: 7051 - protein, 86 aa, Artemisia annua
GKGLGKGGAKRHRKVLRDNIQGITKPAIRRLARRGGVKRISGLIYEETRGVLKIFLENVIRDAVTYTEHARRKTVTAMDVVYALKR

SEQ ID NO: 7052 - protein, 120 aa, Artemisia annua
  misc_feature (2)..(2): Xaa can be any naturally occurring amino acid
  misc_feature (7)..(7): Xaa can be any naturally occurring amino acid
  misc_feature (15)..(15): Xaa can be any naturally occurring amino acid
  misc_feature (18)..(18): Xaa can be any naturally occurring amino acid
  misc_feature (36)..(36): Xaa can be any naturally occurring amino acid
  misc_feature (40)..(40): Xaa can be any naturally occurring amino acid
  misc_feature (44)..(44): Xaa can be any naturally occurring amino acid
  misc_feature (48)..(48): Xaa can be any naturally occurring amino acid
  misc_feature (51)..(52): Xaa can be any naturally occurring amino acid
  misc_feature (56)..(56): Xaa can be any naturally occurring amino acid
  misc_feature (63)..(65): Xaa can be any naturally occurring amino acid
  misc_feature (81)..(81): Xaa can be any naturally occurring amino acid
  misc_feature (90)..(92): Xaa can be any naturally occurring amino acid
  misc_feature (94)..(94): Xaa can be any naturally occurring amino acid
  misc_feature (115)..(115): Xaa can be any naturally occurring amino acid
KXKPPSXFQKKKKEXKKXSGRGKGGKGLGKGGAKRXRKVXRDNXQGIXKPXXRRLXRRGGVKXXXGLIYEETRGVLKIFLXNVIRDAVTXXXHXRRKTVTAMDVVYALKRQGRTXYGFGG

SEQ ID NO: 7053 - protein, 71 aa, Hordeum vulgare
MASPSTAIHHLARRGGVKHILGLIYEETRGVLKIFLENVIRDAEPYTDHARRKTVTAMDVFYTLKRQGRTL

SEQ ID NO: 7054 - protein, 103 aa, Brassica napus
KSSKFSYPEQKKMSGRGKGGEGLGKGGAKRHRKVLRDNIQGIPKPAIRRLARRGGVKRISGLIYEETRGVLKIFLEKVIRDAVTYTEHARRKTGRAMDVVYAL

SEQ ID NO: 7055 - protein, 103 aa, Zea mays
MSGRGKGGKGLGKGRTNRHRKVLRDNIQGITKPAIRRLARRGGIKRISSLINEETRGLLYIFLENVIRDAVTYTHHARGGRVTSMYLAYSLKRQGRTLYGFGG

SEQ ID NO: 7056 - protein, 121 aa, Picea glauca
LFFFHFGGEPAESEELSEMSGRGKGGKGLGKGGAKRHRKALRDNIQGITKPAIRRLARRGGVKRISGLIYEETRGVLKIFLENVIRDAVTYTEHARRKTVTAMDVVYSLKRQGRTLYGFGG

SEQ ID NO: 7057 - protein, 121 aa, Picea glauca
SSFIIFILVAINGREKRRMSGRGKGGKGLGKGGAKRHRKVLRDNIQGITKPAIRRLARRGGVKRISGLIYEETRGVLKIFLENVIRDAVTYTEHARRKTVTAMDVVYSLKRRGRTLYGFGG

SEQ ID NO: 7058 - protein, 105 aa, Helianthus annuus
RVLGTRLVLVSGIRPLRRGDTVKILRDNIQGITKPAIRRLARRGGVKRISGLIYEETRGVLKIFLENVIRDAVTYTEHARRKTVTAMDVVYALKRQGRTLYGFGG

SEQ ID NO: 7059 - protein, 124 aa, Brassica napus
VRGDIENTQANLNLKLSEKRKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 7060 - protein, 124 aa, Gossypium hirsutum
LKFPISLFKSFKFLNFHSISKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 7061 - protein, 124 aa, Cryptomeria japonica
  misc_feature (1)..(1): Xaa can be any naturally occurring amino acid
XSNDFLHGISIGFLESQGFLKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 7062 - protein, 124 aa, Festuca arundinacea
GTRHESPLPLTHLEPRADSSAMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 7063 - protein, 124 aa, Festuca arundinacea
CTRHHRSSSSISSQQLQSRSAMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 7064 - protein, 124 aa, Zingiber officinale
TRPRAEFGTRISCTSFTSFVDMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 7065 - protein, 124 aa, Ipomoea nil
  misc_feature (10)..(10): Xaa can be any naturally occurring amino acid
  misc_feature (16)..(16): Xaa can be any naturally occurring amino acid
  misc_feature (18)..(19): Xaa can be any naturally occurring amino acid
PGTRSKVRSXFLSEEXKXXLKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 7066 - protein, 124 aa, Lactuca sativa
RGHFHLHFFESRSFRFRSNLKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 7067 - protein, 124 aa, Lactuca sativa
  misc_feature (12)..(12): Xaa can be any naturally occurring amino acid
  misc_feature (17)..(17): Xaa can be any naturally occurring amino acid
RGHFHLHFFESXSFRFXSNLKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 7068 - protein, 124 aa, Raphanus sativus
ISSNSFYYPLRSIIQELRNQEMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 7069 - protein, 124 aa, Fragaria vesca
LQFSHLPSQSSFSLLQFSIEKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 7070 - protein, 113 aa, Triphysaria pusilla
SSKSQFPNLKQQNPKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTL

SEQ ID NO: 7071 - protein, 124 aa, Triticum aestivum
TTAPRPSSALSARTKASSSATMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 7072 - protein, 124 aa, Triticum aestivum
TTAPPPIPHSVAARTKEGSSAMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 7073 - protein, 124 aa, Triticum aestivum
DQPPQLPQRQVNLTGEKGEAKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 7074 - protein, 124 aa, Triticum aestivum
ARAATPTLTEKPISPEREASRMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 7075 - protein, 124 aa, Triticum aestivum
THHHSSPNPTRAAAPRGSSATMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 7076 - protein, 124 aa, Triticum aestivum
HHSSNPTFFLAARAKGSSSATMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 7077 - protein, 124 aa, Triticum aestivum
EFGTRHRSSDSTSARSSRSSAMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 7078 - protein, 124 aa, Triticum aestivum
MRSRRRPSDSTTSARSLRSSAMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 7079 - protein, 124 aa, Triticum aestivum
PTFPYTRKIPSSLVRVREAAAMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 7080 - protein, 124 aa, Triticum aestivum
TTAPPIRHFLAARTKASSSATMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 7081 - protein, 112 aa, Gossypium hirsutum
PRVRLHLSSVAGRGKGGKGLGKGGAKRHRKILRDNIQGITKPAIRRLARRGGVKRISAMIYEETRGVLKTFLEGVIRDAVTYTEHAKRKTVTSLDVVYALKRQGRTLYGFGG

SEQ ID NO: 7082 - protein, 106 aa, Helianthus annuus
PRVRSGKGKGGKGLGKVGAKRHRKVLRDNIQGITKPAIRGLARRDGVKPINGLIYEEPRGVLKIFLENVIRDSVTHPKHARRKTVTTMDVVYALKRQGRSLFGFGG

SEQ ID NO: 7083 - protein, 123 aa, Lactuca sativa
YSSLYRNPKLFSVCVVIIPTMSGRGKGGKGLGKGGAKRHRKVLRDNIQGITKPAIRRLARRGGVKRISGLIYEETRGVLKIFLENVIRDAVTYTEHARRKTVTAMDVVYALKRQGKTLYGFGG

SEQ ID NO: 7084 - protein, 123 aa, Raphanus sativus
  misc_feature (59)..(59): Xaa can be any naturally occurring amino acid
NTQQSQKKRERNNSEKFRRKMSGRGKGGKGLGKGGAKRHRKVLRDNIQGITKPAIRRLXRRGGVKRISGLIYEETRGVLKIFLENVIRDAVTYTEHARRKTVTAMDVVYALKRQGRTLYGFGG

SEQ ID NO: 7085 - protein, 123 aa, Selaginella moellendorffii
VLRFAVPPSISSGNLLVAAAMSGRGKGGKGLGKGGAKRHRKHLRDNIQGITKPAIRRLARRGGVKRISGLIYEETRGVLKIFLENVIRDAVTYTEHARRKTVTAMDVVYALKRQGRTLYGFGG

SEQ ID NO: 7086 - protein, 122 aa, Picea glauca
TIVIIHFNCLRAGQESLARMSGRGKGGKGLGKGGAKRHRKVLRDSIQGITKPAIRRLARRGGVKRISGLIYEETRGVLKIFLENVIRDAVTYTEHARRKTVTAMDVVYSLKRQGRTLYGFGG

SEQ ID NO: 7087 - protein, 109 aa, Triphysaria pusilla
SNRNSFHNFCRTKMSGRGKGGKGLGKGGAKRHRKVLRDNIQGITKPAIRRLARRGGVKRISGLIYEETRGVLKIFLENVIRDAVTYTEHARRKTVTAMDVVYALKRQGR

SEQ ID NO: 7088 - protein, 75 aa, Triticum aestivum
KGLGKGGAKRHRKVLRDNIQGITKPAIRRLARRGGVKRISGLIYEGDPRRAQRSFSENVIRDAVTYTEHARRKDP

SEQ ID NO: 7089 - protein, 88 aa, Malus domestica
MSGPGKGGKGLGKGRAKRHCKVLCDNIQGITKSTIRRSARRGGVKRISGLIYEETRGVLKIFLENVIIGVVTYTEHASRKTVTSMDVV

SEQ ID NO: 7090 - protein, 69 aa, Gossypium hirsutum
MPWTYTEPPRRETVTVMDVVYALKRPGPPPPWLGGLIFPFLGPVLLHPGGGGGTNRGFSLKKIFSPSKK

SEQ ID NO: 7091 - protein, 142 aa, Zea mays
MEGITKPAILRLARMGGANRISGLIYEETRGLLKIFLENVIRDAVTYTEHARRKTVTAMDVVYALNRQERTLYRFWWSEPLLIPLKDLIKYFLPPAPANSIEISHIKNPTIYSHPLGTNTFLAVLGCHSVWCAWGSPHTTKI

SEQ ID NO: 7092 - protein, 73 aa, Saccharum officinarum
MKPAIRRLAWRGGVKRIFGVIYEETRGVVKIFLEKVIWDAVTYTEHAGRKTVTAMEVVYALKRQGRTLYGFGG

SEQ ID NO: 7093 - protein, 95 aa, Lolium multiflorum
MSGRGKGGKGLGKSGAKRHRKILRDNIQGITKPAIRRLARRGGVKRISGLIYEETRGVLKTFLEGVIRDSVTYTEHAKRKTVTALDVVYLPGRPL

SEQ ID NO: 7094 - protein, 85 aa, Unknown
  Sequence found in Organisms: Orobanche aegyptiaca, Triphysaria pusilla
MSGRGKGGKGLGKGGAKRHRKVLRDNIQGITKPAIRRLARRGGVKRISGLIYEETRGVLKIFLENVIRDAVTYTEHARRKTVTAM

SEQ ID NO: 7095 - protein, 100 aa, Brassica rapa
  misc_feature (18)..(18): Xaa can be any naturally occurring amino acid
EAKEARGWAKEERRGTPXVLRDNIQGITKPAIRRLARRGGVKRISGLIYEETRGVLKIFLENVIRDAVTYTEHARRKTVTAMDVVYALKRQGRTLYGFGG

SEQ ID NO: 7096 - protein, 114 aa, Cichorium intybus
RIHLAIGREKTCQEEEKEARVLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 7097 - protein, 103 aa, Camellia sinensis
MSGRGRGGKGLGKGGAKRQWKGLRDNIQGITTTAIPGLAPTGGIQRISGLIYEETRGVLKIFLENVIRDAVTYPEHARRKTVTAMDVFYALNRQERTLDGFGW

SEQ ID NO: 7098 - protein, 115 aa, Avena sativa
GKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGLRRRRLLQIPMFIALFP

SEQ ID NO: 7099 - protein, 115 aa, Avena sativa
GKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGLRQRRLLQIPMFISLFP

SEQ ID NO: 7100 - protein, 125 aa, Arabidopsis thaliana
LRIKSNSSSHSSEKKKSNSLEKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 7101 - protein, 125 aa, Beta vulgaris
  misc_feature (11)..(11): Xaa can be any naturally occurring amino acid
QPKTIQTQKIXERRKPKKRREKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 7102 - protein, 125 aa, Brassica napus
ESNHHLNLKLNHLNLEKLSRKKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 7103 - protein, 125 aa, Festuca arundinacea
GTRHRPQHTRVELTGEKGKPSEMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 7104 - protein, 125 aa, Festuca arundinacea
  misc_feature (10)..(10): Xaa can be any naturally occurring amino acid
GTRSTLPQQXQFLSSNSNRSPTMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 7105 - protein, 125 aa, Ipomoea nil
TEQSKLFERSDFLSEEEKKFSKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 7106 - protein, 125 aa, Lactuca sativa
RGSHSSLNKNSNSASHLELVSTMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 7107 - protein, 125 aa, Lactuca sativa
PYSSLYRNPKLFFSVCVVIIPTMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 7108 - protein, 125 aa, Lotus japonicus
LISVHLQSPSSHRFQFDFLSDSMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 7109 - protein, 125 aa, Raphanus sativus
  misc_feature (8)..(8): Xaa can be any naturally occurring amino acid
GISFCNPXRRILFLKVSKLCEEMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 7110 - protein, 125 aa, Raphanus sativus
ESHLQSSPSHSSYSKGIESCEEMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 7111 - protein, 125 aa, Rosa hybrid cultivar
TSESSQLSHPHQNQNQSFSPVKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 7112 - protein, 125 aa, Secale cereale
EKFPIPSSSSPRDAHSRAESEKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 7113 - protein, 125 aa, Fragaria vesca
QFSLLSSKSNTLSLSFKFFVEKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 7114 - protein, 125 aa, Triticum aestivum
ISSPTTKTIQSNPTVERGEARRMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 7115 - protein, 125 aa, Triticum aestivum
ATSTTSNPHRAAKRSSPEREAKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 7116 - protein, 125 aa, Triticum aestivum
RYVRNNLHQQQKRSSPEREASKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 7117 - protein, 125 aa, Triticum aestivum
ARGTTAPPPFASHSAPRKKPSAMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 7118 - protein, 125 aa, Triticum aestivum
YHPTTTPPQQPPPATHTHREAKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 7119 - protein, 125 aa, Triticum aestivum
HRSHHTDKSTSPRRREEKRSEKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 7120 - protein, 125 aa, Triticum aestivum
LFPPTKPRSKIPKSPLFRSYSAMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 7121 - protein, 125 aa, Triticum aestivum
PLQIHPIQSARSQLQGRRKPSTMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 7122 - protein, 125 aa, Triticum aestivum
TSSSIRSHLPARSSKEGRKPSAMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 7123 - protein, 125 aa, Triticum aestivum
QKTKSPNPSSSPGKKERERAAEMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 7124 - protein, 124 aa, Manihot esculenta
  misc_feature (6)..(16): Xaa can be any naturally occurring amino acid
  misc_feature (18)..(20): Xaa can be any naturally occurring amino acid
  misc_feature (22)..(22): Xaa can be any naturally occurring amino acid
ALSFPXXXXXXXXXXXFXXXKXSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 7125 - protein, 124 aa, Raphanus sativus
GQFNSNFDSSSAPNFLNRKKNMSGRGKGGKGLGKGGAKRHRKVLRDNIQGITKPAIRRLARRGGVKRIIGLIYEETRGVLKIFLENVIRDAVTYTEHARRKTVTAMDVVYALKRQGRTLYGFGG

SEQ ID NO: 7126 - protein, 124 aa, Picea glauca
THRNSSLVLLSFWLSAEKRRRMSGRGKGGKGLGKGGAKRHRKVLRDNIQGITKPAIRRLARRGGVKRISGLIYEETRGVLKIFLENVIRDAVTYTEHARRKTVTAMDVVYSLKRQGRTLYGFGG

SEQ ID NO: 7127 - protein, 124 aa, Picea glauca
  misc_feature (8)..(8): Xaa can be any naturally occurring amino acid
LFVAILHXIILVESSGRQRETMSGRGKGGKGLGKGGAKRHRKVLRDNIQGITKPAIRRLARRGGVKRISGLIYEETRGVLKIFLENVIRDAVTYTEHARRKTVTAMDVVYSLKRQGRTLYGFGG

SEQ ID NO: 7128 - protein, 124 aa, Picea glauca
LQFNPTFSLKLKSAARSENGRMSGRGKGGKGLGKGGAKRHRKVLRDNIQGITKPAIRRLARRGGVKRISGLIYEETRGVLKIFLENVIRDAVTYTEHARRKTVTAMDVVYSLKRQGRTLYGFGG

SEQ ID NO: 7129 - protein, 124 aa, Triphysaria pusilla
  misc_feature (18)..(18): Xaa can be any naturally occurring amino acid
  misc_feature (120)..(120): Xaa can be any naturally occurring amino acid
TNQQSAQFSFLQSDNHYXAIKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLXGFGG

SEQ ID NO: 7130 - protein, 121 aa, Triticum aestivum
  misc_feature (21)..(21): Xaa can be any naturally occurring amino acid
AWSRPRSNSIRSELQATIMSXRGKGGKGLGKGGAKRHRNMLRDTIQGITKPAIRRLARRGGVKRISGLIYEETRGVLKIFLENVIRDAVTYTEHARRKTVTAMDVVYALKRQGRTLYGFGG

SEQ ID NO: 7131 - protein, 123 aa, Hordeum vulgare
GEKLLLGEGEKVVGEGEKVLGKRGAKGGKGRGKGGAKRHRKVVRDHLNGITKPAIRRLARRGGVKRISGLIYEEARHVLKVFLEATVRDALTCSEHSRRKTVTAMDVVYALKRQGRTLYGFGG

SEQ ID NO: 7132 - protein, 126 aa, Brassica juncea
STRGSNLICCSLRLQSINRSTETMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 7133 - protein, 126 aa, Brassica rapa
NRESSPTLKFSQEKEKTQFPSEKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 7134 - protein, 126 aa, Beta vulgaris
HEEQISKQYYSKRKLKSQRREKKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 7135 - protein, 126 aa, Brassica napus
  misc_feature (6)..(9): Xaa can be any naturally occurring amino acid
  misc_feature (11)..(12): Xaa can be any naturally occurring amino acid
  misc_feature (14)..(14): Xaa can be any naturally occurring amino acid
KKKKKXXXXLXXFXITNFLNRKKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 7136 - protein, 126 aa, Lactuca sativa
  misc_feature (3)..(3): Xaa can be any naturally occurring amino acid
RGXSVLRFPPLQKLLLRLSINLKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 7137 - protein, 126 aa, Lactuca sativa
LAGTFILHLFLRNLKFKNLFHLTMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 7138 - protein, 126 aa, Raphanus sativus
GKLQLRIFFIFSRKKKSNSHRKEMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 7139 - protein, 126 aa, Triticum aestivum
HRKIPNSFVFLFADAHSRAHSEKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 7140 - protein, 126 aa, Triticum aestivum
  misc_feature (1)..(1): Xaa can be any naturally occurring amino acid
XRGSLYTSPRQVYLTGEKRREAKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 7141 - protein, 126 aa, Triticum aestivum
NSARGALPLLPNLAHLSELGGAAMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 7142 - protein, 126 aa, Triticum aestivum
TSPAATTVPPILHLLAARRGSSAMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 7143 - protein, 126 aa, Triticum aestivum
  misc_feature (1)..(1): Xaa can be any naturally occurring amino acid
  misc_feature (4)..(4): Xaa can be any naturally occurring amino acid
XCRXFGTKIPKSPLFPSYSEQAAMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 7144 - protein, 126 aa, Triticum aestivum
NSARASHHRSSDSTSARSLRPSAMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 7145 - protein, 126 aa, Triticum aestivum
QATTAPRPPSALSTRTKASSSATMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 7146 - protein, 126 aa, Triticum aestivum
RHEPNPSDPICPLAAPRKEAASTMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 7147 - protein, 126 aa, Triticum aestivum
TSSLYTSQRQVNLTEEKKGEARRMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 7148 - protein, 103 aa, Zea mays
MSGRSKGGKGLSNGGTERHHKVLRDNIQDITKPVIIMLERRGGDNRISGLIYQETSGVLKIFLYNLIRDALTYTEHARHKTVTAMDVVYALKRQGRTLYGFGG

SEQ ID NO: 7149 - protein, 125 aa, Elaeis guineensis
WRIPRSFLVVVVQERGEREELEMSGRGKGGKGLGKGGAKRHRKVLRDNIQGITKPAIRRLARRGGVKRISGLIYEETRGVLKVFLENVIRDAVTYTEHARRKTVTAMDVVYALKRQGRTLYGFGG

SEQ ID NO: 7150 - protein, 125 aa, Picea glauca
  misc_feature (21)..(21): Xaa can be any naturally occurring amino acid
HEGEAEYEVRAKKKEEIQQGXKMSGRGKGGKGLGKGGAKRHRKVLRDNIQGITKPAIRRLARRGGVKRISGLIYEETRGVLKIFLENVIRDAVTYTEHARRKTVTAMDVVYSLKRQGRTLYGFGG

SEQ ID NO: 7151 - protein, 98 aa, Hordeum vulgare
GAKRHRKVLRDNIQGITKPAIRLLARRGGVKRISGLIYEEPSACSRSSSRTSSATQSPTPSTPAAPPSPSWTSSTHSSARDAPSTASEARPSTIFILF

SEQ ID NO: 7152 - protein, 52 aa, Zea mays
MYGPGKPGKGMGKGGVKRHRKVLRDNMQGITNPPIRRLASTGGVKRFSGLIY

SEQ ID NO: 7153 - protein, 150 aa, Saccharum officinarum
MSGRGKGGKGLGKGGSKRQRKALRDIIQSITKPAIRRLARRGGVKHIYGLMYQETRGVLKILLENIIRHTVTYTKHTRRKTSTAMDVVYALKRHSRTLYGFCGYVIPHPVVNCMWWRTGSSSVPRIECSRLSVSMLRPQESELYLRSEGR

SEQ ID NO: 7154 - protein, 59 aa, Saccharum officinarum
PFEAPAAAKSGRGQGDKGLGKGGAKGNRKVLRENIQGITKPAIRRLARRGGVKGISGVI

SEQ ID NO: 7155 - protein, 124 aa, Festuca arundinacea
  misc_feature (19)..(20): Xaa can be any naturally occurring amino acid
  misc_feature (22)..(22): Xaa can be any naturally occurring amino acid
  misc_feature (24)..(24): Xaa can be any naturally occurring amino acid
HEARIPTPPHTPLAARPDXXAXSXRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 7156 - protein, 124 aa, Raphanus sativus
  misc_feature (58)..(59): Xaa can be any naturally occurring amino acid
GQISFSCKSPSPINSTDLTETMSGRGKGGKGLGKGGAKRHRKVLRDNIQGITKPAIRXXARRGGVKRISGLIYEETRGVLKIFLENVIRDAVTYTEHARRKTVTAMDVVYALKRQGRTLYGFGG

SEQ ID NO: 7157 - protein, 106 aa, Citrus sinensis
MSGRGKGGKGLGKGGAKRHRKVLRDNIQGITKPAIRRLARRGGVKRISGLIYEETRGVLKIFLENVIRHAVTYTEHAKEKNREPRWTSFYPLQKGGGRTLLWILGG

SEQ ID NO: 7158 - protein, 127 aa, Festuca arundinacea
ARGPPSTTASSSSIRSQQLQSRSAMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 7159 - protein, 127 aa, Festuca arundinacea
  misc_feature (24)..(24): Xaa can be any naturally occurring amino acid
GTRHHQHHRSSSSIRSQQLESRSXMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 7160 - protein, 127 aa, Ipomoea nil
KSTCPFYLSLHKFQTLDFFLHSAKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 7161 - protein, 127 aa, Lactuca sativa
RGFSIFISLQKSEAFSVCEVIIPTMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 7162 - protein, 127 aa, Rosa hybrid cultivar
TSNHLNSLIFHQKQSFSPLNFPVKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 7163 - protein, 127 aa, Triticum aestivum
GRRATTAPPIPHSLQARTKERPSAMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 7164 - protein, 127 aa, Triticum aestivum
ISPHRRPPPATHTQQPSEARRRSKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 7165 - protein, 127 aa, Triticum aestivum
  misc_feature (3)..(3): Xaa can be any naturally occurring amino acid
CRXFGTRAATHTEKPISPEKEASTMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 7166 - protein, 127 aa, Triticum aestivum
NHPTSRHHHRSSSVSISVSSKQSTMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 7167 - protein, 127 aa, Triticum aestivum
GNSHHQASSAHTHQPSSPEREASKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 7168 - protein, 127 aa, Triticum aestivum
HYQPPPLLQPHISSSAARRGSSATMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 7169 - protein, 127 aa, Triticum aestivum
TAPAATTVPPIPLHPLAGRRGSSAMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 7170 - protein, 126 aa, Pinus taeda
RPGIVCYSSSSLFEYQRNLPSGKMSGRGKGGKGLGKGGAKRHRKVLRDNIQGITKPAIRRLARRGGVKRISGLIYEETRGVLKIFLENVIRDAVTYTEHARRKTVTAMDVVYSLKRQGRTLYGFGG

SEQ ID NO: 7171 - protein, 126 aa, Secale cereale
RHEAAPSTSIRSPSSNQGRSSATMSGRGKGGKGLGKGGAKRHRKVLRDNIQGITKPAIRRLARRGGVKRISGLIYEETRGVLKIFLENVIRDTVTYTEHARRKTVTAMDVVYALKRQGRTLYGFGG

SEQ ID NO: 7172 - protein, 120 aa, Glycine max
KITIPNSPKFSLKKKQQCLVAEKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 7173 - protein, 105 aa, Triticum aestivum
  misc_feature (89)..(89): Xaa can be any naturally occurring amino acid
  misc_feature (96)..(96): Xaa can be any naturally occurring amino acid
  misc_feature (103)..(103): Xaa can be any naturally occurring amino acid
MTGRGKGGKGLGKGGAKRHRKILRDNIQGITKPAIRRLARRGGVKRISAMIYEETRGVLKTFLEGVIRDAVTYTEHAKRKTVTSLDVVXALKRQGXNPIRVWXLT

SEQ ID NO: 7174 - protein, 126 aa, Triticum aestivum
SDSLQSRQQLLFFLITLSRRGAAMSGRDKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 7175 - protein, 86 aa, Festuca arundinacea
HEGKVLRDNIQGITKPAIRRLARRGGVKRISGLIYEETRGVLKIFLENVIRDAVTYTEHARRKTVTAMDVVYALKRQGRTLYGFGG

SEQ ID NO: 7176 - protein, 125 aa, Solanum tuberosum
MLHRFAKFKTLETSSSSNFSVKMSGHGKGGKGLGKGGAKRHRKVLRDNIQGITKPAIRRLARRGGVKRISGLIYEETRGVLKIFLENVIRDSVTYTEHARRKTVTAMDVVYALKRQGRTLYGFGG

SEQ ID NO: 7177 - protein, 125 aa, Picea glauca
  misc_feature (2)..(2): Xaa can be any naturally occurring amino acid
GXDGVLVYRAKKGRPENRRNRNMSGRGKGGKGLGKGGAKRHRKVLRDNIQGITKPAIRRLARRGGVKRISGLIYEETRGVLKIFLENVIKDAVTYTEHARRKTVTAMDVVYSLKRQGRTLYGFGG

SEQ ID NO: 7178 - protein, 125 aa, Saccharum officinarum
QLTPPTASNRKKIPNPLVSAAKVSGRGKGGRGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 7179 - protein, 84 aa, Pisum sativum
RQVLRDNIQGITKPAIRRLARRGGVKRISGLIYEETRGVLKIFLENVIRDAVTYTEHARRKTVTAMDVVYALKRQGRTLYGFGG

SEQ ID NO: 7180 - protein, 99 aa, Hordeum vulgare
MSGRGKGGKGLGKGGAKRHRKVLRDNIQGITKPAIQLLARRGSMKRISGLIYEETRGVLKIWLENVMRDAVTYTEHSRRRTVTGMDGVYALNHHGASLC

SEQ ID NO: 7181 - protein, 83 aa, Rosa hybrid cultivar
KVLRDNIQGITKPAIRRLARRGGVKRISGLIYEETRGVLKIFLENVIRDAVTYTEHARRKTVTAMDVVYALKRQGRTLYGFGG

SEQ ID NO: 7182 - protein, 103 aa, Triticum aestivum
  misc_feature (14)..(14): Xaa can be any naturally occurring amino acid
  misc_feature (51)..(51): Xaa can be any naturally occurring amino acid
  misc_feature (69)..(69): Xaa can be any naturally occurring amino acid
  misc_feature (73)..(73): Xaa can be any naturally occurring amino acid
  misc_feature (78)..(79): Xaa can be any naturally occurring amino acid
  misc_feature (84)..(84): Xaa can be any naturally occurring amino acid
CPAAARAGRASARXGAKRHRKVMRDNIQGITKPAIRRLARRGGVKRISGLXYEETRGVLKIFLENVIRXAVTXTEHAXXKTVTXMDVVYALKRQGRTLYGFGG

SEQ ID NO: 7183 - protein, 68 aa, Sesamum indicum
MSGRGKGGKGLGKGGANRHRKVLRDNIQGITKPAIRRLARRGGVKRISGLIYEETRGVLKILLENVTR

SEQ ID NO: 7184 - protein, 75 aa, Sesamum indicum
RFSNCRKMSGRGKGGKGLGKGGANRHRKVLRDNIQGITKPAIRRLARRGGVKRISGLIYEETRGVLKILLENVTR

SEQ ID NO: 7185 - protein, 74 aa, Triticum aestivum
MSGRGKGGKGLGKGGSKGHRKVLPYKVQGGGKPVIRWMAQNGRREAHLGAHLRGDPRGAQNLPREGYPGCRYLH

SEQ ID NO: 7186 - protein, 128 aa, Brassica rapa
NYNRESSPTLKFSQEKEKTQFPSEKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 7187 - protein, 128 aa, Gossypium hirsutum
NSCDSVFSILLRPLKFSLKFQLFTTMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 7188 - protein, 128 aa, Festuca arundinacea
ARGRHQHHLSSSSIRSQQQLQSRSAMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 7189 - protein, 128 aa, Festuca arundinacea
ARGILPATPTHESNSSPQKRENSPEMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 7190 - protein, 128 aa, Festuca arundinacea
GTRLILPATPTHESNSPEEKENPPEMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 7191 - protein, 128 aa, Mesembryanthemum crystallinum
GRVDTQSVPVVNQNKREREREKERKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 7192 - protein, 128 aa, Triticum aestivum
HTAATSTTSKPHRAAKRSSPEREAKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 7193 - protein, 128 aa, Triticum aestivum
LPRTPEKKIPQLFVSVSEEVAAAAAMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 7194 - protein, 125 aa, Beta vulgaris
  misc_feature (74)..(75): Xaa can be any naturally occurring amino acid
  misc_feature (88)..(88): Xaa can be any naturally occurring amino acid
LSPKKILLTFFLSLKISEKNQKMSGRGKGGKGLGKGGAKRHRKVLRDNIQGITKPAIRRLARRGGVKRISGLIXXETRGVLKIFLENXIRDAVTYTEHARRKTVTAMDVVYALKRQGRTLYGFGG

SEQ ID NO: 7195 - protein, 157 aa, Saccharum officinarum
MDVSGAGAGGKAKKGAGGRKAGGGPRKKSVTRSVKAGLQFPVGRIGRYLKKGRYAQRVGTGAPVYLAAVLEYLAAEVLELAGNAARDNKKTRIIPRHVLLAIRNDEELGKLLAGVTIAHGGVLPNINPVLLPKKVAEKAAAKEPKSPKKAAKSPKKA

SEQ ID NO: 7196 - protein, 158 aa, Saccharum officinarum
MDVSGAGAGGKAKKGAGGRKAGGGPRKKSVTRSVKAGLQFPVGRIGRYLKKGRYAQRVGTGAPVYLAAVLEYLAAEVLELAGNAARDNKKTRIIPRHVLLAIRNDEELGKLLAGVTIAHGGVLPNINPVLLPKKVAEKASAAKEPKSPKKAAKSPKKA

SEQ ID NO: 7197 - protein, 155 aa, Unknown
  Sequence found in Organisms: Sorghum bicolor, Saccharum officinarum
MDVSGAGAGGKAKKGAAGRKAGGPRKKSVSRSVKAGLQFPVGRIGRYLKKGRYAQRVGTGAPVYLAAVLEYLAAEVLELAGNAARDNKKTRIIPRHVLLAIRNDEELGKLLAGVTIAHGGVLPNIHSVLLPKKVAEKAAKEPKSPKKAAKSPKKA

SEQ ID NO: 7198 - protein, 158 aa, Saccharum officinarum
MDVSGAGAGGKAKKGAGGRKAGGGPRKKSVTRSVMAGLQFLVGRIGRYLKKGRYAQRVGTGAPVYLAAVLEYLAGEVLELAGNAARDNKKTRIIPRHVLLAIRNDEELGKLLAGVTIAHGGVLPNINPVLLPKKVAEKASAANEPKSPKKAVKSPKKA

SEQ ID NO: 7199 - protein, 156 aa, Cenchrus ciliaris
MDVSGAGATGKVKKGAAGRKAGGPRKKSVSRSVKAGLQFPVGRIGRYLKKGRYAQRVGTGAPVYLAAVLEYLAAEVLELAGNAARDNKKTRIIPRHVLLAIRNDEELGKLLAGVTIAHGGVLPNINPVLLPKKVAEKAAAKEAKSPKKAAKSPKKA

SEQ ID NO: 7200 - protein, 156 aa, Saccharum officinarum
MDSTGAGAGGKVKKGAGGRKAGGPRKKSVSRSVKAGLQFPVGRIGRYLKKGRYAQRVGTGAPVYLAAVLEYLAAEVLELAGNAARDNKKTRIIPRHVLLAIRNDEELGKLLAGVTIAHGGVLPNIHSVLLPKKTAEKASSKEPKSPKKAAKSPKKA

SEQ ID NO: 7201 - protein, 167 aa, Saccharum officinarum
MDVSGAGAGGKAKKGAGGRKAGGGPRKKSVTRSVKAGLQFPVGRIGRYLKKGRYAQRVGTGAPVYLAAVLEYLAAEVLELAGNAARDNKKTRIIPRHVLLAIRNDEELGKLLAGVTIAHGGVLPQPRAPAQEGRREGRGSRPRRPPSPPRRHREAAISAVMLNAHVQ

SEQ ID NO: 7202 - protein, 159 aa, Saccharum officinarum
MDSTGAGAGGKVKKGAGGRKAGGPRKKSVSRSVKAGLQFPVGRIGRYLKKGRYAQRVGTGAPVYLAAVLEYLAAEVLELAGNAARDNKKTRIIPRHVLLAIRNDEELGKLLAGVTIAHGGVLPNIHSVLLPKKTAEKASSGGSKEPKSPKKAAKSPKKA

SEQ ID NO: 7203 - protein, 173 aa, Saccharum officinarum
MDVSGAGAGGKAKKGAAGRKAGGPRKKSVSRSVKAGLQFPVGRIGRYLKKGRYAQRVGTGAPVYLAAVLEYLAAEVLELAGNAARDNKKTRIIPRHVLLAIRNDEELGKLLAGVTIAHGGVLPPLCAPPQEGGREGGQSRPRRPPSPPRRPRVLSSLRGQGRLLCCPVRLDHV

SEQ ID NO: 7204 - protein, 171 aa, Saccharum officinarum
MDVSGAGAGGKAKKGAAGRKAGGPRKKSVSRSVKAGLQFPVGRIGRYLKKGRYAQRVGTGAPVYLAAVLEYLAAEVLELAGNAARDNKKTRIIPRHVLLAIRNDEELGKLLAGVTIAHGGVLPPLCAPPQEGGREGGQSRPRRPPSPPRRRRVLSSLEEKGGSSISAVLLD

SEQ ID NO: 7205 - protein, 157 aa, Unknown
  Sequence found in Organisms: Gossypium hirsutum, Zea mays
MDASGAGSKGKKGAAGRKAGGPRKKSVTRSVKAGLQFPVGRIGRYLKKGRYAQRVGTGAPVYLAAVLEYLAAEVLELAGNAAKDNKKTRIIPRHVLLAIRNDEELGKLLAGVTIAHGGVLPNIHSVLLPKKAAEKAASGGSKEPKSPKKGAKSPKKA

SEQ ID NO: 7206 - protein, 156 aa, Zea mays
MDASAAGAGGKAKKGAAGRKAGGPRKKSVTRSVKAGLQFPVGRIGRYLKKGRYAQRVGTGAPVYLAAVLEYLAAEVLELAGNAAKDNKKTRIIPRHVLLAIRNDEELGKLLSGVTIAHGGVLPNINPVLLPKKTAEKAAAKEAKSPKKAAKSPKKA

SEQ ID NO: 7207 - protein, 157 aa, Sorghum bicolor
MDASGAGGKAKKGAAGRKAGGPRKKSVSRSVKAGLQFPVGRIGRYLKKGRYAQRVGTGAPVYLAAVLEYLAAEVLELAGNAARDNKKTRIIPRHVLLAIRNDEELGKLLAGVTIAHGGVLPNINPVLLPKKVAEKAASGGSKEAKSPKKAAKSPKKA

SEQ ID NO: 7208 - protein, 70 aa, Saccharum officinarum
MDVSGAGAGGKANNGAGGRKAGGGPRKKSVTRSVKAGLQFPVGRIWRYLKKGRYAQRVGTGAPVYLAAVL

SEQ ID NO: 7209 - protein, 160 aa, Sorghum bicolor
MDSTGAGAGGKVKKGAGGRKAGGGPRKKSVSRSVKAGLQFPVGRIGRYLKKGRYAQRVGTGAPVYLAAVLEYLAAEVLELAGNAARDNKKTRIIPRHVLLAIRNDEELGKLLSGVTIAHGGVLPNINPVLLPKKTAEKASSGGSKEPKSPKKAAKSPKKA

SEQ ID NO: 7210 - protein, 159 aa, Saccharum officinarum
MDSTGAGAGGKVKKGAGGRKAGGPRKKSVSRSVKAGLQFPVGRIGRYLKKGRYAQRVGTGAPVYLAAVLEYLAAEVLELAGNAARDNKKTRIIPRHVLLAIRNDEELGKLLAGVTIAHGGVLPNINPVLLPKKTAEKASSGGSKEPKSPKKAAKSPKKA

SEQ ID NO: 7211 - protein, 157 aa, Saccharum officinarum
MDASGAGGKAKKGAAGRKAGGPRKKSVSRSVKAGLQFPVGRIGRYLKKGRYAQRVGTGAPVYLAAVLEYLAAEVLELAGNAARDNKKTRIIPRHVLLAIRNDEELGKLLAGVTIAHGGVLPNINPVLLPKKVAEKAASGGSKQAKSPKKAAKSPKKA

SEQ ID NO: 7212 - protein, 186 aa, Zea mays
  misc_feature (33)..(33): Xaa can be any naturally occurring amino acid
SQFTPLIFSRLEPLKFPPLASRSSTCSHGRQRXGSKGKKGAAGRKAGGPRKKSVTRSVKAGLQFPVGRIGRYLKKGRYAQRGHWRPRLPRRRPGVPRRRGSGVGRERGERQQEDAHHPAPRAPGDPQRRGAREAAGRRHHRARRRSSPTSTPCSCPRRRRKKRPAPATRNPSSPRRAPSPPKRLRK

SEQ ID NO: 7213 - protein, 159 aa, Saccharum officinarum
MDSTGAGAGGKVKKGAGGRKAGGPRKKSVSRSVKAGLQFPVGRIGRYLKKGRYAQRVGTGAPVYLAAVLEYLAAEVLELAGNAARDNKKTRIIPRHVLLAIRNDEELGKLLAGVTIAHGGVLPNINPVLLPKKTAEKASSGGSKEPKSPKKGAKSPKKA

SEQ ID NO: 7214 - protein, 151 aa, Saccharum officinarum
MDASGAGGKAKKGAAGRKAGGPRKKSVSRSVKAGLQFPVGRIGRYLKKGRYAQRVGTGAPVYLAAVLEYLAAEVLELAGNAARDNKKTRIIPRHVLLAIRNDEELGKLLAGVTIAHGGVLPQPGAPAQEGGREGGQSPQRRPPSPPRRLRK

SEQ ID NO: 7215 - protein, 74 aa, Saccharum officinarum
MKTRIIPRHVLLAIRNDEELGKLLAGVTIAHGGVLHNINPVLLPKKVAEKAAANEPKSPKKAAKSPKKAYGGRH

SEQ ID NO: 7216 - protein, 159 aa, Oryza sativa
MDAAGAGAGGKLKKGAAGRKAGGPRKKAVSRSVKAGLQFPVGRIGRYLKKGRYAQRIGTGAPVYLAAVLEYLAAEVLELAGNAARDNKKNRIIPRHVLLAIRNDEELGKLLAGVTIAHGGVLPNINPVLLPKKTAEKAAAAGKEAKSPKKAAGKSPKKA

SEQ ID NO: 7217 - protein, 159 aa, Panicum virgatum
MDNTGTGAGGKVKKGAGGRKTGGPRKKSVTRSVKAGLQFPVGRIGRYLKKGRYAQRVGSGAPVYLAAVLEYLAAEVLELAGNAARDNKKTRIIPRHVLLAIRNDEELGKLLSGVTIAHGGVLPNINPVLLPKKTAEKASSGGSKEAKSPKKAAKSPKKA

SEQ ID NO: 7218 - protein, 159 aa, Panicum virgatum
MDTTGTGAGGKVKKGAGGRKTGGPRKKSVTRSVKAGLQFPVGRIGRYLKKGRYAQRVGSGAPVYLAAVLEYLAAEVLELAGNAARDNKKTRIIPRHVLLAIRNDEELGKLLSGVTIAHGGVLPNINPVLLPKKTAEKASSGGSKEAKSPKKAAKSPKKA

SEQ ID NO: 7219 - protein, 244 aa, Zea mays
  misc_feature (34)..(34): Xaa can be any naturally occurring amino acid
SQFTPLIFSRLEPLKFPPLASRSSTCSSHGRQRXGSKGKKGAAGRKAGGPRKKSVTRSVKAGLQFPVGRIGRYLKKGRYAQRVGTGAPVYLAAVLEYLAAEVLELAGNAAKDNKKTRIIPRHVLLAIRNDEELGKLLAGVTIAHGGVLPNIHSVLLPKKAAEKAASGGNKEPKSPKKGAKSPQKGLKSRVFICAVCCSMFVSRSVDGDVSCSKNPALGALIGRFPPFNREKTLHQVQKAPVGGN

SEQ ID NO: 7220 - protein, 157 aa, Saccharum officinarum
MDSTGAGAGGKVKKGAGGRKAGGPRKKSVSRSVKAGLQFPVGRIGRYLKKGRYAQRVGTGAPVYLAAVLEYLAAEVLELAGNAARDNKKTRIIPRHVLLAIRNDEELGKLLAGVTIAHGGVLPPLSSAAQEDGREGVQSRPRRLPSPPRRHRVSRMI

SEQ ID NO: 7221 - protein, 157 aa, Saccharum officinarum
MDSTGAGAGGKVKKGAGGRKAGGPRKKSVSRSVKAGLQFPVGRIGRYLKKGRYAQRVGTGAPVYLAAVLEYLAAEVLELAGNAARDNKKTRIIPRHVLLAIRNDEELGKLLAGVTIAHGGVLPPLGSAAQEDGGEGVQSRPRKPPSPPRRHRVSRQI

SEQ ID NO: 7222 - protein, 202 aa, Saccharum officinarum
PRRDTDCLSISKRSSSSFSTAGGHGRERSGSLLKGEEGRRRAQGRRAEEEVGVAVRQGRAAVPRRPHRAVPQEGPVRAARLHGRPRLPRRRPRVPRRRGARARRQRGQGQQEDAHHPAPRAPGYPQRRGARQAAGRRHHRPRRRPPQHPLCAPPQEGGREGGQGAQVVQYGRQVLQESLECSRFLEDKGSSSFKPLPLVLSC

SEQ ID NO: 7223 - protein, 159 aa, Sorghum bicolor
MDSTAAGAGGKAKKGAAGRKAGGPRKKSVSRSVKAGLQFPVGRIGRYLKKGRYAQRVGTGAPVYLAAVLEYLAAEVLELAGNAARDNKKTRIIPRHVLLAIRNDEELGKLLSGVTIAHGGVLPNINPVLLPKKTAEKASTGGSKEAKSPKKAAKSPKKA

SEQ ID NO: 7224 - protein, 157 aa, Panicum virgatum
MDASGATGKVKKGAAGRKAGGPRKKSVSRSVKAGLQFPVGRIGRYLKKGRYAQRVGTGAPIYLAAVLEYLAAEVLELAGNAARDNKKTRIIPRHVLLAIRNDEELGKLLAGVTIAHGGVLPNINPVLLPKKAAEKAASGGAKEAKSPKKGAKSPKKA

SEQ ID NO: 7225 - protein, 167 aa, Saccharum officinarum
  misc_feature (151)..(151): Xaa can be any naturally occurring amino acid
  misc_feature (158)..(158): Xaa can be any naturally occurring amino acid
  misc_feature (167)..(167): Xaa can be any naturally occurring amino acid
MDSTGAGAGGKVKKGAGGRKAGGPRKKSVSRSVKAGLQFPVGRIGRYLKKGRYAQRVGTGAPVYLAAVLEYLAAEVLELAGNAARDNKKTRIIPRHVLLAIRNDEELGKLLAGVTIAHGGVLPNINPFCCPRRRRRRRPAAGARSPSRPRXAPSPPRXIDCPARSNX

SEQ ID NO: 7226 - protein, 168 aa, Saccharum officinarum
MDSTGAGAGGKVKKGAGGRKAGGPRKKSVSRSVKAGLQFPVGRIGRYLKKGRYAQRVGTGAPVYLAAVLEYLAAEVLELAGNAARDNKKTRIIPRHVLLAIRNDEELGKLLAGVTIAHGGVLPQPGSAAQEDGGEGVQSRPRRPPSPPRKHRLSSLIQCLALPCTSDA

SEQ ID NO: 7227 - protein, 400 aa, Zea mays
LRCWHGREDSPIDVVVVNDSGGVRNASHLLKYDSMLGTFKADVKIVDDTTISVDGKPITVVSSRDPLKLPWGELGIDIVIEGTGVFVDGPGAGKHIQAGAKKVIITAPAKGADIPTYVVGVNEGDYDHSVADIISNASCTTNCLAPFVKILDEEFGIVKGTMTTTHSYTGDQRLLDASHRDLRRARAAALNIVPTSTGAAKAVALVLPQLKGKLNGIALRVPTPNVSVVDLVINTVKTGITADDVNASAPGPGGKAKKGAPGRKPGGPRKKSVTRSVKAGLQFPFGRIGRYLKKGRYAQRVGTGAPVYLAAVLEYLAAEVLELAGNAAKDNKKTRIIPRHVLLAIRNDEELGKLLSGVTIAHGGVLPNINPVLLPKKTAEKAAAKEAKSPKKAAKSPKKA

SEQ ID NO: 7228 - protein, 159 aa, Cenchrus ciliaris
MDATGTGAGGKVKKGAAGRKAGGPRKKSVSRSVKAGLQFPVGRIGRYLKKGRYAQRVGTGAPVYLAAVLEYLAAEVLELAGNAARDNKKSRIIPRHVLLAIRNDEELGKLLAGVTIAHGGVLPNINPVLLPKKTAEKASSGGSKEAKSPKKAAKSPKKA

SEQ ID NO: 7229 - protein, 150 aa, Zea mays
MDVSGAGGKAKKGAAGRKAGGPTKKSVSRSSRAGLQFPVSRVGRYLKKGRYAQRVGTGAPVYLAAVLEYLAAEVLELAGNAARDNKKTRIIPRHVLLAIRNDEELGKLLAGVTIAHGGVLPNIHTVLLPKKVAEKAAKEPKKAAKSPKKA

SEQ ID NO: 7230 - protein, 159 aa, Zea mays
MDSTGTGAGGKGKKGAAGRKVGGPRKKSVSRSVKAGLQFPVGRIGRYLKKGRYAQRVGTGAPVYLAAVLEYLAAEVLELAGNAARDNKKTRIIPRHVLLAIRNDEELGKLLGGVTIAHGGVLPNINPVLLPKKTAEKASSVGSKEAKSPKKAAKSPKKA

SEQ ID NO: 7231 - protein, 159 aa, Panicum virgatum
MDSTGTGAGGKVKKGAAGRKTGGPRKKAVSRSVKAGLQFPVGRIGRYLKKGRYAQRVGTGAPVYLAAVLEYLAAEVLELAGNAARDNKKTRIIPRHVLLAIRNDEELGKLLSGVTIAHGGVLPNINPVLLPKKTAEKASSGGSKEAKSPKKAAKSPKKA

SEQ ID NO: 7232 - protein, 57 aa, Saccharum officinarum
AFLPRIHCFSKRSSSSAAVMDVSGAGAGGKANKGAGGRMAVGWPRNKSVTRSVNAGL

SEQ ID NO: 7233 - protein, 95 aa, Saccharum officinarum
IPPISRALSPREATRSAAAAMDSTGAGAGGKVKKGAGGRKAGGPRKKVGVEVRESRTPSSPRPASGATLEEGPVRAARRNRRPRLPRRRPQVPRR

SEQ ID NO: 7234 - protein, 74 aa, Pennisetum glaucum
MDATGTGAAGKVKKGAAGRKAGGPRKKSVSRSVKAGLQFPVGPHRALPQEGPLRAARRHRRPCLPRRRPRVPGR

SEQ ID NO: 7235 - protein, 159 aa, Zea mays
MDATGTGAGGKAKKGAAGRKAGGPRKKSVTRSVKAGLQFPVGRIGRYLKKGRYAQRVGSGAPVYLAAVLEYLAAEVLELAGNAAKDNKKTRIVPRHVLLAIRNDEELGKLLTGVTIAHGGVLPNINPVLLPKKTAEKASSGGSKEAKSPKKAAKSPKKA

SEQ ID NO: 7236 - protein, 157 aa, Panicum virgatum
MDASGATGKVKKGAAGRKAGGPRKKAVSRSVKAGLQFPVSRIGRYLKKGRYAQRVGTGAPIYLAAVLEYLAAEVLELAGNAARDNKKTRIIPRHVLLAIRNDEELGKLLAGVTIAHGGVLPNINPVLLPKKVAEKATSGGAKEGKSPKKGAKSPKKA

SEQ ID NO: 7237 - protein, 155 aa, Avena sativa
MDVSSTATGGKAKKGAAGRKAGGPRKKSVTRSVKAGLQFPVGRVGRYLKKGRYAQRVGTGAPVYLAAVLEYLAAEVLELAGNAAKDNKKSRIIPRHLLLAVRNDEELGKLLAGVTIAHGGVLPKINPVLLPKKTAEKAAKEPKSPKKTAKSPKKA

SEQ ID NO: 7238 - protein, 155 aa, Saccharum officinarum
  misc_feature (37)..(37): Xaa can be any naturally occurring amino acid
HGSKRNRSAGKEKKGSAGRKAGGPRKSSVSRSVKAGXQFPVGRIGRYLKKGRYAQRVGTGAPVYLAAVLEYLAAEVLELAGNAARDNKKTRIIPRHVLLAIRNDEELGKLLAGVTIAHGGVLPNIHSVLLPKKVAEKAAKEPKSPKKAAKSPKKA

SEQ ID NO: 7239 - protein, 158 aa, Saccharum officinarum
MDASGAGGKAKKGAAGRKAGGPRKKSVSRSVKAGLQFPVGRIGRYLKKGRYAQRVGTGAPVYLAAVLEYLAAEVLELAGNAARDNKKTRIIPRHVLLAIRNDEELGKLLAGVTIAHGGVLPNINPVLLPKKVAEKAASGGSKQAKSPKKAVKFPPESL

SEQ ID NO: 7240 - protein, 148 aa, Gerbera hybrid cultivar
MDGAGKAKKGAGGRKGGGPRKKAVTRSVKAGLQFPVGRIGRFLKKGRYAQRVGSGAPVYLAAVLEYLAAEVLELAGNAARDNKKNRIIPRHVLLAIRNDEELGKLLAGVTIAHGGVLPNINPVLLPKKAAAAKEPKSPSKATKSPKKA

SEQ ID NO: 7241 - protein, 155 aa, Avena sativa
MDVPSTATGGKAKKGGAGRKAGGPRKKSVTRSVKAGLQFPVGRIGRYLKKGRYAQRVGTGAPVYLAAVLEYLAAEVLELAGNAAKDNKKSRIIPRHLLLAIRNDEELGKLLAGVTIAHGGVLPKIHSVLLPKKAAEKAEKAAKSQKKATKSPKKA

SEQ ID NO: 7242 - protein, 104 aa, Saccharum officinarum
MDVSGAGAGGKAKKGAGGRKAGGGPRKKSVTRSVKAGLQFPVGRIGRYLKKGRYAQRVGTGAPVYLAAVLEYLAAEVLELAGNVARDNKKTSHHPAPRASGHPQ

SEQ ID NO: 7243 - protein, 164 aa, Saccharum officinarum
MDVSGAGAGGKAKRGAGGRKAGGGPRKKSVTRSVKAGLQFPVGRIGRYLKKGRYAQRVGTGAPVYLAAVLEYLAAEVLELAGNAARDNKKTRIIPRHVLLAIRNDEELGKLLAGVTIAHGGGLPNINPVLLAKKVAEKGAAKEPKSPKKAASPPRSLEGSSLPV

SEQ ID NO: 7244 - protein, 150 aa, Beta vulgaris
MDTAGGKGKKGAAGRKGGGPKKKPVSRSVKAGLQFPVGRIGRYLKKGRYAQRVGTGAPVYLAAVLEYLAAEVLELAGNAARDNKKNRIIPRHVLLAVRNDDELGKLLAGVTIAHGGVLPNINPVLLPKKTAEKAAKEPKSPKAAKSPKKA

SEQ ID NO: 7245 - protein, 155 aa, Festuca arundinacea
MDVSSTAAGGKAKKGAAGRKAGGPRKKSVTRSVKAGLQFPVGRVGRYLKKGRYAPRVGTGAPVYLAAVLEYLAAEVLELAGNAAKDNKKSRIIPRHLLLAVRNDEELGKLLAGVTIAHGGVLPKINPVLLPKKTADKAAKEPKSPKKTAKSPKKA

SEQ ID NO: 7246 - protein, 154 aa, Saccharum officinarum
MDVSGAGAGGKAKKGAAGRKAGGPRKKSVSRSVKAGLQFPVGRIGRYLKKGRYAQRVGTGAPVYLAAVLEYLAAEVLELAGNAARDNKKTRIIPRHVLLAIRNDEELGKLLAGVTIGHGGGLPNIHFGLLPKKVAQKAAKNPIPQERRQVPKKA

SEQ ID NO: 7247 - protein, 154 aa, Brachypodium distachyon
MDTGAGKAKKGAGGRKAGGGGGPRKKSVTRSVKAGLQFPVGRIGRYLKKGRYAQRVGSGAPVYLAAVLEYLAAELLELAGNAARDNKKTRIIPRHLLLAIRNDDELGKLLAGVTIAHGGVMPKINQVLLPKKTAAKEPKEPKSPKKAAKSPKKA

SEQ ID NO: 7248 - protein, 154 aa, Brachypodium distachyon
MDVSGTGAGKAKKGAAGRKAGGPRKKSVTRSVRAGLQFPVGRIGRYLKKGRYAQRVGTGAPVYMAAVLEYLAAEVLELAGNAARDNKKSRIIPRHVLLAVRNDDELGKLLAGVTIAHGGVLPKINPILLPKKTAEKAPKEPKSPKKAATPKKAD

SEQ ID NO: 7249 - protein, 139 aa, Saccharum officinarum
MDVSGAGAGGKAKKGAAGRKASGPRKKSVSRSVKAGLQFPVGRIGRYLKKGRYSHRVGTGAPVYLAVVLEYLAAEVLELAGYAGRDNKKTRIIPRHVLLAIRNDQELGKLLAGVTIAHGGVLPNIHYVLLPKKVGDKAV

SEQ ID NO: 7250 - protein, 151 aa, Panicum virgatum
MDAGAPKVKKAAAGRKLGGPKKKPVSRSVKAGLQFPVGRIGRYLKKGRYAQRVGTGAPVYLAAVLEYLAAEVLELAGNAARDNKKNRIIPRHVLLAIRNDEELGKLLAGVTIAHGGVLPNIHSVLLPKKAAEKAEKAAKSPKKAAAKSPKK

SEQ ID NO: 7251 - protein, 157 aa, Sorghum bicolor
MDGGGAKAKKAAAGRKLGGGGPKKKPVSRSVKAGLQFPVGRIGRYLKKGRYAQRVGTGAPVYLAAVLEYLAAEVLELAGNAARDNKKNRIIPRHVLLAIRNDEELGKLLAGVTIAHGGVLPNINSVLLPKKAAEKAEKAASATKSPKKAAAAKSPKK

SEQ ID NO: 7252 - protein, 156 aa, Saccharum officinarum
MDGGGTKVKKAAAGRKLGGGGPKKKPVSRSVKAGLQFPVGRIGRYLKKGRYAQRVGTGAPVYLAAVLEYLAAEVLELAGNAARDNKKNRIIPRHVLLAIRNDEELGKLLAGVTIAHGGVLPNIHSVLLPKKAAERAEKAATATKSPKKAAAKSPKK

SEQ ID NO: 7253 - protein, 156 aa, Saccharum officinarum
MDGGGAKVKKAAAGRKLGGGGPKKKPVSRSVKAGLQFPVGRIGRYLKKGRYAQRVGTGAPVYLAAVLEYLAAEVLELAGNAARDNKKNRIIPRHVLLAIRNDEELGKLLAGVTIAHGGVLPNIHSVLLPKKAAERAEKAATATKSPKKAAAKSPKK

SEQ ID NO: 7254 - protein, 164 aa, Zea mays
MDASGAGSKAKKGAAGRKAGGPRKKSVSRSVKAGLQFPVGRIGRYLKKGRYAQRVGTGAPVYLAAVLEYLAAEVLELAGNAAKDNKKTRIVPRHVLLAIRNDVELGKLLAGVTIAHGGVLPNINPVLLPKKVAEKASSGGSKESKSPKKAAKSPKKAAKSPKKA

SEQ ID NO: 7255 - protein, 155 aa, Avena sativa
MDVSSTAAGAKGKKGAAGRKAGGPRKKSVTRSVKAGLQFPVGRVGRYLKKGRYAQRVGTGAPVYLAAVLEYLGAEVLELAGNAAKDNKKSRIIPRHLLLAVRNDEELGKLLAGVTTAHGGVLPKINPVLLPKKTAEKAAKEPKSPKKTAKSPKKA

SEQ ID NO: 7256 - protein, 155 aa, Hordeum vulgare
MDVSATGAGAKAKKGAAGRKAGGPRKKSVSRSVKAGLQFPVGRIGRYLKKGRYAQRVGTGAPVYLAAVLEYLAAELLELAGNAAKDNKKSRIIPRHLLLAVRNDEELGKLLAGVTIAHGGVVPKINPVLLPKRTAEKAPKEGKSPKKAAKSPKKA

SEQ ID NO: 7257 - protein, 149 aa, Manihot esculenta
MESGGKVKKGAGGRKGGGPKKKPVSRSVKAGLQFPVGRIGRYLKKGRYSQRVGTGAPVYLAAVLEYLAAEVLELAGNAARDNKKNRIIPRHVLLAVRNDEELGKLLAGVTIAHGGVLPNINPVLLPKKSEKAAKEPKSPSKATKSPKKA

SEQ ID NO: 7258 - protein, 150 aa, Liriodendron tulipifera
MESTGKVKKGAGGRKGGGPKKKPVSRSVKAGLQFPVGRIGRYLKKGRYSQRVGTGAPVYLAAVLEYLAAEVLELAGNAARDNKKNRIIPRHVLLAVRNDEELGKLLHGVTIAHGGVLPNINPVLLPKKTAEKAAKEPKSPTKAAKSPKKA

SEQ ID NO: 7259 - protein, 150 aa, Zea mays
MDVSGAGGKAKKGAAGRKAGGPTKKSVSRSSRAGLQFPVSRVGRYLKKGRYAQRVGTGAPVYLAAVLEYLAAEVLELAGNAARDNKKTRIIPRHVLLAIRNDEELGKLLAGVTIAHGGVLPNIHTVLLPKKGPEKAAKEPQKAAKFPQKA

SEQ ID NO: 7260 - protein, 150 aa, Prunus persica
METGGKVKKGAGGRKGGGPKKKPVTRSVKAGLQFPVGRIGRYLKKGRYAQRVGSGAPVYLAAVLEYLAAEVLELAGNAARDNKKNRIIPRHLLLAVRNDEELGKLLAGVTIAHGGVLPNINPVLLPKKSEKAAAKEPKSPSKATKSPKKA

SEQ ID NO: 7261 - protein, 152 aa, Lotus japonicus
MDTTTGKAKKGAGGRKIGGPKKKPVSRSIKAGLQFPVGRIGRYLKKGRYAQRVGTGAPVYLAAVLEYLAAEVLELAGNAARDNKKNRIIPRHVLLAVRNDEELGKLLAGVTIAHGGVLPNINPVLLPKKTAEKVAKEPKSPAKKGVKSPKKA

SEQ ID NO: 7262 - protein, 154 aa, Elaeis guineensis
MESGGGKIKKGAGGRKGGGPKKKPVSRSVKAGLQFPVGRIGRYLKKGRYAQRVGTGAPVYLAAVLEYLAAEVLELAGNAARDNKKNRIIPRHVLLAIRNDEELGKLLAGVTIAHGGVLPNINPVLLPKKTDKAGKETKSPAKSPSKAGKSPKKS

SEQ ID NO: 7263 - protein, 147 aa, Gerbera hybrid cultivar
MDGAGKAKKGAGGRKGGGPRKKAVTRSVRAGLQFPVGRIGRFLKKGRYAQRVGTGAPVYLAAVLEYLAAEVLELAGNAARDNKKNRIIPRHVLLAIRNDEELGKLLAGVTIAHGGVLPNINPILLPKKTAAKEPKSPSKSTKSPKKA

SEQ ID NO: 7264 - protein, 150 aa, Citrus sinensis
MESGGKVKRGAGGRKGGGPKKKPVSRSVKAGLQFPVGRIGRYLKKGRYSQRVGTGAPVYLAAVLEYLAAEVLELAGNAARDNKKNRIIPRHVLLAVRNDEELGKLLAGVTIAHGGVLPNINPVLLPKKSEKAATKEPKSPAKATKSPKKA

SEQ ID NO: 7265 - protein, 149 aa, Vigna unguiculata
MDTGGKIKKGAGGRKGGGPKKKPVTRSVRAGLQFPVGRIGRYLKKGRYAQRVGTGAPVYLAAVLEYLAAEVLELAGNAARDNKKNRIIPRHVLLAVRNDEELGKLLAGVTIAHGGVLPNINPVLLPKKTEKASKEPKSPSKATKSPKKA

SEQ ID NO: 7266 - protein, 149 aa, Vigna unguiculata
MDAGGKIKKGAGGRKGGGPKKKPVTRSVRAGLQFPVGRIGRYLKKGRYAQRVGTGAPVYLAAVLEYLAAEVLELAGNAARDNKKNRIIPRHVLLAVRNDEELGKLLAGVTIAHGGVLPNINPVLLPKKTEKASKEPKSPSKATKSPKKA

SEQ ID NO: 7267 - protein, 150 aa, Medicago truncatula
MDASTKATKKGAGGRKGGGPRKKSVTRSIRAGLQFPVGRIGRYLKKGRYAQRVGTGAPVYLAAVLEYLAAEVLELAGNAARDNKKNRIIPRHVLLAVRNDEELGKLLAGVTIAHGGVLPNINPVLLPKKSEKPVKEPKSPSKAKKSPKKA

SEQ ID NO: 7268 - protein, 149 aa, Glycine max
MDAGGKIKKGAGGRKGGGPKKKPVSRSVKAGLQFPVGRIGRYLKKGRYAQRVGTGAPVYLAAVLEYLAAEVLELAGNAARDNKKNRIIPRHVLLAVRNDEELGKLLAGVTIAHGGVLPNINPVLLPKKTERAAKEPKSPSKATKSPKKA

SEQ ID NO: 7269 - protein, 151 aa, Artemisia annua
MDASKTKKGAGGRKGGGPRKKSVTRSVKAGLQFPVGRIGRYLKNGRYAKRVGTGAPVYLAAVLEYLAAEVLELAGNAARDNKKTRIIPRHVLLAIRNDDELGKLLSGVTIAHGGVLPNINPVLLPKKTAAKEPKSPSKGKSPKKAAATAAE

SEQ ID NO: 7270 - protein, 155 aa, Lotus japonicus
MDSTATGKVKKGAAGRKAGGPKKKSVSRSVKAGLQFPVGRIGRYLKKGRYAQRVGSGAPVYLAAVLEYLAAEVLELAGNAARDNKKNRIIPRHVLLAVRNDEELGKLLAGVTIAHGGVLPNINPVLLPKKTAEKAPKEPKSPAKKAAKSPKKAAA

SEQ ID NO: 7271 - protein, 157 aa, Zea mays
MDGGGAKAKKAAAGRKLGGGGPKKKPVSRSVKAGLQFPVGRIGRYLKKGRYAQRVGTGAPVFLAAVLEYLAAEVLELAGNAARDNKKTRIIPRHLLLAIRNDEELGKLLGGVTIAHGGVLPNINPVLLPKKAAERAEKAAAAGPKSPKKAAAKSPKK

SEQ ID NO: 7272 - protein, 157 aa, Saccharum officinarum
MDGGGTKVKKAAAGRKLGGGGPKKKPVSRSVKAGLQFPVGRIGRYLKKGRYAQRVGTGAPVYLAAVLEYLAAEVLELAGNAARDNKKNRIIPRHVLLAIRNDEELGKLLAGVTIAHGGVLPNIHSVLLPKKAAERAEKAATATKSPKKAAAAKSAKK

SEQ ID NO: 7273 - protein, 176 aa, Euphorbia esula
MDTGAKLKKGAGERKGGGPKKKPVSRSVKAGLQFPVGRIGRFLKKGRYAQRVGSGAPVYLAAVLEYLAAEVLELAGNAARDNKKNRIIPRHVLLAVRNDEELGKLLAGVTIAHGGVLPNINPVLLPKKAEKAAAAAEQPRSPNHQPRLLNHLRRLRSIIFRHLDISPSLYLNCFFF

SEQ ID NO: 7274 - protein, 150 aa, Ricinus communis
MESGGKVKKGAGGRKGGGPKKKPVTRSVRAGLQFPVGRIGRYLKKGRYAQRVGTGAPVYMAAVLEYLAAEVLELAGNAARDNKKNRIIPRHVLLAVRNDEELGKLLAGVTIAHGGVLPNINPVLLPKKTEKATKEPTKSPSKATKSPKKA

SEQ ID NO: 7275 - protein, 148 aa, Cynara scolymus
MEGTGKVKKGAGGRKGGGPRKKSVTRSVKAGLQFPVGRIGRYLKKGRYAQRVGTGAPVYLAAVLEYLAAEVLELAGNAARDNKKNRIIPRHVLLAIRNDEELGKLLAGVTIAHGGVLPNINPILLPKKTATKEPKSPSKAAKSPKKTA

SEQ ID NO: 7276 - protein, 164 aa, Zea mays
MDASGAGSKAKKGAAGRKAGGPRKKSVSRSVKAGLQFPVGRIGRYLKKGRYAQRVGTGAPVYLAAVLEYLAAEVLELAGNAAKDNKKTRIVPRHLLLAIRNDVELGKLLSGVTIAHGGVLPNINPVLLPKKVAEKASSGGSKESKSPKKAAKSPKKAAKSPKKA

SEQ ID NO: 7277 - protein, 162 aa, Allium cepa
  misc_feature (5)..(5): Xaa can be any naturally occurring amino acid
MDTGXKAKKGAGGRKGPSGPRKKSVTRSVKAGLQFPVGRIGRYLKKGRYAQRVGTGAPVYLAAVLEYLAAEVLELAGNAAKDNKKNRIIPRHVLLAIRNDEELGKLLGGVTIAHGGVLPNINPVLLPKKTAAKESETPKSPKKTAAKSPKKVAAKTPKKVAA

SEQ ID NO: 7278 - protein, 163 aa, Saccharum officinarum
MDSTGAGAGGKVKKGAGGRKAGGPRKKSVSRSVKAGLQFPVGRIGRYLKKGRYAQRVGTGAPVYLAAVLEYLAAEVLELAGNAARDNKKTRIIPRHVLLAIRNDEELGKLLAGVTIRHGGVLANIHSVLVPKKTAEKAFNNEPKSAQKASKFPKKAFSVEGLF

SEQ ID NO: 7279 - protein, 173 aa, Cichorium intybus
RGHHFVTSKNSIVYIPIKRNGYHRKSEEGCRRKEGWWPRKKSVTRSVKAGLQFPVGRIGRYLKAGRYAKRVGTGAPVYLAAVLEYLAAEVLELAGNAARDNKKSRIIPRHVLLAIRNDDELGKLLGGVTIAHGGVLPNINPVLLPKKSATTEPKSPSKAAKSPKKAAKSPKKT

SEQ ID NO: 7280 - protein, 146 aa, Gerbera hybrid cultivar
MDGAGKVKKGAGGRKGGPRKKAVTRSVRAGLQFPVGRIGRFLKKGRYAQRVGTGAPVYLAAVLEYLAAEVLELAGNAARDNKKNRIIPRHVLLAIRNDEELGKLLAGVTIAHGGVLPNINPILLPKKTAAKEPKSPSKSAKSPKKA

SEQ ID NO: 7281 - protein, 150 aa, Malus domestica
METGGKLKKGAGGRKGGGPKKKAVTRSVRAGLQFPVGRIGRYLKKGRYAQRVGSGAPVYLAAVLEYLAAEVLELAGNAARDNKKNRIIPRHLLLAVRNDEELGKLLAGVTIAHGGVLPNINPVLLPKKSEKAAGKEPKSPSKATKSPKKA

SEQ ID NO: 7282 - protein, 150 aa, Malus domestica
METGGKLKKGAGGRKGGGPKKKAVTRSVRAGLQFPVGRIGRYLKKGRYAQRVGSGAPVYLAAVLEYLAAEVLELAGNAARDNKKNRIIPRHLLLAVRNDEELGKLLAGVTIAHGGVLPNINPVLLPKKSEKAAGKEPKSPTKATKSPKKA

SEQ ID NO: 7283 - protein, 153 aa, Beta vulgaris
MDSTAGGKAKKGAGGRKGGGPKKKPVSRSVKAGLQFPVGRIGRYLKKGRYAQRVGTGAPVYLAAVLEYLAAEVLELAGNAARDNKKNRIIPRHVLLAVRNDDELGKLLSGVTIAHGGVLPNINPVLLPKKAGGDKATKEPKSPSKATKSPKKA

SEQ ID NO: 7284 - protein, 149 aa, Manihot esculenta
METGGKVKKGAGGRKGGGPKKKPVSRSVKAGLQFPVGRIGRYLKKGRYSQRVGTGAPVYLAAVLEYLAAEVLELAGNAARDNKKNRIIPRHVLLAVRNDEELGKLLAGVTIAHGGVLPNINPVLLPKKSDKAAKEPKSPSKATKSPKKA

SEQ ID NO: 7285 - protein, 150 aa, Unknown
  Sequence found in Organisms: Castanea mollissima, Quercus alba
MDTGGKVKRGAGGRKGGGPKKKPVSRSVKAGLQFPVGRIGRYLKKGRYAQRVGTGAPVYLAAVLEYLAAEVLELAGNAARDNKKNRIIPRHVLLAVRNDEELGKLLAGVTIAHGGVLPNINPVLLPKKTEKAATKEPKSPARATKSPKKA

SEQ ID NO: 7286 - protein, 150 aa, Gossypium hirsutum
METSGKVKKGAGGRKGGGPKKKPVSRSVKAGLQFPVGRIGRYLKKGRYSQRVGTGAPVYLAAVLEYLAAEVLELAGNAARDNKKNRIIPRHVLLAVRNDEELGKLLAGVTIAHGGVLPNINPVLLPKKTEKAAGKEPKSPSKATKSPKKA

SEQ ID NO: 7287 - protein, 150 aa, Gossypium hirsutum
METTGKVKKGAGGRKGGGPKKKPVSRSVKAGLQFPVGRIGRYLKKGRYSQRVGTGAPVYLAAVLEYLAAEVLELAGNAARDNKKNRIIPRHVLLAVRNDEELGKLLAGVTIAHGGVLPNINPVLLPKKTEKAAGKEPKSPSKATKSPKKA

SEQ ID NO: 7288 - protein, 152 aa, Papaver somniferum
METPGGKAKKGFAGRRGGGPKKKAVTRSVKAGLQFPVGRIGRYLKKGRYAQRVGSGAPVYLAAVLEYLAAEVLELAGNAARDNKKTRIIPRHVLLAVRNDEELGKLLSGVTIAHGGVLPNINPILLPKKTAEKASTAKEPKSPKAGKSPKKA

SEQ ID NO: 7289 - protein, 149 aa, Glycine max
MDTGGKIKKGAGGRKGGGPKKKPVTRSVRAGLQFPVGRIGRYLKKGRYAQRVGTGAPVYLAAVLEYLAAEVLELAGNAARDNKKNRIIPRHVLLAVRNDEELGKLLAGVTIAHGGVLPNINPVLLPKKTERASKEPKSPSKATKSPKKA

SEQ ID NO: 7290 - protein, 149 aa, Glycine max
MDAGGKIKKGAGGRKGGGPKKKPVSRSVKAGLQFPVGRIGRYLKKGRYAQRVGTGAPVYLAAVLEYLAAEVLELAGNAARDNKKNRIIPRHVLLAVRNDEELGKLLAGVTIAHGGVLPNINPVLLPKKTERASKEPKSPSKATKSPKKA

SEQ ID NO: 7291 - protein, 151 aa, Euphorbia esula
MDSTTVKKGAGGRKGGGPKKKPVTRSVRAGLQFPVGRIGRYLKKGRYAQRVGTGAPVYLAAVLEYLAAEVLELAGNAARDNKKNRIIPRHVLLAVRNDEELGKLLAGVTIAHGGVLPNINPILLPKKTERSAAAAKEPKSPAKAAKSPKKA

SEQ ID NO: 7292 - protein, 155 aa, Triticum aestivum
  misc_feature (66)..(66): Xaa can be any naturally occurring amino acid
  misc_feature (76)..(76): Xaa can be any naturally occurring amino acid
MDVSATGAGAKAKKGAAGRKAGGPRKKSVSRSVKAGLQFPVGRIGRYLKKGRYAQRVGTGAPVYLXAVLEYLAAEXLELAGNAAKDNKKSRIIPRHLLLAVRNDEELGKLLAGVTIAHGGVVPKINPVLLPKRTAEKVPKEGKSPKKAAKSPKKA

SEQ ID NO: 7293 - protein, 156 aa, Fragaria vesca
METGGGKIKKGAAGRKGGGPRKKSVTRSIKAGLQFPVGRIGRYLKKGRYAQRVGSGAPVYLAAVLEYLAAEVLELAGNAARDNKKTRIIPRHLLLAIRNDEELGKLLSGVTIAHGGVLPNINPILLPKKAEKAGGGVTKEPKSPSKAGKSPKKAAA

SEQ ID NO: 7294 - protein, 155 aa, Cenchrus ciliaris
MDAGATKVKKAAAGRKLGGPKKKPVSRSVKAGLQFPVGRIGRYLKKGRYAQRVGTGAPVYLAAVLEYLAAEVLELAGNAARDNKKNRIIPRHVLLAIRNDEELGKLLAGVTIAHGGVLPNINPVLLPKKAAERAEKAEKASKSPKKAAATKSPKK

SEQ ID NO: 7295 - protein, 175 aa, Zea mays
MDATGTGAGGKAKKGAAGRKAGGPRKKSVTRSVKAGLQFPVGRIGRYLKKGRYAQRVGSGAPVYLAAVLEYLAAEVLELAGNAAKDNKKTRIVPRHVLLAIRNDEELGKLLTGVTIAHGGGLPNINPVLLPKKKAEKGFHGGSKEAILPKRPPSPQEGIGVGGGSHFFMCWVETG

SEQ ID NO: 7296 - protein, 148 aa, Artemisia annua
EGTGKIKKGAAGRKAGGPRKKSVTRSVKAGLQFPVGRIGRYLKKGRYAKRVGTGAPVYLAAVLEYLAAEVLELAGNAARDNKKTRIIPRHVLLAIRNDEELGKLLSGVTIAHGGVLPNINPVLLPKKTAAKEPTPKSPSKAAKSPKKA

SEQ ID NO: 7297 - protein, 151 aa, Camellia sinensis
MDGAGKVKKGAGGRKGGGPKKKPVSRSVKAGLQFPVGRIGRYLKKGRYAQRVGTGAPVYMAAVLEYLAAEVLELAGNAARDNKKNRIIPRHVLLAVRNDEELGKLLAGVTIAHGGVLPNINPVLLPKKTGSAATKEPKSPSKATKSPKKAA

SEQ ID NO: 7298 - protein, 150 aa, Ricinus communis
METGGKVKKGAGGRKGGGPKKKPVTRSVRAGLQFPVGRIGRYLKKGRYAQRVGTGAPVYMAAVLEYLAAEVLELAGNAARDNKKNRIIPRHVLLAVRNDEELGKLLAGVTIAHGGVLPNINPVLLPKKTEKATKEPTKSPSKATKSPKKA

SEQ ID NO: 7299 - protein, 152 aa, Zingiber officinale
MDASGATAGKAKKGAAGRRAGGPKKKAVSRSTKAGLQFPVGRIGRFLKKGRYAQRVGSGAPVYLAAVLEYLAAEVLELAGNAARDNKKNRIIPRHVLLAIRNDEELGKLLAGVTIAHGGVLPNINPVLLPKKTAAKEPKSPSKATKSPKKAA

SEQ ID NO: 7300 - protein, 146 aa, Medicago truncatula
PKATKKGAGGRKGGGPRKKSVTRSIRAGLQFPVGRIGRYLKKGRYAQRVGTGAPVYLAAVLEYLAAEVLELAGNAARDNKKNRIIPRHVLLAVRNDEELGKLLAGVTIAHGGVLPNINPVLLPKKSEKPVKEPKSPSKAKKSPKKA

SEQ ID NO: 7301 - protein, 163 aa, Saccharum officinarum
  misc_feature (129)..(129): Xaa can be any naturally occurring amino acid
  misc_feature (146)..(146): Xaa can be any naturally occurring amino acid
  misc_feature (149)..(149): Xaa can be any naturally occurring amino acid
  misc_feature (151)..(151): Xaa can be any naturally occurring amino acid
  misc_feature (155)..(155): Xaa can be any naturally occurring amino acid
  misc_feature (160)..(160): Xaa can be any naturally occurring amino acid
  misc_feature (162)..(162): Xaa can be any naturally occurring amino acid
MDASGAGGKAKKGAAGRKAGGPRKKSVSRSVKAGLQFPVGRIGRYLKKGRYAQRVGTGAPVYLAAVLEYLAAEVLELAGNAARDNKKTRIIPRHVLLAIRNDEELGKLLAGVTIAHGGVLPNINPVLLXKKVAEKAASGSSKQAKXPKXAXKSPXRLRKXGXH

SEQ ID NO: 7302 - protein, 171 aa, Phaseolus coccineus
DHLLTDTLTPHCYLLLKYRVWPWIPPGKIKKGAGGRKGGGPKKKAVSRSVKAGLQFPVGRIGRFLKKGRYAQRVGAGAPVYLAAVLEYLAAEVLELAGNAARDNKKNRIIPRHVLLAVRNDEELGKLLSGVTIAHGGVLPNINPVLLPKKSEKAAKEPKSSSKATKSPKKA

SEQ ID NO: 7303 - protein, 91 aa, Mesembryanthemum crystallinum
MAAVLEYLAAEVLELAGNAARDNKKNRIIPRHVLLAIRNDEELGKLLSGVTIAHGGVLPNINPVLLPKKTAEKSPKEPKSPSKATKSPKKA

SEQ ID NO: 7304 - protein, 174 aa, Triticum aestivum
SLHPNPDLPPAPVKPWHATVTGAKGKKGAAGRKAGGPRKKSVTRSVKAGLQFPVGRIGRYLKKGRYAQRVGTGAPVYLAAVLEYLAAELLELAGNAAKDNKKSRIIPRHLLLAVRNDEELGKLLAGVTIAHGGVIPKINPVLLPKKTAEKEGQAPKSPKKAAKSPKKAATPKKA

SEQ ID NO: 7305 - protein, 151 aa, Linum usitatissimum
MDAGSTKVKKGAAGRKIGGPKKKPVSRSVKAGLQFLVGRIGRYLKKGRYAKRVGTGAPVYLAAVLEYLAAEVLELAGNAARDNKKNRIIPRHVLLAIRNDEELGKLLAGVTIAHGGVLPNINPVLLPKKSAAKEPAEKKSPAKATKSPKKA

SEQ ID NO: 7306 - protein, 151 aa, Orobanche aegyptiaca
MEAGGKVKKGAAGRKIGGGPRKKSVTRSVRAGLQFPVGRIGRYLKKGRYAQRVGTGAPVYVAAVLEYLAAEVLELAGNAARDNKKNRIIPRHLLLAVRNDEELGKLLAGVTIAHGGVIPNINPVLLPKKNEKTAEKTPKSPAKAAKSPKKA

SEQ ID NO: 7307 - protein, 149 aa, Vigna unguiculata
MDAGGKIKKGAGGRKGGGPKKKPVARSVRAGLQFPVGRIGRYLKKGRYSQRVGTGAPVYLAAVLEYLAAEVLELAGNAARDNKKNRIIPRHVLLAVRNDEELGKLLAGVTIAHGGVLPNINPVLLPKKTEKASKEPKSPSKATKSPKKA

SEQ ID NO: 7308 - protein, 149 aa, Glycyrrhiza uralensis
MDASGKVKKGAGGRKGGGPKKKAVTRSVRAGLQFPVGRIGRYLKKGRYAQRVGAGAPVYLAAVLEYLAAEVLELAGNAARDNKKNRIIPRHVLLAVRNDEELGKLLAGVTIAHGGVLPNINPVLLPKKADRAAKEPKSPSKATKSPKKA

SEQ ID NO: 7309 - protein, 151 aa, Lotus japonicus
MDTGGKSKKGAGGRKAGGPKKKPVSRSVKAGLQFPVGRIGRYLKKGRYAQRVGTGAPVYLAAVLEYLAAEVLELAGNAARDNKKNRIIPRHVLLAVRNDEELGKLLAGVTIAHGGVLPNINPVLLPKKTAEKAPKESKSPPKKAGKSPKKA

SEQ ID NO: 7310 - protein, 153 aa, Pseudoroegneria spicata
MDASGTVAKGKKGAAGRKAGGPRKKSVTRSVKAGLQFPVGRIGRYLKKGRYAQRVGTGAPVYLAAVLEYLAAELLELAGNAAKDNKKSRIIPRHLLLAVRNDEELGKLLAGVTIAHGGVIPKINPVLLPKRTAEKEGKAPKSPKKAAKSPKKA

SEQ ID NO: 7311 - protein, 148 aa, Glycine max
MDAGGKIKKGAGGRKGGGPKKKPVSRSVKAGLQFPVGRIGRYLKKGRYAQRVGTGAPVYLAAVLEYLAAEVLELAGNAARDNKKNRIIPRHVLLAVRNDEELGKLLAGVTIAHGGVLPNINPVLLPKKTQVAKEPKSPSKATKSPKKA

SEQ ID NO: 7312 - protein, 149 aa, Glycine max
MDTGGKIKKGAGGRKGGGPKKKPVSRSVKAGLQFPVGRIGRYLKKGRYAQRVGTGAPVYLAAVLEYLAAEVLELAGNAARDNKKNRIIPRHVLLAVRNDEELGKLLAGVTIAHGGVLPNINPVLLPKKTERASKEPKSPSKATKSPKKS

SEQ ID NO: 7313 - protein, 156 aa, Oryza sativa
MDVGVGGKAAKKAVGRKLGGPKKKPVSRSVKAGLQFPVGRIGRYLKKGRYAQRVGTGAPVYLAAVLEYLAAEVLELAGNAARDNKKNRIIPRHVLLAIRNDEELGKLLAGVTIAHGGVLPNINPVLLPKKTAEKADKPAKASKDKAAKSPKKQARS

SEQ ID NO: 7314 - protein, 134 aa, Saccharum officinarum
MDGGGTKVKKAAAGRKLGGGGPKKKPVSRSVKAGLQFPVGRIGRYLKKGRYAQRVGTGAPVYLAAVLEYLAAEVLELAGNAARDNKKNRIIPRHVLLAIRNDEELGKLLAGVTIAHGGVLPPLRPPPQEGRREG

SEQ ID NO: 7315 - protein, 153 aa, Eschscholzia californica
MDTGKVKKGAGGRKGGGPKKKSVSRSVKAGLQFPVGRIGRYLKKGRYSQRVGSGAPVYLAAVLEYLAAEVLELAGNAARDNKKNRIIPRHVLLAVRNDEELGKLLAGVTIAHGGVLPNINPILLPKKSEKAAEKAATKTPKSPSKATKSPKKA

SEQ ID NO: 7316 - protein, 149 aa, Centaurea maculosa
MDTTGKVKKGAAGRKAGGPRKKSVTRSVKAGLQFPVGRIGRYLKKGRYAQRVGTGAPVYLAAVLEYLAAEVLELAGNAARDNKKNRIIPRHVLLAIRNDEELGKLLAGVTIAHGGVLPNINPILLPKKTATKEPKSPSKAAKSPKKAAA

SEQ ID NO: 7317 - protein, 155 aa, Lactuca sativa
METTGKAKKGAGGRKGGGPRKKSVTRSVKAGLQFPVGRIGRYLKVGRYAKRVGTGAPVYLAAVLEYLAAEVLELAGNAARDNKKTRIIPRHVLLAIRNDDELGKLLGGVTIAHGGVLPNIHAVLLPKKSATTEPKSPSKAAKSPKKAAKTPKKAE

SEQ ID NO: 7318 - protein, 151 aa, Coffea canephora
MESAGGKVKKGAGGRKGGGPKKKPVSRSVKAGLQFPVGRIGRYLKKGRYSERVGTGAPVYMAAVLEYLAAEVLELAGNAARDNKKNRIIPRHVLLAVRNDEELGKLLAGVTIAHGGVLPNINPVLLPKKNEKAAKEPVKSPAKATKSPKKA

SEQ ID NO: 7319 - protein, 148 aa, Solanum melongena
MESTGKVKKGAGGRKGGGPKKKPVTRSVKAGLQFPVGRIGRYLKKGRYAQRVGSGAPVYLAAVLEYLAAEVLELAGNAARDNKKNRIIPRHLLLAVRNDEELGKLLAGVTIAHGGVLPNINPVLLPKKTGAEKAPKSPSKATKSPKKA

SEQ ID NO: 7320 - protein, 150 aa, Panax ginseng
METGGKLKKGAAGRKGGGPKKKPVSRSVKAGLQFPVGRIGRYLKKGRYAQRVGTGAPVYLAAVLEYLAAEVLELAGNAARDNKKNRIIPRHLLLAVRNDEELGKLLAGITIAHGGVLPNINPVLLPKKSEKAAKEPTKSPSKATKSPKKA

SEQ ID NO: 7321 - protein, 151 aa, Persea americana
MEGGGKVKKGVAGRKGGGPKKKPVSRSVKAGLQFPVGRIGRYLKKGRYSQRVGTGAPVYLAAVLEYLAAEVLELAGNAARDNKKNRIIPRHVLLAVRNDEELGKLLAGVTIAHGGVIPNINPVLLPKKTAEKAAKEPKSPAKAPKSPKKAA

SEQ ID NO: 7322 - protein, 153 aa, Brachypodium distachyon
GAGGKAKKGAVGKKLGGPRKKSVTRSVKAGLQFPVGRIGRFLKKGRYAQRVGSGAPVYLAAVLEYLAAEVLELAGNAARDNKKTRIIPRHVLLAIRNDEELGRLLGGVTIAHGGVLPNINPLLLPKKAAEKAGTEKVAAKSPKKPAGKSPKKA

SEQ ID NO: 7323 - protein, 163 aa, Brachypodium distachyon
MEVSSTPAGKGKKGAAGRKVGGPRKKAVTRSVKAGLQFPVGRVGRLLKKGRYAQRVGSGAPVYLAAVLEYLAAEVLELAGNAARDNKKSRIIPRHVLLAIRNDEELGKLLAGVTIAHGGVLPNIHTVLLPKKTAEKAPKEAKEPKSPKKAATPKKAAKSPKKA

SEQ ID NO: 7324 - protein, 151 aa, Gossypium hirsutum
MDTGSKVKKGAGGRKGGGPKKKPVSRSVKAGLQFPVGRIGRYLKKGRYSQRVGTGAPVYLAAVLEYLAAEVLELAGNAARDNKKNRIIPRHVLLAVRNDEELGKLLAGVTIAHGGVLPNINPVLLPKKNEKVATKEPKSPSKATKKSPKKA

SEQ ID NO: 7325 - protein, 151 aa, Actinidia deliciosa
METGGKPKKGAAGRRGGGPKKKPVSRSVKAGLQFPVGRIGRYLKKGRYAQRVGTGAPVYMAAVLEYLAAEVLELAGNAARDNKKNRIIPRHVLLAIRNDEELGKLLAGVTIAHGGVLPNINPVLLPKKTEKASTKEPKSPSKATKSPKKAV

SEQ ID NO: 7326 - protein, 151 aa, Actinidia deliciosa
MDAGGKAKKGAAGRRGGGPKKKPVSRSVKAGLQFPVGRIGRYLKKGRYAQRVGTGAPVYMAAVLEYLAAEVLELAGNAARDNKKNRIIPRHVLLAIRNDEELGRLLAGVTIAHGGVLPNINPVLLPKKTDKAATKEPKSPSKATKSPKKAA

SEQ ID NO: 7327 - protein, 153 aa, Medicago truncatula
MDASTKTKKGAGGRKGGGPRKKSVTRSIRAGLQFPVGRIGRYLKKGRYAQRVGTGAPVYLAAVLEYLAAEVLELAGNAARDNKKNRIIPRHVLLAVRNDEELGKLLAGVTIAHGGVLPNINPVLLPKKTERSNTVSKEPKSPKPKAGKSPKKA

SEQ ID NO: 7328 - protein, 148 aa, Helianthus annuus
MESTGKVKKGAAGRKAGGPRKKAVTRSVKAGLQFPVGRIGRFLKKGRYAQRVGSGAPVYLAAVLEYLAAEVLELAGNAARDNKKNRIIPRHVLLAIRNDEELGKLLAGVTIAHGGVLPNINPILLPKKTAAKEPKSPSKAAKSPKKAK

SEQ ID NO: 7329 - protein, 147 aa, Camellia sinensis
MEKVKKGAGGRKGGGPKKKPVSRSVKAGLQFPVGRIGRYLKKGRYSQRVGTGAPVYLAAVLEYLAAEVLELAGNAARDNKKNRIIPRHVLLAVRNDEELGKLLAVVTIAHGGVLPNINPVLLPKKSEKAAKEPKSPTKAAKSPKRKA

SEQ ID NO: 7330 - protein, 149 aa, Artemisia annua
MEGTGKIKKGAAGRKAGGPRKKSVTRSVKAGLQFPVGRIGRYLKKGRYAKRVGTGAPVYLAAVLEYLAAEVLELAGNAARDNKKTRIIPRHVLLAIRNDEELGKLLSGVTIAHGGVLPNINPVLLPKKTAAKEPTPKSPSKAGKSPKKA

SEQ ID NO: 7331 - protein, 150 aa, Jatropha curcas
MDAGAKVKKGAGGRKGGGPKKKPTSRSVKAGLQFPVGRIGRYLKKGRYAQRVGSGAPVYLAAVLEYLAAEVLELAGNAARDNKKNRIIPRHVLLAVRNDEELGKLLAGVTIAHGGVLPNINPVLLPKKSEKAATKEPKSPSKGTKSPKKA

SEQ ID NO: 7332 - protein, 151 aa, Orobanche aegyptiaca
MEVSGKVKKGAAGRKIGGGPRKKSVTRSVRAGLQFPVGRIGRYLKKGRYAQRVGTGAPVYVAAVLEYLAAEVLELAGNAARDNKKNRIIPRHLLLAVRNDEELGKLLAGVTIAHGGVIPNINPILLPKKTDKAAEKTTKSPAKATKSPKKA

SEQ ID NO: 7333 - protein, 149 aa, Vitis vinifera
MESTGKVKKGAGGRKGGGPKKKPVSRSVKAGLQFPVGRIGRYLKKGRYSQRVGTGAPVYLAAVLEYLAAEVLELAGNAARDNKKNRIIPRHVLLAVRNDEELGKLLSGVTIAHGGVLPNINPVLLPKKTDKATKEPKSPSKATKSPKKA

SEQ ID NO: 7334 - protein, 151 aa, Antirrhinum majus
MEAGGKLKKGAGGRKGGGPKKKPVTRSVRAGLQFPVGRIGRYLKKGRYAQRVGTGAPVYMAAVLEYLAAEVLELAGNAARDNKKNRIIPRHVLLAVRNDEELGKLLAGVTIAHGGVLPNINPVLLPKKSEKATTEKATKSPSKATKSPKKA

SEQ ID NO: 7335 - protein, 153 aa, Hordeum vulgare
MDASTAGAVSKAKKYVVGRKLGGGPRKKAVARSVKAGLQFPVSRIARFLKKGRYAQRVGTGAPVYLAAVLEYLAAELLELAGNAAKDNKKSRIIPRHLLLAVRNDEELGKLLAGVTIAHGGVLPNINPVLLPKKTAEKEPKSPKKAAKSPKKA

SEQ ID NO: 7336 - protein, 149 aa, Bruguiera gymnorhiza
MDTTAKVKKGAGGRKGGGPKKKPVSRSVKAGLQFPVGRIGRYLKKGRYSQRVGTGAPVYLAAVLEYLAAEVLELAGNAARDNKKNRIIPRHVLLAVRNDEELGKLLAGVTIAHGGVLPNINPVLLPKKSEKAIKEPKSPSKATKSPKKA

SEQ ID NO: 7337 - protein, 149 aa, Manihot esculenta
METGGKVKKGAGGRKGGGPKKKPTSRSVRAGLQFPVGRIGRYLKKGRYSQRVGTGAPVYLAAVLEYLAAEVLELAGNAARDNKKNRIIPRHVLLAVRNDEELGKLLAGVTIAHGGVLPNINPVLLPKKTEKATKEPKSPSKATKSPKKA

SEQ ID NO: 7338 - protein, 153 aa, Trifolium pratense
MDSTTNTKTKKGAAGRKGGGPRKKSVTRSTRAGLQFPVGRIGRYLKKGRYAQRVGTGAPVYLAAVLEYLAAEVLELAGNAARDNKKNRIIPRHVLLAVRNDEELGKLLAGVTIAHGGVLPNINPILLPKKTDRSTSASKEPKSPKAGKSPKKA

SEQ ID NO: 7339 - protein, 151 aa, Carica papaya
MDSATKVKKGAGGRKGGGPKKKPVSRSVKAGLQFPVGRIGRYLKKGRYSQRVGTGAPVYMAAVLEYLAAEVLELAGNAARDNKKNRINPRHVLLAVRNDEELGKLLAGVTIAHGGVLPNINPVLLPKKSEKAAATKESKSPSKATKSPKKA

SEQ ID NO: 7340 - protein, 151 aa, Arachis hypogaea
MDSPAVKGKKGAAGRRGGGPKKKSVSRSAKAGLQFPVGRIGRYLKKGRYAQRLGSGAPVYLAAVLEYLVAEVLELAGNAARDNKKNRIIPRHVLLAVRNDEELGKLLAGVTIAHGGVLPNINPVLLPKKSQAAAAKEPKSPSKGTKSPKKA

SEQ ID NO: 7341 - protein, 150 aa, Arachis hypogaea
MDAASKVKKGAGGRKGGGPKKKPVSRSVKAGLQFPVGRIGRYLKKGRYSQRVGTGAPVYLAAVLEYLAAEVLELAGNAARDNKKNRIIPRHVLLAVRNDEELGKLLAGVTIAHGGVLPNINPVLLPKKTAEKAPKETKSPSKATKSPKKA

SEQ ID NO: 7342 - protein, 150 aa, Arachis hypogaea
MDAASKVKKGAGGRKGGGPKKKPVSRSVKAGLQFPVGRIGRYLKKGRYSQRVGTGAPVYLAAVLEYLAAEVLELAGNAARDNKKNRIIPRHVLLAVRNDEELGKLLAGVTIAHGGVLPNINPVLLPKKTAEKAPKEKKSPSKATKSPKKA

SEQ ID NO: 7343 - protein, 149 aa, Populus trichocarpa
METGGKVKKGAAGRKGGGPKKKPVSRSAKAGLQFPVGRIGRYLKKGRYSQRVGSGAPVYLAAVLEYLAAEVLELAGNAARDNKKNRIIPRHVLLAVRNDEELGKLLAGVTIAHGGVLPNINPVLLPKKTEKAAKEPKSPSKATKSPKKA

SEQ ID NO: 7344 - protein, 149 aa, Camellia sinensis
MDAGGKVKKGAAGRKGGGPKKKPVSRSVKAGLQFPVGRISRYLKKGRYSQRVGTGAPVYLAAVLEYLAAEVLELAGNAARDNKKNRIIPRHVLLAVRNDEELGKLLAGVTIAHGGVLPNINPVLLPKKNEKATKEPKSPSKATKSPKKA

SEQ ID NO: 7345 - protein, 155 aa, Tragopogon dubius
METTGKAKKGAGGRKGGGPRKKSVSRSTKAGLQFPVGRVGRYLKIGRYAKRVGTGAPVYLAAVLEYLAAEVLELAGNAARDNKKSRIIPRHVLLAIRNDEELGKLLGGVTIAHGGVLPNINPVLLPKKSAVTEPKSPSKAAKSPKKAAKSPKKTE

SEQ ID NO: 7346 - protein, 153 aa, Theobroma cacao
MDAGAKVKKGAGGRKGGGPKKKPVSRSVKAGLQFPVGRIGRYLKKGRYSQRVGTGAPVYLAAVLEYLAAEVLELAGNAARDNKKNRIIPRHVLLAVRNDEELGKLLAGVTIAHGGVLPNINPVLLPKKNDKAPKEPKSPSKATKSPKKSPKKA

SEQ ID NO: 7347 - protein, 152 aa, Brassica napus
MDSGTKVKKGAGGRRGGGLKKKPVSRSVKAGLQFPVGRIGRYLKKGRYSKRVGTGAPVYLAAVLEYLAAEVLELAGNAARDNKKNRIIPRHVLLAVRNDDELGKLLKGVTIAHGGVLPNINPVLLPKKSAKAASTTKVIKSPSKATKSPKKA

SEQ ID NO: 7348 - protein, 152 aa, Brassica napus
  misc_feature (120)..(120): Xaa can be any naturally occurring amino acid
MDSGTKVKKGAGGRRGGGPKKKPVSRSVKAGLQFPVGRIGRYLKKGRYSKRVGTGAPVYLAAVLEYLAAEVLELAGNAARDNKKNRIIPRHVLLAVRNDDELGKLLKGVTIAHGGVLPNXNPVLLPKKSAKAASTTKVIKSPSKATKSPKKA

SEQ ID NO: 7349 - protein, 118 aa, Secale cereale
  misc_feature (115)..(115): Xaa can be any naturally occurring amino acid
MDATGTGGKGKKGAAGRKAGGPRKKSVTRSVKAGLQFPVGRIGRYLKKGPTPSASAPAPPSTSPPSSSTSPPSCWSSPGTPPRTTRRAALSPATCCSPSGTTRSSASCWPASPSXTAA

SEQ ID NO: 7350 - protein, 153 aa, Unknown
  Sequence found in Organisms: Cucumis sativus, Cucumis melo
METGGKLKKGAGGRKGGGPKKKPVSRSVKAGLQFPVGRIGRYLKNGRYARRVGTGAPVYLAAVLEYLAAEVLELAGNAARDNKKNRIIPRHVLLAIRNDEELGKLLAGVTIAHGGVLPNINPVLLPKKSEKATTKEPKSPSKAPKATKSPKKA

SEQ ID NO: 7351 - protein, 156 aa, Hordeum vulgare
MDVSGAAAKGKKGAAGRKAGGPRKKSVTRSVKAGLQFPVGRIGRYLKKGRYAQRVGTGAPVFLAAVLEYLAAELLELAGNAAKDNKKSRIIPRHLLLAVRNDEELGKLLAGVTIAHGGVIPKINPVLLPKRTAEKEGKEPKSPKKATKSPKKATKA

SEQ ID NO: 7352 - protein, 205 aa, Saccharum officinarum
MDGGGTKVKKAAAGRKLGGGGPKKKPVSRSVKAGLQFPVGRIGRYLKKGRYAQRVGTGAPVYLAAVLEYLAAEVLELAGNAARDNKKNRIIPRHVLLAIRNDEELGKLLAGVTIAHGGVLPNIHSVLLPKKAAERAEKAAPLPKSPRKARAASRPRSSVPALSQLILISPWLSGRGILLVVLAVWGYVGCVPSGSGGSIELVWVN

SEQ ID NO: 7353 - protein, 158 aa, Triticum aestivum
MDVSGTGAGAKGKKGAAGRKAGGPRKKSVTRSVKAGLQFPVGRIGRYLKKGRYAQRVGTGAPVYLAAVLEYLAAELLELAGNAAKDNKKSRIIPRHLLLAVRNDEELGKLLAGVTIAHGGVIPKINPVLLPKRTAEKEGKEPKSPKKTTKSPKKTTKA

SEQ ID NO: 7354 - protein, 155 aa, Lactuca sativa
METTGKAKKGAGGRKGGGPRKKSVTRSVKAGLQFPVGRIGRYLKVGRYAKRVGTGAPVYLAAVLEYLAAEVLELAGNAARDNKKTRIIPRHVLLAIRNDDELGKLLGGVTIAHGGVLPNIHAVLLPKKTTTSEPKSPSKAAKSPKKAAKTPKKAE

SEQ ID NO: 7355 - protein, 161 aa, Brachypodium distachyon
MDVSGTGAGKAKKGAAGRKAGGPRKKSVTRSVRAGLQFPVGRIGRYLKKGRYAQRVGTGAPVYMAAVLEYLAAEVLELAGNAARDNKKSRIIPRHVLLAVRNDDELGKLLAGVTIAHGGVLPKINPILLPKKTAEKAPKEPKSPKKAATPKKADAKSPKKA

SEQ ID NO: 7356 - protein, 153 aa, Allium cepa
MEAGGKMKKGAGGRKGPSGPRKKSVTRSVKAGLQFPVGRIGRYLKKGRYAQRVGTGAPVYLAAVLEYLAAEVLELAGNAAKDNKKNRIIPRHVLLAIRNDEELGKLLGGVTIAHGGVLPNINPVLLPKKTAAKESETPKSPKKTAAKTPKKAV

SEQ ID NO: 7357 - protein, 151 aa, Helianthus annuus
METTGKAKKGAAGRKAGGPRKKSVTRSVKAGLQFPVGRIGRYLKHGRYAKRVGTGAPVYLAAVLEYLAAEVLELAGNAARDNKKNRITPRHVLLAIRNDDELGKLLAGVTIAHGGVLPNINPVLLPKKSAAAAKEPNKSPAKTTKSPKKAA

SEQ ID NO: 7358 - protein, 159 aa, Saccharum officinarum
MDAGAKVPKKAAAGRRGGGGPKKKPVSRSVKAGLQFPVGRIGRYLKQGRYAQRIGTGAPVYLAAVLEYLAAEVLELAGNAARDNKKNRIIPRHVLLAIRNDEELGKLLAGVTIAHGGVLPNINPVLLPKKTAAAAAKEGKEKKSPKKAAAKSPKKAAAA

SEQ ID NO: 7359 - protein, 148 aa, Solanum melongena
MESTGKVKKGAGGRKGGGPKKKPVTRSVKAGLQFPVGRIGRYLKKGQYAQRVGSGAPVYLAAVLEYLAAEVLELAGNAARDNKKNRIIPRHLLLAVRNDEELGKLLAGVTIAHGGVLPNINPVLLPKKTGAEKAPKSPSKATKSPKKA

SEQ ID NO: 7360 - protein, 148 aa, Cynara scolymus
METTGKAKKGAGGRKGGGPRKKAVTRSIRAGLQFPVGRIGRYLKNGRYAKRVGTGAPVYLAAVLEYLAAEVLELAGNAARDNKKNRIIPRHVLLAIRNDDELGKLLAGVTIAHGGVLPNINPVLLPKKTAAKEPKSPSKATKSPKKAD

SEQ ID NO: 7361 - protein, 148 aa, Unknown
  Sequence found in Organisms: Taraxacum officinale, Helianthus annuus
MESTGKVKKGAAGRKAGGPRKKAVTRSVKAGLQFPVGRIGRFLKKGRYAQRVGSGAPVYLAAVLEYLAAEVLELAGNAARDNKKNRIIPRHVLLAIRNDEELGKLLAGVTIAHGGVLPNINPILLPKKTAAKEPKSPSKATKSPKKAK

SEQ ID NO: 7362 - protein, 149 aa, Zingiber officinale
MELGGKARKGAGGRRGGGGPKKKPVSRSVKAGLQFPVGRIGRYLKNGRYAKRVGTGAPVYLAAVLEYLAAEVLELAGNAARDNKKNRIIPRHVLLAIRNDEELGKLLAGVTIAHGGVLPNINPVLLPKKAAGKEPKSPAKSAAKSPKKP

SEQ ID NO: 7363 - protein, 157 aa, Zea mays
MDASGAGSKGKKGAAGRKAGGPRKKSVTRSVKAGLQFPVGRIGRYLKKGRYAQRVGTGAPVYLAPVLEYLPPEVLELAGNPAKDNKKTGIIPPPVLLAIRNDGELGKLLAGVPIAPGGVLPNIPSVLLPKKAAGKAARGGPKEPKSPQKGAKSPQKG

SEQ ID NO: 7364 - protein, 55 aa, Lactuca sativa
HSFLLSFVDVIQRMEGAGKAKKGAGGRKGGGPRKKAVSRSVKPDFSFRLVGSDVF

SEQ ID NO: 7365 - protein, 149 aa, Tropaeolum majus
MDTTGKAKKGAGGRKGGGPKKKSVTRSVRAGLQFPVGRIGRYLKKGRYAARVGTGAPVYLAAVLEYLAAEVLELAGNAARDNKKSRIIPRHLLLAVRNDEELGKLLSGVTIAHGGVLPNINPILLPKKTEKSAHEPKSPAKAGKSPKKA

SEQ ID NO: 7366 - protein, 149 aa, Vitis vinifera
MEAAGKVKKGAGGRKGGGPKKKPVSRSVKAGLQFPVGRIGRYLKKGRYSQRVGTGAPVYLAAVLEYLAAEVLELAGNAARDNKKNRIIPRHVLLAVRNDEELGKLLAGVTIAHGGVLPNINPVLLPKKSDKAAKEPKSPSKATKSPRKT

SEQ ID NO: 7367 - protein, 153 aa, Hordeum vulgare
MDASTAGAVSKAKKYVVGRKLGGGPRKKAVARSVKAGLQFPVSRIARFLKKGRYAQRVGMGAPVYLASVLEYLAAELLELAGNAAKDNKKSRIIPRHLLLAVRNDEELGKLLAGVTIAHGGVLPNINSVLLPKKTAEKEPKSPKKAAKSPKKA

SEQ ID NO: 7368 - protein, 152 aa, Medicago truncatula
MDASTKTTKKGAGGRKGGGPRKKSVTRSIRAGLQFPVGRIGRYLKKGRYAQRVGTGAPVYLAAVLEYLAAEVLELAGNAARDNKKNRIIPRHLLLAVRNDEELGKLLAGVTIAHGGVLPNINPILLPKKTERANTGGKEPKTTKAGKSPKKA

SEQ ID NO: 7369 - protein, 143 aa, Nuphar advena
KAKKGAGGRKGGGARKKSVTRSVKAGLQFPVGRIGRYLKKGRYSHRVGSGAPVYLAAVLEYLAAEVLELAGNAARDNKKNRIIPRHLLLAVRNDEELGKLLQGVTIAHGGVLPNINPVLLPKKTEKATKEAKSPKAAKSPKKA

SEQ ID NO: 7370 - protein, 151 aa, Nuphar advena
MEGVGGTPKVKKGAGGRKGGGPKKKPVSRSVKAGLQFPVGRIGRYLKKGRYSQRVGTGAPVYLAAVLEYLAAEVLELAGNAARDNKKNRIIPRHLLLAVRNDEELGKLLHGVTIAHGGVLPNINSVLLPKKTEKTTKEPKSPKATKSPRKA

SEQ ID NO: 7371 - protein, 151 aa, Nuphar advena
MEGVGGTPKVKKGAGGRKGGGPKKKPVTRSVKAGLQFPVGRIGRYLKKGRYSQRVGTGAPVYLAAVLEYLAAEVLELAGNAARDNKKNRIIPRHLLLAVRNDEELGKLLQGVTIAHGGVLPNINPILLPKKTEKATKEPKSPKATKSPRKA

SEQ ID NO: 7372 - protein, 147 aa, Elaeis guineensis
MEIGGKLKKGAGGRRGGGPKKKPVSRSVKAGLQFPVGRIGRYLKKGRYSQRVGTGAPVYLAAVLEYLAAEVLELAGNAARDNKKNRIIPRHVLLAVRNDEELGKLLAGVTIAHGGVLPNINPVLLPKKTASKEPKSPTKATKSPKKA

SEQ ID NO: 7373 - protein, 147 aa, Elaeis guineensis
METGGKVKKGAGGRRGGGPKKKPVSRSVKAGLQFPVGRIGRYLKKGRYSQRVGTGAPVYLAAVLEYLAAEVLELAGNAARDNKKNRIIPRHVLLAVRNDEELGKLLAGVTIAHGGVLPNINPVLLPKKTASKEPKSPSKATKSPKKA

SEQ ID NO: 7374 - protein, 155 aa, Pseudoroegneria spicata
MDASATVATGKAKKGAAGRKAGGPRKKSVSRSVKAGLQFPVGRIGRFLKKGRYAQRVGSGAPVYLAAVLEYLAAELLELAGNAAKDNKKSRIIPRHLLLAIRNDEELGKLLAGITIAHGGVIPNINPLLLPKKTAEKSPKEPKSPKKTTKSPKKA

SEQ ID NO: 7375 - protein, 150 aa, Sesamum indicum
MESGGKLKKGAGGRKGGGPKKKPVSRSVKAGLQFPVGRIGRYLKKGRYSERVGTGAPVYMAAVLEYLAAEVLELAGNAARDNKKNRIIPRHVLLAVRNDEELGKLLAGVTIAHGGVLPNINPVLLPKKSEKAAEKPAKSPTKATKSPKKG

SEQ ID NO: 7376 - protein, 150 aa, Tamarix hispida
MDSTGKVKKGAGGRKGGGPKKKPVSRSVKAGLQFPVGRIGRFLKKGRYAQRVGSGAPVYLAAVLEYLAAEVLELAGNAARDNKKNRIIPRHVLLAVRNDEELGKLLSGVTIAHGGVLPNINPVLLPKRADKSGAKEPKSPSKATKSPKKA

SEQ ID NO: 7377 - protein, 150 aa, Juglans hindsii x Juglans regia
METGGKVKRGAAGRKGGGPKKKPVSRSVKAGLQFPVGRIGRYLKKGRYSQRVGTGAPVYLAAVLEYLAAEVLELAGNAARDNKKNRIIPRHVLLAVRNDEELGKLLAGVTIAHGGVLPNINPVLLPKKPDKVATKEPKSPSKATKSPKKA

SEQ ID NO: 7378 - protein, 153 aa, Triticum aestivum
MDASATGAVSKAKKYVVGRKLGGGPRKKAVARSVKAGLQFPVGRIGRFLKKGRYAQRVGMGAPVYLASVLEYLAAELLELAGNAAKDNKKSRIIPRHLLLAIRNDQELGKLLAGVTIAHGGVLPNINPVLLPKKTAEKEPKSPKKAAKSPKKA

SEQ ID NO: 7379 - protein, 155 aa, Triticum aestivum
MDASATVAAGKAKKGAAGRKAGGPRKKSVSRSVKAGLQFPVSRIGRYLKKGRYAQRVGTGAPVYLAAVLEYLAAELLELAGNAAKDNKKSRITPRYLLLAVRNDEELGKLLAGVTIAHGGVVPKINPVLLPKKTAEKSTKEPKSPKKTAKSPKKA

SEQ ID NO: 7380 - protein, 150 aa, Pisum sativum
MDASTKTKKGAGGRKGGGPRKKSVTRSVRAGLQFPVGRVGRFLKKGRYAQRVGTGAPVYLAAVLEYLAAEVLELAGNAARDNKKNRISPRHLLLAVRNDEELGKLLAGVTIAYGGVLPNINPVLLPKRKENAAASTPKSPSKAKKSPKKA

SEQ ID NO: 7381 - protein, 64 aa, Phaseolus coccineus
METGGKIKKGAGGRKGGGPKKKPVTRSVRAGLQFPVGRVGRYLKKGRYAKRVGTRCSRLLGCCS

SEQ ID NO: 7382 - protein, 151 aa, Lactuca sativa
MEGAAKSKKGAGGRKAGGPRKKAVTRSVKAGLQFPVGRIGRFLKKGRYAQRVGSGAPVYLAAVLEYLAAEVLELAGNAARDNKKTRIIPRHLLLAIRNDEELGKLLGGVTIAHGGVLPNINPILLPKKTAAKEPSTPSKAAKSPKKAKKAE

SEQ ID NO: 7383 - protein, 150 aa, Lactuca sativa
MEGTGKVKKGAAGRKGGPRKKSVTRSVKAGLQFPVGRIGRFLKNGRYAKRVGTGAPVYLAAVLEYLAAEVLELAGNAARDNKKHRIIPRHLLLAVRNDEELGKLLAGVTIAHGGVLPNINPILLPKKTAAAAEPKSPSKAAKSPKKAAKA

SEQ ID NO: 7384 - protein, 85 aa, Lactuca sativa
  misc_feature (75)..(75): Xaa can be any naturally occurring amino acid
MRLGTTRKPESSQDIFCWPLETMKSLENYWVELRLLMVEFFQTSILFCCRRRLLLRSHQLLLKLLNLQRKLRRLXRLSCLNFILL

SEQ ID NO: 7385 - protein, 135 aa, Zea mays
MDASAAGAGGKAKKGAAGRKAGGPRKKSVTRSVKAGLQFPVGRIGRYLKKGRYAQRVGTGAPVYLAAVLEYLAAEVLELAGNAAKGHKKTRIIPRHVLLAIRNDEELGKLLSGVTIAQGGVLPKINPGVLAKKTL

SEQ ID NO: 7386 - protein, 155 aa, Senecio madagascariensis
KFNKKWKPPGKSKKGAGGRKGGGPRKKSVTRSIKAGLQFPVGRIGRYLKNGRYAKRVGTGAPVYLAAVLEYLAAEVLELAGNAARDNKKTRIIPRHVLLAIRNDEELGKLLSGVTIAHGGVLPNINPVLLPKKTAAKEATKSPVKTPKSPKKAAA

SEQ ID NO: 7387 - protein, 159 aa, Brachypodium distachyon
MDGAGGKAKKGAVGKKLGGPRKKSVTRSVKAGLQFPVGRIGRFLKKGRYAQRVGSGAPVYLAAVLEYLAAEVLELAGNAARDNKKTRIIPRHVLLAIRNDEELGRLLGGVTIAHGGVLPNINPLLLPKKAAEKAGTEKVAAKSPKKPAGKSPKKAAAKA

SEQ ID NO: 7388 - protein, 154 aa, Gossypium hirsutum
MDAGSKVKKGAGGRKGGGPKKKPVSRSVKAGLQFPVGRIGRYLKKGRYSQRVGTGAPVYLAAVLEYLAAEVLELAGNAARDNKKNRIIPRHVLLAVRNDEELGKLLAGVTIAHGGVLPNINPVLLPKKNEKAAAKEPKSPSKATKSPKKSPKKA

SEQ ID NO: 7389 - protein, 151 aa, Lactuca sativa
MEGAGKAKKGAGGRKGGGPRKKAVTRSVKAGLQFPVGRIGRFLKKGRYAQRVGSGAPVYLAAVLEYLAAEVLELAGNAARDNKKTRIIPRHLLLAIRNDEELGKLLGGVTIAHGGVLPNINPILLPKKTAAKEPSTPSKAAKSPKKAKKAE

SEQ ID NO: 7390 - protein, 153 aa, Persea americana
MEGGGKVKKGAAGRKGGGPKKKPVSRSVKAGLQFPVGRIGRYLKKGRYSQRVGTGAPVYLAAVLEYLAAEVLELAGNAARDNKKNRIIPRHVLLAVRNDEELGKLLAGVTIAHGGVIPNINPVLLPKKTAEKAAKEPKSSSKAPKSPKKAAAA

SEQ ID NO: 7391 - protein, 156 aa, Hordeum vulgare
MEVSGAAAKGKKGAAGRKAGGPRKKSVTRSVKAGLQFPVGRIGRYLKKGRYAQRVGTGAPVYLAAVLEYLAAELLELAGNAAKDNKKSRIIPRHLLLAVRNDEELGKLLAGVTIAHGGVIPKINPVLLPKRTAEKEGKGPKSPKKATKSPKKATKA

SEQ ID NO: 7392 - protein, 150 aa, Cichorium intybus
MEGTGKAKKGAAGRKGGPRKKAVSRSVKAGLQFPVGRIGRYLKKGRYAKRVGTGATVYLAAVLEYLAAEVLELAGNAARDNKKTRIIPRHLLLAIRNDEELGKLLAGVTIAHGGVLPNINPILLPKKTAAAKEPKSPSKAAKSPKKAVKA

SEQ ID NO: 7393 - protein, 155 aa, Taraxacum officinale
METTGKAKKGAGGRKGGGPRKKSVTRSVKAGLQFPVGRIGRYLKLGRYAKRVGTGAPVYLAAVLEYLAAEVLELAGNAARDNKKTRIIPRHVLLAIRNDDELGKLLGGVTIAHGGVLPNINPVLLPKKTTPSEPKSPSKGAKSPKKAAKTPKKAE

SEQ ID NO: 7394 - protein, 136 aa, Zea mays
MDASGAGSKAKKGAAGRKAGGPRKKSVSRSVKAGLQFPVGRIGRYLKKGRYAQRVGTGAPVYLAAVLEYLAAEVLELAGNAAKDNKNTFIVPRHLLLAIVTTLSSQFAVWPHHRARRCPPQHQPGSPAQKVAGKGV

SEQ ID NO: 7395 - protein, 150 aa, Panax ginseng
MDNTGKGKKGAGGRKGGGPRKKAVTRSARAGLQFPVGRIGRYLKKGRYAQRLGTGAPVYLAAVLEYLAAEVLELAGNAARDNKKNRIIPRHLLLAVRNDEELGKLLGGVTIAHGGVLPNINPVLLPKKTDKATKEPKSPSKAATKSPKKA

SEQ ID NO: 7396 - protein, 152 aa, Orobanche aegyptiaca
MEASGKVKKGAAGRKIGGGPRKKSVTRSVRAGLQFPVGRIGRYLKKGRYAQRVGTGAPVYVAAVLEYLAAEVLELAGNAARDNKKNRIIPRHLLLAVRNDEELGKLLAGVTIAHGGVIPNINPVLLPKKNEKDGEKTPKSPAKKATKSPKKA

SEQ ID NO: 7397 - protein, 151 aa, Tragopogon dubius
METSGKLKKGAAGRKAGGPKKKSVTRSVKAGLQFPVGRIGRYIKNGRYAKRVGTGAPVYLAAVLEYLAAEVLELAGNAARDNKKSRIIPRHVLLAVRNDEELGKLLAGVTIAHGGVLPNINPVLLPKKNLDKAEKETTKSPKKAAKSPKKA

SEQ ID NO: 7398 - protein, 152 aa, Catharanthus roseus
METAGKVKKGAAGRKGGGPKKKPVTRSTRAGLQFPVGRIGRYLKKGRYSQRVGTGAPVYMAAVLEYLAAEVLELAGNAARDNKKNRIIPRHVLLAIRNDEELGKLLAGVTIAHGGVLPNINPVLLPKKTGEKVATKEPKSPSKATKSPKKAA

SEQ ID NO: 7399 - protein, 152 aa, Catharanthus roseus
MDTATGKMKKGAAGRRGGGPKKKPVSRSSRAGLQFPVGRIGRYLKKGRYSQRVGTGAPVYMAAVLEYLAAEVLELAGNAARDNKKNRIIPRHVLLAVRNDEELGKLLAGVTIAHGGVLPNINPVLLPKKNEKAAAKEPAKSPAKGTKSPKKA

SEQ ID NO: 7400 - protein, 152 aa, Catharanthus roseus
MDTAGKVKKGAAGRKGGGPKKKPVTRSTRAGLQFPVGRIGRYLKKGRYSQRVGTGAPVYMAAVLEYLAAEVLELAGNAARDNKKNRIIPRHVLLAIRNDEELGKLLAGVTIAHGGVLPNINPVLLPKKSGEKVATKEPKSPSKATKSPKKAA

SEQ ID NO: 7401 - protein, 152 aa, Centaurea maculosa
METGGKLKKGAAGRKAGGGPKKKPVTRSVKAGLQFPVGRIGRYLKKGRYSKRVGTGAPVYLAAVLEYLAAEVLELAGNAARDNKKNRIIPRHVLLAVRNDDELGKLLSGVTIAHGGVLPNINPVLLPKKSHEKATKEPSKSPSKATKSPKKA

SEQ ID NO: 7402 - protein, 149 aa, Zingiber officinale
METGGKARKGAGGRRGGGGPKKKPVSRSVKAGLQFPVGRIGRYLKHGRYAKRVGTGAPVYLAAVLEYLAAEVLELAGNAARDNKKTRIVPRHVLLAIRNDEELGKLLAGVTIAHGGVLPNINPVLLPKKTASKEPKSPSKPAGKSPKKA

SEQ ID NO: 7403 - protein, 151 aa, Actinidia deliciosa
  misc_feature (7)..(7): Xaa can be any naturally occurring amino acid
  misc_feature (11)..(11): Xaa can be any naturally occurring amino acid
  misc_feature (16)..(16): Xaa can be any naturally occurring amino acid
  misc_feature (100)..(100): Xaa can be any naturally occurring amino acid
MEAGGKXRKGXGGRKXGGPKKKPVSRSVKAGLQFPVGRIGRYLKKGRYAQRVGTGAPVYLAAVLEYLAAEVLELAGNAARDNKKNRIIPRHVLLAVRNDXELGKLLAGVTIAHGGVLPNINPVLLPKKNEKVATKEPKSPSKATKSPKKAA

SEQ ID NO: 7404 - protein, 148 aa, Carthamus tinctorius
METTGKAKKGAGGRKGGGPRKKAVTRSIRAGLQFPVGRIGRYLKNGRYAKRVGTGAPVYLAAVLEYLAAEVLELAGNAARDNKKNRIIPRHVLLAIRNDDELGKLLAGVTIAHGGVLPNINPILLPKKTAAKEPKSPSKATKSPKKAD

SEQ ID NO: 7405 - protein, 150 aa, Helianthus annuus
METTGKAKKGVAGRKAGGPRKKSVTRSVKAGLQFPVGRIGRYLKHGRYAKRVGTGAPVYLAAVLEYLAAEVLELAGNAARDNKKNRITPRHVLLAIRNDDELGKLLAGVTIAHGGVLPNINPVLLPKKSAAAAKETKSPVKPGKSPKKAA

SEQ ID NO: 7406 - protein, 160 aa, Artemisia annua
METGGKKKGAAGRKGPAGPRKKSVTRSVKAGLQFPVGRIGRYLKNGRYAKRVGTGAPVYLAAVLEYLAAEVLELAGNAARDNKKSRIIPRHVLLAIRNDDELGKLLSGVTIAHGGVLPNINPVLLPKKSATKESTPKSPAKAAKSPKKLPIHHTILKSAS

SEQ ID NO: 7407 - protein, 107 aa, Jatropha curcas
MDSGAKVKKGAGGRKGGGPKKKPTSRSVKAGLQFPVGRIGRYLKKGRYAQRVGSGAPVYMAAVLEYLAAEVLELAGNAARDNKKNRIIPRHVLLAVRNDEELGITAE

SEQ ID NO: 7408 - protein, 61 aa, Tropaeolum majus
MDAGGKAKKGAGGRKAGGPKKKAVTRSIKAGLQFPVGRIGRYLKKGRYSQRWCSGLSRRCS

SEQ ID NO: 7409 - protein, 149 aa, Tropaeolum majus
MDTGGKGKKGAGGRKGGDQKKKPVTRSIKAGLQFPVGRIGRYLKKGRYAQRVGSGAPVYLAAVLEYLAAEVLELAGNAAKDNKKTRIIPRHILLAVRNDEELGKLLAGVTIAHGGVLPNINPVLLPKKTEKAGKEPKSPSKTTKSSKKP

SEQ ID NO: 7410 - protein, 150 aa, Orobanche aegyptiaca
MDASAKVKKGAGGRKGGGPKKKPVSRSVKAGLQFPVGRIGRYLKKGRYSQRVGTGAPVYLAAVLEYLAAEVLELAGNAARDNKKNRIIPRHLLLAVRNDEELGKLLAGVTIAHGGVIPNINPILLPKKTDKAAEKTPKSPAKATKSPKKA

SEQ ID NO: 7411 - protein, 149 aa, Pisum sativum
MDASTKTKKGAAGRKGGGPRKKSVTRSVRAGLQFPVGRIGRFLKKGRYAQRVGTGAPVYLAAVLEYLAAEVLELAGNAARDNKKKSISPRHLLLAVRNDEELGKLLAGVTIARGGVLPNINPVLLPKRTESAATAPKSPSKARKSPKKA

SEQ ID NO: 7412 - protein, 145 aa, Taraxacum officinale
  misc_feature (68)..(68): Xaa can be any naturally occurring amino acid
MEKKGAAGRKGGPRKKAVSRSVKAGLQFPVGRLGRYLKNGRYAKRVGTGAPVYLAAVLEYLAAEVLEXAGNAARDNKKTRIIPRHVLLAVRNDEELGKLLAGVTIAHGGVLPNINPVLLPKKTAAAKEPKSPSKAAKSPKKATKA

SEQ ID NO: 7413 - protein, 150 aa, Lactuca sativa
MEGTGKVKKGAAGRKGGPRKKSVTRSVKAGLQFPVGRIGRFLKNGRYAKRVGTGAPVYLAAVLEYLAAEVLELAGNAARDNKKHRIIPRHLLLAVRNDEELGKLLAGVTIAHGGVLPNINPILLPKKTATATEPKSPSKAAKSPKKAAKA

SEQ ID NO: 7414 - protein, 151 aa, Lactuca sativa
MEGAAKSKKGAGGRKAGGPRKKAVTRSVKAGLQFPVGRIGRFLKKGRYAQRVGSGAPVYLAAVLEYLAAEVLELAGNASRDNKKTRIIPRHLLLAIRNDEELGKLLGGVTIAHGGVLPNINPILLPKKTAAKEPSTPSKAAKSPKKAKKAE

SEQ ID NO: 7415 - protein, 151 aa, Nicotiana benthamiana
MDTAGKAKKGAGGRKAGGQSKKPVSRSVKAGLQFPVGRIGRYLKKGRYAQRVGSGAPVYLAAVLEYLAAEVLELAGNAARDNKKNRIIPRHVLLAVRNDEELGKLLAGVTIAHGGVLPNINPILLPKKTGGAEKEPKSPAKATKSPRKAVA

SEQ ID NO: 7416 - protein, 159 aa, Secale cereale
  misc_feature (50)..(50): Xaa can be any naturally occurring amino acid
  misc_feature (102)..(102): Xaa can be any naturally occurring amino acid
MDASATGAGAKGKKGAAGRKAGGPRKKSVTRSVKAGLQFPVGRIGRYLKXGRYAKRVGTGAPVYLAAVLEYLAAELLELAGNAAKDNKKSRIVPRHLLLAVXNDQELGRLLAGVTIAHGGVLPNINPVLLPKRTAEKEPKEGKSPKKATKSPKKADKKA

SEQ ID NO: 7417 - protein, 196 aa, Euphorbia esula
METGGKLKKGAGGRKGGGPKKKPVSRSVKAGLQFPVGRIGRYLKNGRYARRVGTGAPVYLAAVLEYLAAEVLELAGNAARDNKKNRIIPRHVLLAIRNDEELGKLLAGVTIAHGGVLPNINPVLLPKKSEKATTKEPKSPSKAPPPLLFFFFFFFFFFFFPPEKLLTCSLPICMYFVGFLGPSSGLFINGSSKLMN

SEQ ID NO: 7418 - protein, 149 aa, Helianthus annuus
MEATGKAKKGAAGRKAGGPRKKAVTRSIRAGLQFPVGRIGRYLKNGRYAKRVGTGAPVYLAAVLEYLAAEVLELAGNAARDNKKNRINPRHVLLAIRNDDELGKLLAGVTIAHGGVLPNINPVLLPKKTAAKEPKSPAKATKSPKKAAA

SEQ ID NO: 7419 - protein, 155 aa, Hordeum vulgare
MDASATVAAGKGKKGAAGRKAGGPRKKSVSRSVKAGLQFPVSRIGRFLKKGRYAQRVGSGAPVYLAAVLEYLAAELLELAGNAAKDNKKSRITPRHLLLAIRNDEELGKLLAGITIAHGGVIPNINPVLLPKKTAEKSPKEPKSPKKTAKSPKKA

SEQ ID NO: 7420 - protein, 149 aa, Cicer arietinum
MDTSPKSKRGAGGRKGGGPRKKAVTRSTRAGLQFPVGRIGRYLKKGRYAQRVGTGAPVYLAAVLEYLAAEVLELAGNAARDNKKNRIIPRHVLLAVRNDEELGKLLAGVTIAHGGVLPNINPILLPKKNERAVKEPKSPSKAVKSPKKA

SEQ ID NO: 7421 - protein, 152 aa, Cucumis sativus
MDSGGKAKKGFAGRRGGADSKKKPVSRSVKAGLQFPVGRIGRYLKNGRYSQRVGTGAPVYLAAVLEYLAAEVLELAGNAARDNKKNRIIPRHVLLAVRNDEELGKLLAGVTIAHGGVLPNINPVLLPKKSERAAAAKEPKSPSKGTKSPKKA

SEQ ID NO: 7422 - protein, 148 aa, Medicago truncatula
MDASTKTKKGAGGRKGGPRKKSVTRSTRAGLQFPVGRIGRYLKKGRYAQRVGTGAPVYLAAVLEYLAAEVLELAGNAARDNKKNRIIPRHVLLAVRNDEELGKLLAGVTIAHGGVLPNINPILLPKKNEKAATTTKSPSKATKSPKKA

SEQ ID NO: 7423 - protein, 145 aa, Medicago truncatula
MDKKGAGGRKGGEPRKKSVTRSIRAGLQFPVGRIGRYLKKGRYAQRVGTGAPVYLAAVLEYLAAEVLELAGNAARDNKKNRIIPRHVLLAVRNDEELGKLLNGVTIAHGGVFPNINPILLPKKTEKAVSKEPKSPKKAGKSPKKA

SEQ ID NO: 7424 - protein, 151 aa, Orobanche aegyptiaca
MEASGKVKKGAAGRKIGGGPRKKSVTRSVRAGLQFPVGRIGRYLKKGRYAQRVGTGAPVYVAAVLEYLAAEVLELAGNAARDNKKNRIIPRHLLLAVRNDEELGKLLAGVTIAHGGVIPNINPILLPKKADKAAEKTPKSPAKATKSPRKA

SEQ ID NO: 7425 - protein, 151 aa, Orobanche aegyptiaca
MDASGKVKKGAAGRKIGGGPRKKSVTRSVRAGLQFPVGRIGRYLKKGRYAQRVGTGAPVYVAAVLEYLAAEVLELAGNAARDNKKNRIIPRHLLLAVRNDEELGKLLAGVTIAHGGVIPNINPVLLPKKNEKVGEKAPKSPAKATKSPKKA

SEQ ID NO: 7426 - protein, 147 aa, Pisum sativum
TKVKKGAGGRKGGGPRKKSVTRSVRAGLQFPVGRIGRFLKKGRYAQRVGTGAPVYLAAVLEYLAAEVLELAGNAARDNKKNRISPRHLLLAVRNDEELGKLLAGVTIAHGGVLPNINPVLLPKRTESASSTAKEPKSPKAKKTPKKA

SEQ ID NO: 7427 - protein, 149 aa, Ocimum basilicum
METGGKLKKGAGGRKGGGPKKKPVSRSVKAGLQFPVGRIGRYLKKGRYSQRVGTGAPVYMAAVLEYLAAEVLELAGNAARDNKKNRIIPRHVLLAVRNDEELGKLLAGVTIAHGGVLPNINPVLLPKKSGNVAEKTPKSPKATKSPKKA

SEQ ID NO: 7428 - protein, 149 aa, Phaseolus coccineus
METAGKIKKGAGGRKGGGPKKKPVSRSVKAGLQFPVGRIGRYLKKGRYAQRVGSGAPIYLAAVLEYLAAEVLELAGNAARDNKKNRIIPRHVLLAVRNDEELGKLLAGVTIAHGGVLPNINPVLLPKKTEKASKEPKSPSKATKSPRKS

SEQ ID NO: 7429 - protein, 149 aa, Theobroma cacao
  misc_feature (8)..(8): Xaa can be any naturally occurring amino acid
MDTGGKVXKGAGGRKGGGPKKKPVSRSVKAGLQFPVGRIGRYLKKGRYSQRVGTGAPVYMAAVLEYLAAEVLELAGNAARDNKKNRIIPRHVLLAVRNDEELGKLLAGVTIAHGGVLPNINPVLLPKKTDKATKEPKSPSKATKSLKKA

SEQ ID NO: 7430 - protein, 149 aa, Manihot esculenta
  misc_feature (81)..(81): Xaa can be any naturally occurring amino acid
  misc_feature (88)..(88): Xaa can be any naturally occurring amino acid
METGGKVKKGAGGRKGGGPKKKPTSRSVRAGLQFPVGRIGRYLKKGRYSQRVGTGAPVYLAAVLEYLAAEVLELAGNAARXNKKNRIXPRHVLLAVRNDEELGKLLAGVTIAHGGVLPNINPVLLPKKTEKATKEPKSPSKATKSPKKA

SEQ ID NO: 7431 - protein, 148 aa, Cichorium intybus
AGDAGEKGAAGRKAGGPKKKPVTKSVKAGLQFPVGRIGRYIKKGRYAKRVGTGAPVYLAAVLEYLAAEVLELAGNAARDNKKTRIIPRHVLLAVRNDEELGKLLAGVTIAHGGVLPNINPILLPKKSLEKATKEPKSPAKSAKSPKKA

SEQ ID NO: 7432 - protein, 151 aa, Trifolium pratense
MDTSPKSKKGAGGRKGGGPRKKSVTRSTRVGLQFPVGRIGRYLKKGRYAQRVGTGAPVYLAAVLEYLAAEVLELAGNAARDNKKNRIIPRHVLLAVRNDEELGKLLAGVTIAHGGVLPNINPILLPKKTDRSTTASKEPKSPKAKKSPKKA

SEQ ID NO: 7433 - protein, 148 aa, Actinidia deliciosa
METGGKMKKGAAGRRGGGPKKKPITRSVKAGLQFPVGRIGRYLKKGRYAQRVGSGAPVYLAAVLEYLAAEVLELAGNAARDNKKNRIIPRHVLLAVRNDEELGKLLAGVTIAHGGVLPNINPVLLPKKTQATKEPKSPTKATKSPKKA

SEQ ID NO: 7434 - protein, 148 aa, Medicago truncatula
MEASTKTTKKGAGGRKGGGPRKKSVTRSIRAGLQFPVGRIGRYLKKGRYAQRVGTGAPVYLAAVLEYLAAEVLELAGNAARDNKKNRIIPRHVLLAVRNDEELGKLLNGVTIAHGGVLPNINPILLPKKTEKTAPKEPKKAGKSPKKA

SEQ ID NO: 7435 - protein, 144 aa, Quercus alba
MDKKGAGGRKGSGSRKKSVTRSVKAGLQFPVGRIGRYLKKGRYAQRCGSGAPVYMAAVLEYLAAEVLELAGNAARDNKKTRIIPRHVLLAVRNDEELGKLLAGVTIAHGGVLPNINPILLPKKTEKITKEPKSPSKAAKSPKKA

SEQ ID NO: 7436 - protein, 150 aa, Arachis hypogaea
MDSPAGKTKKGAAGRRGGGPKRKPVSRSVKAGLQFPVGRIGRFLKKGRYSQRVGTGAPVYLAAVLEYLAAEVLELAGNAARDNKKNRIIPRHVLLAVRNDEELGKLLAGVTIAHGGVLPNINPVLLPKKSQTATKEPKSPSKGTKSPKKA

SEQ ID NO: 7437 - protein, 151 aa, Nicotiana tabacum
MDTSGKAKKGAAGRRGGGPKKKPVTRSVRAGLQFPVGRIGRYLKKGRYAQRVGTGAPVYLAAVLEYLAAEVLELAGNAARDNKKNRIIPRHVLLAVRNDEELGKLLAGVTIAHGGVLPNINPILLPKKTGGDKAGKEPKSPSKATKSPKKA

SEQ ID NO: 7438 - protein, 150 aa, Triphysaria pusilla
METGGKVKKGAAGRKAGGPKKKSVTRSVKAGLQFPVGRIGRFLKKGRYAQRVGSGAPVYLAAVLEYLAAEVLELAGNAARDNKKSRIIPRHLLLAVRNDEELGKLLAGVTIAHGGVIPNINPVLLPKKSDKVAEKAPKSPSKAAKSPKKA

SEQ ID NO: 7439 - protein, 150 aa, Triphysaria pusilla
METGGKAKKGAAGRKAGGPKKKSVSRSVKAGLQFPVGRIGRFLKKGRYAQRVGSGAPVYLAAVLEYLAAEVLELAGNAARDNKKSRIIPRHLLLAVRNDEELGKLLAGVTIAHGGVIPNINPVLLPKKTDKGADKEPKSPSKATKSPKKA

SEQ ID NO: 7440 - protein, 153 aa, Triticum aestivum
MDASAAGAVPKAKKYVVGRKLGGGPRKQAVARSVKAGLQFPVGRIGRFLKKGRYAQRVGMGAPVYLASVLEYLAAELLELAGNAAKDNKKSRIIPRHLLLAIRNDQELGRLLAGVTIAHGGVLPNINPVLLPKKAADKEPKSPKKAAKSPKKA

SEQ ID NO: 7441 - protein, 153 aa, Triticum aestivum
MDASPTGAVSKAKKYVVGRKLGGGPRKKAVARSVKAGLQFPVGRIGRFLKKGRYAQRVGMGAPVYLASVLEYLAAELLELAGNAAKDNKKSRIIPRHLLLAIRNDQELGKLLAGVTIAHGGVLPNINPVLLPKKTTEKEPKSPKKAAKSPKKA

SEQ ID NO: 7442 - protein, 153 aa, Heritiera littoralis
MDAGGKVKKGAGGRKGGGPKKKPVSRSVKAGLQFPVGRIGRYLKKGRYSQRVGTGAPVYLAAVLEYLAAEVLELAGNAARDNKKNRIIPRHVLLAVRNDEELGKLLAGVTIAHGGVLPNINPVLLPKKNEKAVKEPKSPSKATKSPKKSLKKA

SEQ ID NO: 7443 - protein, 159 aa, Hordeum vulgare
MDASGTGAGAKGKKGAAGRKAGGPRKKSVTRSVKAGLQFPVGRIGRYLKKGRYAKRVGTGAPVYLAAVLEYLAAELLELAGNAAKDNKKSRIVPRHLLLAVRNDQELGRLLAGVTIAHGGVLPNINPVLLPKRTAEKEPKEGKSPKKAAKSPKKADKKA

SEQ ID NO: 7444 - protein, 151 aa, Lactuca sativa
MEGAGKTKKGAGGRKGGGPRKKAVTRSVKAGLQFPVGRIGRFLKKGRYAQRVGIGAPVYLAAVLEYLAAEVLELAGNAARDNKKTRIIPRHLLLAIRNDEELGKLLGGVTIAHGGVLPNINPILLPKKTAAKEPSIPSKAAKSPKKAKKSE

SEQ ID NO: 7445 - protein, 166 aa, Hordeum vulgare
MDASGTVAKGKKGAAGRKAGSPRKKSVSRSVKAGLQFPVGRIGRYLKKGRYAQRVGTGAPVYLAAVLEYLAAELLELAGNAAKDNKKSRIIPRHLLLAVRNDEELGKLLAGVTIAHGGVVPNINTVLLPKRTAEKEGKAPKSPKKAPKSPKKAAKSPKKAATPKKA

SEQ ID NO: 7446 - protein, 154 aa, Saccharum officinarum
  misc_feature (133)..(134): Xaa can be any naturally occurring amino acid
  misc_feature (139)..(139): Xaa can be any naturally occurring amino acid
MDGGGAKVKKAAAGRKLGGGGPKKKPVSRSVKAGLQFPVGRIGRYLKKGRYAQRVGTGAPVYLAAVLEYLAAEVLELAGNAARDNKKNRIIPRHVLLAIRNDEELGKLLAGVTIAHGGVLPNIHSVLLPKKAXXRAEKXATATQVPKKARRQVA

SEQ ID NO: 7447 - protein, 155 aa, Cleome gynandra
MDSGAKLKKGVAGRRGGGPKKKPVSRSVKAGLQFPVGRIGRYLKKGRYSQRIGTGAPVYLAAVLEYLAAEVLELAGNAARDNKKNRIIPRHVLLAVRNDEELGKLLQGVTIAHGGVLPNINPVLLPKKPEKNVAAAATTKESKSPSKATKSPKKA

SEQ ID NO: 7448 - protein, 151 aa, Artemisia annua
MEGTGKIKKGAAGRKAGGPRKKSVTRSVKAGLQFPVGRIGRYLKKGRYAKRVGTGAPVYLAAVLEYLAAEVLELAGNAARDNKKTRIIPRHVLLAIRNDEELGKLLSGVTIAHGGVLPNINPVLLPKKTAAKESTPKSPSKVGKSPKKAAA

SEQ ID NO: 7449 - protein, 151 aa, Unknown
  Sequence found in Organisms: Ipomoea nil, Ipomoea nil
MDAPAAKIKKGAGGRKGGGPKKKPVTRSVRAGLQFPVGRIGRYLKKGRYAQRVGTGAPVYMAAVLEYLAAEVLELAGNAARDNKKNRIIPRHVLLAVRNDEELGKLLAGVTIAHGGVLPNINPVLLPKKSGSEATKEPKAKAAKSPKKKAA

SEQ ID NO: 7450 - protein, 151 aa, Helianthus annuus
METTGKAKKGAAGRKAGGPRKKSVTRSVKAGLQFPVGRIGRFLKHGRYAKRVGTGAPVYLAAVLEYLAAEVLELAGNAARDNKKNRITPRHVLLAIRNDDELGKLLAGVTIAHGGVLPNINPVLLPKKSAAAAKEPGKPPAKTGKSPKKAA

SEQ ID NO: 7451 - protein, 151 aa, Orobanche aegyptiaca
MDASAKVKKGAGGRKGGGPKKKPVSRSVKAGLQFPVGRIGRYLKKGRYSQRVGTGAPVYMAAVLEYLAAEVLELAGNAARDNKKNRVIPRHLLLAVRNDEELGKLLAGVTIAHGGVIPNINPILLPKKSDKVAEKTPKSPAKKAAKSPKKA

SEQ ID NO: 7452 - protein, 42 aa, Lactuca sativa
MEGAGKAKKGAGGRKGGGPRKKAVSRSVKPDFSFRLVGSDVF

SEQ ID NO: 7453 - protein, 159 aa, Sorghum bicolor
MDAGAKVPKKAAAGRRGGGGPKKKPVSRSVKAGLQFPVGRIGRYLKQGRYAQRIGTGAPVYLAAVLEYLAAEVLELAGNAARDNKKNRIIPRHVLLAIRNDEELGKLLAGVTIAHGGVLPNINPVLLPKKTAAAAAKEGKEKKSPKKAATKSPKKAAAA

SEQ ID NO: 7454 - protein, 153 aa, Cleome spinosa
MDAGAKLKKGAGGRRGGGPKKKPVSRSVKSGLQFPVGRIGRYLKKGRYSQRVGTGAPVYLAAVLEYLAAEVLELAGNAARDNKKNRIIPRHILLAVRNDEELGRLLQGVTIAHGGVLPNINPVLLPKKPEKTAAAVKETKSPPSKAAKSPKKA

SEQ ID NO: 7455 - protein, 145 aa, Solanum melongena
MEKKGAGGRKGGGPKKKPVTRSVKAGLQFPVGRIGRYLKKGRYSQRVGTGAPVYLAAVLEYLAAEVLELAGNAARDNKKNRIIPRHVLLAVRNDEELGKLLAGVTIAHGGVLPNINPVLLPKKSDKVGKEPAKSPSKATKSPKKA

SEQ ID NO: 7456 - protein, 150 aa, Panax ginseng
METGGKFKKGAAGRKGGGPKKKSVSRSVKAGLQFPVGRIGRYLKVGRYAKRVGSGAPVYLAAVLEYLAAEVLELAGNAARDNKKKTIIPRHVLLAVRNDEELGRLLAGVTIAHGGVLPNINPVLLPKKSEKAAKEPTKSPSKATKSPRKA

SEQ ID NO: 7457 - protein, 150 aa, Malus domestica
METGGKFKKGAGGRRAGGPKKKPVTRSVRAGLQFPVGRIGRYLKHGRYAQRIGTGAPVYLAAVLEYLAAEVLELAGNAARDNKKNRIIPRHVLLAVRNDEELGKLLKGVTIAHGGVLPNINPVLLPKKHERVAKEPKSPVKAATKSPKKA

SEQ ID NO: 7458 - protein, 150 aa, Malus domestica
MEGGGKVKKGAAGRKGGGPRAKPVTRSIKAGLQFPVGRIGRYLKKGRYAQRVGTGAPVYLAAVLEYLAAEVLELAGNAARDNKKNRIIPRHLLLAVRNDEELGKLLAGVTIAHGGVLPNINPILLPKKTDKATKEPKSPSKATKSPKKSA

SEQ ID NO: 7459 - protein, 148 aa, Centaurea maculosa
  misc_feature (3)..(3): Xaa can be any naturally occurring amino acid
MEXTGKAKKGAGGRKGGGPRKKAVTRSIRAGLQFPVGRIGRYLKNGRYAKRVGTGAPVYLAAVLEYLAAEVLELAGNAARDNKKNRIIPRHVLLAIRNDDELGKLLAGVTIAHGGVLPNINPILLPKKTAAKEPKSPSKSTKSPKKAD

SEQ ID NO: 7460 - protein, 152 aa, Centaurea maculosa
METGGKLKKGAAGRKAGGGPKKKPVTRSVKAGLQFPVGRIGRYLKKGRYSKRVGTGAPVYLAAVLEYLAAEVLELAGNAARDNKKNRIIPRHVLLAVRNDDELGKLLSGVTIAHGGVLPNINPVLLPKKSHDKATKEPAKSPSKATKSPKKA

SEQ ID NO: 7461 - protein, 151 aa, Rosa hybrid cultivar
METGGKFKKGAGGRKAGGPKKKPVTRSTKAGLQFPVGRIGRYLKNGRYAQRVGSGAPVYLAAVLEYLAAEVLELAGNAARDNKKNRIIPRHVLLAVRNDEELGKLLAGVTIAHGGVLPNINPVLLPKNSGKTAAKEPKSPSKATKSPKKAA

SEQ ID NO: 7462 - protein, 150 aa, Fragaria vesca
ETGGKFKKGAGGRKAGGPKKKPVTRSTKAGLQFPVGRIGRYLKNGRYAQRVGSGAPVYLAAVLEYLAAEVLELAGNAARDNKKNRIIPRHVLLAVRNDEELGKLLAGVTIAHGGVLPNINPVLLPKNSGKTAAKEPKSPSKATKSPKKAA

SEQ ID NO: 7463 - protein, 160 aa, Saccharum officinarum
MDVSGAGAGGKAKKGAAGRKAGGPRKKSVSRSVKAGLQFPVGRIGRYLKKGRYAQRVGTGAPVYLAAVLEYLAAEVLELAGNAARDNKKTRIIPRHVLLAIRNDEELGKLLAGVTIGHGGVLPNIHSLVLPKRWARRRPRTQFAKKAASSPRRARVVFVF

SEQ ID NO: 7464 - protein, 150 aa, Saccharum officinarum
MEPRRATGKANKGAADRKAGRPRKKSVSRSVKAGLQFPVGRIGRYLKKGRYAQRVGTGAPVYLAAVLEYLAAEVLELAGNAARDNKKTRIIPRHVLLAIRNDEELGKLLAGVTIAHGGVLPNINPVLLPKKVAEKAASGSNKQAKSPKKA

SEQ ID NO: 7465 - protein, 151 aa, Nicotiana tabacum
MDTSGKAKKGAAGRRVGGPKKKPVTRSVRAGLQFPVGRIGRYLKKGRYAQRVGTGAPVYLAAVLEYLAAEVLELAGNAARDNKKNRIIPRHVLLAVRNDEELGKLLAGVTIAHGGVLPNINPILLPKKTGGEKAGKEHKSPSKATKSPKKA

SEQ ID NO: 7466 - protein, 62 aa, Artemisia annua
MEGMPRGLGLVLRFILLLSLNTLLLRNWQETQQGTTRRPGSSQGTFYWQSGTMTSLESCYLE

SEQ ID NO: 7467 - protein, 142 aa, Medicago truncatula
MDKKGAGGRKGGGPRKKSVTRSIRAGLQFPVGRIGRYLKKGRYAQRVGTGAPVYLAAVLEYLAAEVLELAGNAARDNKKNRIIPRHVLLAVRNDEELGKLLNGVTIAHGGVLPNINPILLPKKTEKAVPKEPKKAGKSPKKA

SEQ ID NO: 7468 - protein, 152 aa, Mimulus guttatus
METGGKMKKGAAGRKGTGPKKKPVSRSMKAGLQFPVGRIGRYLKKGRYSQRVGSGAPVYMAAVLEYLAAEVLELAGNAARDNKKNRIIPRHLLLAVRNDEELGKLLAGVTIAHGGVIPNINPVLLPKKSEKAAAAEKSPKSPAKATKSPKKA

SEQ ID NO: 7469 - protein, 152 aa, Avena sativa
MDGSKAKKVAVKKLGGPRKKSVTRSVKAGLQFPVGRIGRYLKNGRYAKRVGTGAPVYLAAVLEYLAAEVLELAGNAAKDNKKSRIIPRHLLLAIRNDQELGRLLGGVTIAHGGVLPNINPVLLPKKSVEKAEKAAAKSPKKATKSPKKAAKA

SEQ ID NO: 7470 - protein, 150 aa, Orobanche aegyptiaca
MDTSAKVKKGAGGRKGGGPKKKPVSRSVKAGLQFPVGRIGRYLKKGRYSQRVGTGAPVYMAAVLEYLAAEVLELAGNAARDNKKNRIIPRHLLLAVRNDEELGKLLAGVTIAHGGVIPNINPILLPKKSDKVAEKTPKSPAKATKSPKKA

SEQ ID NO: 7471 - protein, 151 aa, Orobanche aegyptiaca
MEASGKVKKGAAGRKIGGGPRKKSVTRSVRAGLQFPVGRIGRYLKKGRYAQRVGTGAPVYLAAVLEYLAAEVLELAGNAARDNKKNRIIPRHLLLAVRNDEELGKLLAGVTIAHGGVIPNINPILLPKKNDKVGEKTPKSPAKATKSPKKA

SEQ ID NO: 7472 - protein, 150 aa, Pisum sativum
MDASKQTKKGAGGRKGGGPRKKSVTRSVRAGLQFPVGRIGRFLKKGRYAQRVGTGAPVYLAAVLEYLAAEVLELAGNAARDNKKKSISPRHLLLAVRNDEELGKLLAGVTIARGGVLPNINPVLLPKRTESAAASTPKSPSKAKKSPKKA

SEQ ID NO: 7473 - protein, 148 aa, Pisum sativum
TKVKKGAGGRKGGGPRKKSVTRSVRAGLQFPVSRIGRFLKKGRYAQRVGTGAPVYLAAVLEYLAAEVLELAGNAARDNKKNRISPRHLLLAVRNDEELGKLLAGVTIAHGGVLPNINPVLLPKRTESASSSAKEPKSPSKAKKTPKKA

SEQ ID NO: 7474 - protein, 150 aa, Triphysaria pusilla
METGGKVKKGAAGRKAGGPKKKSVTRSVKAGLQFPVGRIGRFLKKGRYAQRVGSGAPVYLAAVLEYLAAEVLELAGNAARDNKKSRIIPRHLLLAVRNDEELGKLLAGVTIAHGGVIPNINPVLLPKKSDKVAEKSPKSPSKATKSPKKA

SEQ ID NO: 7475 - protein, 91 aa, Antirrhinum majus
MAAVLEYLAAEVLELAGNAARDNKKNRIIPRHLLLAVRNDEELGKLLAGVTIAHGGVLPNINPVLLPKKSEKAAEKAAKSPSKATKSPKKA

SEQ ID NO: 7476 - protein, 153 aa, Antirrhinum majus
MEAVAKVKKGAGGRKGGGPKKKPVTRSVRAGLQFPVGRIGRYLKKGRYAQRVGTGAPVYMAAVLEYLAAEVLELAGNAARDNKKNRIIPRHVLLAVRNDEELGKLLSGVTIAHGGVLPNINPVLLPKKTGGDKAEKAPKSPSKAGKSPKKAAA

SEQ ID NO: 7477 - protein, 154 aa, Hordeum vulgare
MDGSKAKKVAGKKLGGPRKKSVTRSIKAGLQFPVGRIGRFLKKGRYAQRVGSGAPVYLAAVLEYLAAEVLELAGNAAKDNKKTRIVPRHLLLAIRNDQELGRLLAGVTIAHGGVIPNINPVLLPKKSAEKAEKAGAAAKSPKKPAKSPKKAAKA

SEQ ID NO: 7478 - protein, 144 aa, Castanea mollissima
MDKKGAGGRKGSGSRKKSVPRSVKAGLQFPVGRIGRYLKKGRYAKRFGSGAPVYMAAVLEYLAAEVLELAGNAARDNKKTRIIPRHVLLAVRNDEELGKLLAGVTIAHGGVLPNINPVLLPKKTEKATKEPKSPSKATKSPKKA

SEQ ID NO: 7479 - protein, 152 aa, Festuca arundinacea
  misc_feature (11)..(11): Xaa can be any naturally occurring amino acid
  misc_feature (14)..(14): Xaa can be any naturally occurring amino acid
MDASKGKKFAXKKXGGPRKKSVTRSVKAGLQFPVGRIGRYLKKGRYAKRVGTGAPVYLAAVLEYLAAEVLELAGNAARDNKKSRIVPRHLLLAIRNDQELGRLLGGVTIAHGGVLPNINPVLLPKKSVEKAEKVAAKSPKKAAKSPKKAAKA

SEQ ID NO: 7480 - protein, 152 aa, Festuca arundinacea
MDASKGKKFAAKKLGGPRKKSVTRSVKAGLQFPVGRIGRYLKKGRYAKRVGTGAPVYLAAVLEYLAAEVLELAGNAARDNKKSRIVPRHLLLAIRNDQELGRLLGGVTIAHGGVLPNINPVLLPKKSVEKAEKVAAKSPKKAAKSPKKAAKA

SEQ ID NO: 7481 - protein, 148 aa, Actinidia deliciosa
METGGKMKKGAAGRRGGGPKKKPITRSVKAGLQFPVGRIGRYLKKGRYAQRVGSGAPVYLAAVLEYLAAEVLELAGNAARDNKKNRIIPRHVLLAVRNDEELGKLLAGVTIAHGGVLPNINPILLPKKTQATKEPKSPTKATKSPKKA

SEQ ID NO: 7482 - protein, 151 aa, Lactuca sativa
  misc_feature (134)..(134): Xaa can be any naturally occurring amino acid
MEGVAKSKKGAGGRKAGGPRKKAVTRSVKAGLQFPVGRIGRFLKKGRYAQRVGSGAPVYLAAVLEYLAAEVLELAGNASRDNKKTRIIPRHLLLAIRNDEELGKLLGGVTIAHGGVLPNINPVLLPKKTAAKEXSTPSKAAKSPKKAKKAE

SEQ ID NO: 7483 - protein, 150 aa, Lactuca sativa
MQTSGKVKKGAAGRKAGGPKKKSVSRSVKAGLQFPVGRIGRYIKNGRYAKRVGSGAPIYLAAVLEYLAAEVLELAGNAARDNKKSRIIPRHVLLAVRNDEELGKLLAGVTIAHGGVLPNINPILLPKKSLEKATKEPKSPAKAAKSPRKA

SEQ ID NO: 7484 - protein, 150 aa, Lactuca sativa
  misc_feature (2)..(2): Xaa can be any naturally occurring amino acid
MXTSGKVKKGAAGRKAGGPKKKSVSRSVKAGLQFPVGRIGRYIKNGRYAKRVGSGAPIYLAAVLEYLAAEVLELAGNAARDNKKSRIIPRHVLLAVRNDEELGKLLAGVTIAHGGVLPNINPILLPKKSLEKATKEPKSPAKAAKSPRKA

SEQ ID NO: 7485 - protein, 151 aa, Lactuca sativa
MEAAAKSKKGAGGRKAGGPRKKAVTRSVKAGLQFPVGRIGRFLKKGRYAQRVGSGAPVYLAAVLEYLAAEVLELAGNASRDNKKTRIIPRHLLLAIRNDEELGKLLGGVTIAHGGVLPNINPILLPKKTAAKEPSTPSKAAKSPKKAKKAE

SEQ ID NO: 7486 - protein, 152 aa, Liriodendron tulipifera
MEGTGKVKKGAGGRKGGGPKKKPVSRSVKAGLQFPVGRIGRYLKKGRYSQRVGTGAPVYLAAVLEYLAAEVLELAGNAARDNKKNRIVPRHVLLAVRNDEELGKLLKGVTIAHGGVLPNINPVLLPKKTGAAAEKAGKEPRSPSKAAKSPKA

SEQ ID NO: 7487 - protein, 152 aa, Zea mays
MDASKLKKVAGKKFGGPRKKSVTRSVKAGLQFPVGRIGRYLKKGRYAQRVGSGAPVYLAAVLEYLAAEVLELAGNAAKDNKKTRIVPRHLLLAIRNDQELGRLLSGVTIAHGGVIPNINPVLLPKKTAEKAEKTAAKSPKKATKSPKKATKA

SEQ ID NO: 7488 - protein, 148 aa, Medicago truncatula
MEASTKTTKKGAGGRKGGGPRKKSVTRSIRAGLQFPVGRIGRYLKKGRYAQRVGTGAPVYLAAVLEYLAAEVLELAGNAARDNKKNRIIPRHVLLAVRNDEELGKLLNGVTIAHGGVLPNINPILLPKKTEKAVSKEPKKAGKSPKKA

SEQ ID NO: 7489 - protein, 151 aa, Nicotiana benthamiana
MDTSGKAKKGAAGRRGGGPKKKPVTRSVRAGLQFPVGRIGRYLKKGRYAQRVGTGAPVYLAAVLEYLAAEVLELAGNAARDNKKNRIIPRHVLLAVRNDEELGKLLAGVTIAHGGVLPNINPILLPKKTGSDKAGKDPKSPSKATKSPKKA

SEQ ID NO: 7490 - protein, 152 aa, Petunia hybrida
METGGKVKKGAAGRRGGGPKKKPVSRSVRAGLQFPVGRIGRYLKKGRYAQRVGTGAPVYLAAVLEYLAAEVLELAGNAARDNKKNRIIPRHLLLAVRNDEELGKLLAGVTIAHGGVLPNINPVLLPKKTGGSEKAGKEPKSPSKATKSPKKA

SEQ ID NO: 7491 - protein, 154 aa, Papaver somniferum
  misc_feature (135)..(135): Xaa can be any naturally occurring amino acid
  misc_feature (152)..(152): Xaa can be any naturally occurring amino acid
MDATGKVKKGAGGRKGNGGPKKKSVTRSVRAGLQFPVGRIGRYLKKGRYAQRIGSGAPVYLAAVLEYLAAEVLELAGNAAIDNKKKTINPRHILLAVRNDEELGKLLAGVTIAHGGVLPNINPVLLPKKSERSTXAASKEPKSPVKAAKSPXKA

SEQ ID NO: 7492 - protein, 153 aa, Senecio madagascariensis
MEAGGKAKKGAAGRKAGGPRKKSVTRSVKAGLQFPVGRIGRYLKKGRYAKRVGTGAPVYLAAVLEYLAAEVLELAGNAARDNKKTRIIPRHVLLAVRNDEELGKLLAGVTIAHGGVLPNINPVLLPKKSQSGKEPASKSPVKATKSPKKGAAA

SEQ ID NO: 7493 - protein, 136 aa, Saccharum officinarum
MDVSGAGAGGKAMKGAVGRKAGGPRKKSVSRSVKAGLQFPVGRIGRYLKKGRYAQRVGTGAPVYLAAVLEYLAAEVLELAGNAARDNKKTRIIPRHVLLAIRNDEELGKLLAGVTIAHGGVLPNIHSVLLPQKVVL

SEQ ID NO: 7494 - protein, 168 aa, Saccharum officinarum
RIPPISTGLSPREATRSAAAARDSTGAGAGGKVKKGAGGRKAGGPRKKSVSRSVKAGLQFPVGRIGRYLKKGRYAQRVGTGAPVYLAAVLEYLADEVLELAGNAASDNKKTPIILRHMLLAIRNDEELGKLLGRCDHRPRGRAAQHPLNSAVQKNAIKSFQKGAQVSQ

SEQ ID NO: 7495 - protein, 150 aa, Helianthus annuus
MDAGGKLKKGAAGRKAGGPKKKPVTRSVKAGLQFPVGRIGRYLKVGRYAKRVGTGAPVYLAAVLEYLAAEVLELAGNAARDNKKNRINPRHVLLAVRNDDELGKLLAGVTIAHGGVLPNINPVLLPKKSHDKAAKEPKSPAKPTKSPKKA

SEQ ID NO: 7496 - protein, 150 aa, Nicotiana tabacum
MDTAGKAKKGAGGRKVGGQSKKPVSRSVKAGLQFPVGRIGRYLKKGRYAQRVGSGAPVYLAAVLEYLAAEVLELAGNAARDNKKNRIIPRHVLLAVRNDEELGKLLAGVTIAHGGVLPNINPILLPKKTGAEKAPKSPAKATKSPRKAAA

SEQ ID NO: 7497 - protein, 150 aa, Triphysaria pusilla
METGGKVKKGAAGRKAGGPKKKSVTRSVKAGLQFPVGRIGRFLKKGRYAQRVGSGAPVYLAAVLEYLAAEVLELAGNAARDNKKSRIIPRHLLLAVRNDEELGKLLAGVTIVHGGVIPNINPVLLPKKSDKVAEKAPKSPSKAAKSPKKA

SEQ ID NO: 7498 - protein, 150 aa, Triphysaria pusilla
METGGKVKKGAAGRKAGGPKKKSVTRSVKAGLQFPVGRIGRFLKKGRYSQRVGSGAPVYLAAVLEYLAAEVLELAGNAARDNKKSRIIPRHLLLAVRNDEELGKLLAGVTIAHGGVIPNINPVLLPKKSDKVAEKAPKSPSKAAKSPKKA

SEQ ID NO: 7499 - protein, 147 aa, Triphysaria pusilla
MDASAKVKKGAGGRKGGGPKKKPVSRSVKAGLQFPVGRIGRYLKKGRYSERVGSGAPVYMAAVLEYLAAEVLELAGNAARDNKKNRIIPRHVLLAVRNDEELGKLLAGVTIAHGGVIPNINPVLLPKKAAEKASKSPAKATKSPKKA

SEQ ID NO: 7500 - protein, 159 aa, Hordeum vulgare
MDASATGAGAKGKKGAAGRKAGGPRKKSVTRSVKAGLQFPVGRIGRYLKKGRYAKRVGTGAPVYLAAVLEYLAAELLELAGNAAKDNKKSRIVPRHLLLAVRNDQELGRLLAGVTIAHGGVLPNINPVLLPKRTAEKEPKEGKSPKKAAKSPKKADKKA

SEQ ID NO: 7501 - protein, 151 aa, Lactuca sativa
MEGAAKAKKGAGGRKAGGPRKKAVTRSVKAGLQFPVGRIGRFLKKGRYAQRVGSGAPVYLAAVLEYLAAEVLELAGNAARDNKKTRIIPRHLLLAIRNDEELGKLLGGVTIAHGGVLPNINPILLPKKTAAKEPSTPSKAAKSPKKAKKDE

SEQ ID NO: 7502 - protein, 160 aa, Zea mays
MDAGAKVVKKAAAGRRGGGGPKKKPVSRSVKAGLQFPVGRIGRYLKQGRYSQRVGTGAPVYLAAVLEYLAAELLELAGNAARDNKKNRIIPRHVLLAIRNDEELGKLLAGVTIAHGGVLPNINPVLLPKKTAVAAAKEGKEKKSPKKAAAAKSPKKVADS

SEQ ID NO: 7503 - protein, 150 aa, Triphysaria pusilla
MEATPKAKKGAAGRKAGGPKKKSVTRSVKAGLQFPVGRIGRFLKKGRYAQRVGSGAPVYLAAVLEYLAAEVLELAGNAARDNKKSRIIPRHLLLAVRNDEELGKLLAGVTIAHGGVIPNINPVLLPKKSDKVAEKAPKSPSKAAKSPRKA

SEQ ID NO: 7504 - protein, 150 aa, Triphysaria pusilla
METGGKAKKGAAGRKAGGPKKKSVSRSVKAGLQFPVGRIGRFLKKGRYAQRVGSGAPVYLAAVLEYLAAEVLELAGNAARDNKKSRIIPRHLLLAVRNDEELGKLLAGVTIAHGGVIPNINPVLLPKKSDKVAEKAPKSPSKATKSPRKA

SEQ ID NO: 7505 - protein, 151 aa, Artemisia annua
METGGKKKGAAGRKGPSGPRKKSVTRSVKAGLQFPVGRIGRYLKNGRYAKRVGTGAPVYLAAVLEYLAAEVLELAGNAARDNKKSRIIPRHVLLAIRNDDELGKLLSGVTIAHGGVLPNINPVLLPKKSATKESTPKSPAKAAKSPKKAAA

SEQ ID NO: 7506 - protein, 151 aa, Artemisia annua
MEGTGKIKKGAAGRKAGGPRKKSVTRSVKAGLQFPVGRIGRYLKKGRYAKRVGTGAPVYLAAVLEYLAAEVLELAGNAARDNKKTRIIPRHVLLAIRNDEELGKLLSGVTIAHGGVLPNINPVLLPKKTAAKESTPKSPSKVGKSPKKTAA

SEQ ID NO: 7507 - protein, 151 aa, Artemisia annua
MEGTGKIKKGVAGRKAGGPRKKSVTRSVKAGLQFPVGRIGRYLKKGRYAKRVGTGAPVYLAAVLEYLAAEVLELAGNAARDNKKTRIIPRHVLLAIRNDEELGKLLSGVTIAHGGVLPNINPVLLPKKTAAKESTPKSPSKVGKSPKKAAA

SEQ ID NO: 7508 - protein, 151 aa, Artemisia annua
METGGKKKGAAGRKGPAGPRKKSVTRSVKAGLQFPVGRIGRYLKNGRYAKRVGTGAPVYLAAVLEYLAAEVLELAGNAARDNKKSRIIPRHVLLAIRNDDELGKLLSGVTIAHGGVLPNINPVLLPKKSATKESTPKSPAKAAKSPKKAAA

SEQ ID NO: 7509 - protein, 163 aa, Oryza sativa
MEVGAKVPKKAGAGGRRGGGGPKKKPVSRSVKAGLQFPVGRIGRYLKQGRYSQRIGTGAPVYLAAVLEYLAAEVLELAGNAARDNKKNRIIPRHVLLAIRNDEELGKLLAGVTIAHGGVLPNINPVLLPKKTGSAAAKEAKEGKTPKSPKKATTKSPKKAAAA

SEQ ID NO: 7510 - protein, 151 aa, Gerbera hybrid cultivar
MDAGTKVKKGAAGRKAGGPKKKPVSRSVKAGLQFPVGRIGRYLKKGRYAQRVGTGAPVYLAAVLEYLAAEVLELAGNAARDNKKNRIIPRHVLLAVRNDEELGKLLAGVTIAHGGVIPNINPVLLPKKAHDKATKEPAKSPSKATKSPKKG

SEQ ID NO: 7511 - protein, 149 aa, Camellia sinensis
MDAAKVKKGAAGRKGGGPKKKPVSRSVKAGLQFPVGRIGRYLKKGRYSQRVGTGAPVYLAAVLEYLAAEVLELAGNAARDNKKNRIIPRHVLLAVRNDEELGKLLAGVTIAHGGVLPNINPVLLPKKSDKATKEPKSPSRATKSPKKAA

SEQ ID NO: 7512 - protein, 151 aa, Cynara scolymus
METGGKLKKGAAGRKAGGPKKKPVTRSVKAGLQFPVGRIGRYLKKGRYSKRVGTGAPVYLAAVLEYLAAEVLELAGNAARDNKKNRIIPRHVLLAVRNDDELGKLLAGVTIAHGGVLPNINPVLLPKKSHDKATKEPAKSPSKSTKSPKKA

SEQ ID NO: 7513 - protein, 154 aa, Raphanus sativus
MDSGAKVKKGAGAGGRRGGGPKKKPVSRSVKAGLQFPVGRIGRYLKKGRYSKRVGTGAPVYLAAVLEYLAAEVLELAGNAARDNKKNRIIPRHVLLAVRNDDELGKLLKGVTIAHGGVLPNINPVLLPKKSEKAASTTKGTKSPSKATKSPKKA

SEQ ID NO: 7514 - protein, 151 aa, Carthamus tinctorius
METGGKLKKGAAGRKAGGPKKKPVTRSVKAGLQFPVGRIGRYLKKGRYSKRVGTGAPVYLAAVLEYLAAEVLELAGNAARDNKKNRIIPRHVLLAVRNDDELGKLLSGVTIAHGGVLPNINPVLLPKKSHEKATKEPAKSPSKSTKSPKKA

SEQ ID NO: 7515 - protein, 144 aa, Helianthus annuus
MEAKKGAGGRKAGGPKKKPVSRSVKAGLQFPVGRLGRYLKKGRYAQRVGTGAPVYLAAVLEYLAAEVLELAGNAARDNKKNRIIPRHVLLAVRNDEELGKLLAGVTIAHGGVLPNINPVLLPKKAAAKEATKSPAKVTKSPKKA

SEQ ID NO: 7516 - protein, 145 aa, Nicotiana tabacum
MEKKGAGGRKGGGPKKKAVSRSVKAGLQFPVGRIGRYLKKGRYAQRVGSGAPVYLSAVLEYLAAEVLELAGNAARDNKKTRIIPRHVLLAVRNDEELGKLLAGVTIAHGGVLPNINPVLLPKKSDKVGKEPAKSPSKATKSPKKA

SEQ ID NO: 7517 - protein, 145 aa, Nicotiana tabacum
MEKKGAGGRKGGGPKKKAVSRSVKAGLQFPVGRIGRYLKKGRYAQRVGSGAPVYLSAVLEYLAAEVLELAGNAARDNKKTRIIPRHVLLAVRNDEELGKLLAGVTIAHGGVLPNINPVLLPKKSDKVGKEPTKSPTKATKSPKKA

SEQ ID NO: 7518 - protein, 729 aa, Zea mays
MSGWDEGAVFYSDQAQFPRGGPGGDPAADLTRHSALRKFKEFLRGFTGPTGDFPYRESLVHNRDHVTVATEDLDAFDAELSDKIRKSPADYLPLFETAASEVLASLRSKVAGETGEMEEPVPGDVQIFLSSKENCLSMRSVGADYMSKLVKIAGITIAASRVKAKATHVTLICKNCRSVRTVPCRPGLGGAIVPRSCDHVPQPGEEPCPLDPWIAVPDKSKYVDLQTLKLQENPEDVPTGELPRNMLLSVDRHLVQTIVPGTRLTVVGIYSVYQASTTQKGAVGVKQPYIRVVGLEQSRDNNSNGPSNFTLDEEMEFKEFAQRPDAYAKLCSMIGPSIYGHSDVKKAIACLLFGGSKKRLPDGVRLRGDIHVLLLGDPSTAKSQFLKFVEKTAPIAVYTSGKGSSAAGLTASVTRDSSSREFYLEGGAMVLADGGVVCIDEFDKMRPEDRVAIHEAMEQQTISIAKAGITTVLNSRTSVLAAANPIAGRYDDLKTAQDNIDLQTTILSRFDLIFIVKDIRMYDQDKRIASHIIKVHASGAAASSANTEGSEGENWLKRYIQYCRATCKPRLSEKAAEMLQNKYIEIRQKMRQQAHETGRAAAIPITVRQLEAIIRLSESLAKMRLTSVATPEHVEEAFRLFNVSTVDAARSGINEHLNLSPEIANEIKQAEAQIKRRMGIGSHISERRLIDGLNRMGMNESIVRRALLIMHQRDEVEYKRERHVIVRKA

SEQ ID NO: 7519 - protein, 742 aa, Zea mays
MSGWDEGAVFYSDQAQFPRGGPGGDPAADLTRHSALRKFKEFLRGFTGPTGDFPYRESLVHNRDHVTVAIEDLDAFDAELSDKIRKSPADYLPLFETAAAEVLASLRSKVAGETGEMEEPVTGDVQIFLSSKENCLSMRSVGADYMSKLVKIAGIAIAASRVKAKATHVTLICKNCRSVRTVPCRPGLGGAIVPRSCDHVPQPGEEPCPLDPWIAVPDKSKYVDLQTLKLQENPEDVPTGELPRNVLLSVDRHLVQTIVPGTRLTVVGIYSVYQASTTQKGAVGVKQPYIRVVGLEQSRDNNSNGPSNFTLDEEMEFKEFAQRPDAYAKLCSMIGPSIYGHSDVKKAIACLLFGGSKKAQILIKPLICRLPDGVRLRGDIHVLLLGDPSTAKSQASTFLKFVEKTAPIAVYTSGKGSSAAGLTASVTRDSSSREFYLEGGAMVLADGGVVCIDEFDKMRPEDRVAIHEAMEQQTISIAKAGITTVLNSRTSVLAAANPIAGRYDDLKTAQDNIDLQTTILSRFDLIFIVKDIRMYDQDKRIASHIIKVHASGAAASSTNTEGSEGENWLKRYIEYCRATCKPRLSEKAAEMLQNKYIEIRQKMRQQAHETGRAAAIPITVRQLEAIIRLSESLAKMRLTSVATPEHVEEAFRLFNVSTVDAARSGINEHLNLSPEIANEIKQAEAQIKRRMGIGSHISERRLIDELNRMGMNESIVRRALLIMHQRDEVEYKRERHVIVRKA

SEQ ID NO: 7520 - protein, 729 aa, Oryza sativa
MSGWDEGAVFYSDQAQFPRGGPGGDPSADLTRHSALRKFKEFLRGFTGPTGDFPYRESLVHNRDHVTVAIEDLDAFDAELSDKIRKSPADYLPLFETAASEVLASLRSKVAGETGEMEEPATGDVQIFLSSKENCLSMRSIGADYMSKLVKIAGITIAASRVKAKATHVTLLCKNCRSVKTVPCRPGLGGAIVPRSCDHVPQPGEEPCPLDPWIAVPDKSKYVDLQTLKLQENPEDVPTGELPRNMLLSVDRHLVQTIVPGTRLTVIGIYSVYQASANQKGAVGVKQPYIRVVGLEQSRDANSNGPSNFTLDEEMEFKEFAQRPDAYVKICSMIGPSIYGHSDVKKAIACLLFGGSKKRLPDGVRLRGDIHVLLLGDPSTAKSQFLKFVEKTAPIAVYTSGKGSSAAGLTASVIRDGSSREFYLEGGAMVLADGGVVCIDEFDKMRPEDRVAIHEAMEQQTISIAKAGITTVLNSRTSVLAAANPIAGRYDDLKTAQDNIDLQTTILSRFDLIFIVKDVRMYDQDKRIASHIIKVHASGAAASSKNTDASEGENWLKRYIEYCRVTCKPRLSEKAAEMLQNKYVEIRQKMRQQAHETGRAAAIPITVRQLEAIIRLSESLAKMRLTSVATPEHVEEAFRLFNVSTVDAARSGINEHLNLSPDIANEIKQAEAQIKRRMGIGSHISERRLIDELNRMGMNESIVRRALLIMHQRDEVEYKRERHVIVRKA

SEQ ID NO: 7521 - protein, 733 aa, Brachypodium distachyon
MSGWDEGAVFYSDQAQFPRGGDPGGAEITRHSALRKFKEFLRGFTGPTGDFPYRESLVHNRDHVTVAIEDLDAFDAELADKIRKAPADYLPLFETAGSEVLASLRSKVAGETGEMEEPVTGDVQIFLSSKENCLSMRSIGADYMSKLVKIAGIAIAASRVKAKATHVTLICKNCRTVRTVPCRPGLGGAIVPRSCDHLPQPGEEPCPLDPWIAVPDKSKYVDLQTLKLQENPEDVPTGELPRNVLLSVDRHLVQTIVPGTRLTVVGIYSVFQASGTANHKGAVGVKQPYIRIVGLEQSRDDNSNGPSNFTLDEEMEFKEFAQRPDAYAKICSMIGPSIYGHSDVKKAIACLLFGGSKKRLPDGVRLRGDIHALLLGDPSTAKSQFLKFVEKTAPIAVYTSGKGSSAAGLTASVTRDSNSREFYLEGGAMVLADGGVVCIDEFDKMRPEDRVAIHEAMEQQTISIAKAGITTVLNSRTSVLAAANPISGRYDDLKTAQDNIDLQTTILSRFDLIFIVKDVRMYEQDKRIANHIIKVHASGAATTSKNMEMDANTNEGENWLKRYIEYCRNTCRPRLSEKAAEMLQNKYVEIRQKMRQQSHETGRAAAIPITVRQLEAIIRLSESLAKMRLTSVATPEHIEEAFRLFNVSTVDAARSGINEHLNLSPEIANEIKQAEAQIKRRMGIGSHISERRLLDELNRMGMNESIVRRALVIMHQRDEVEYKRERHVIVRKA

SEQ ID NO: 7522 - protein, 729 aa, Triticum aestivum
MSGWDEGAVFYSDQAQFPQGDPAAADITRHSALRKFKEFLRGFTGPTGDFPYRESLVHNRDHVTVAIEDLDAFDAELADRIRKAPADYLPLFETAGSEVLASLRSKVAGETGEMEEPVTGDVQIFLSSKENCVSMRSIGADYMSKLVKIAGIAIAASRVKAKATHVTLLCKNCRSVRTVPCRPGLGGAIVPRSCDHVPQPGEEPCPLDPWIAVPDKSKYVDLQTLKLQENPEDVPTGELPRNVLLSVDRHLVQTIVPGTRLTVIGIYSVFQASGTNNQKGAVGVKQPYIRIVGLEQSRDDNTNGPSHFTLDEEMEFKEFAQRPDAYAKICSMIGPSIYGHGDVKKAIACLLFGGSKKRLPDGVRLRGDIHALLLGDPSTAKSQFLKFVEKTAPIAVYTSGKGSSAAGLTASVTRDSNSREFYLEGGAMVLADGGVVCIDEFDKMRPEDRVAIHEAMEQQTISIAKAGITTVLNSRTSVLAAANPISGRYDDLKTAQDNIDLQTTILSRFDLIFIVKDVRMYEQDKRIANHIIKVHASGAATQANKNTNANEGENWLKRYVEYCRNTCRPRLSEKAAEMLQNKYVEIRQKMRQQSHETGRAAAIPITVRQLEAIIRLSESLAKMRLTSVATPEHIEEAFRLFNVSTVDAARSGINEHLNLSPEIANEIKQAEAQIKRRMGIGSHISERRLLDELNRMGMNESIVRRALVIMHQRDEVEYKRERHVIVRKA

SEQ ID NO: 7523 - protein, 736 aa, Brachypodium distachyon
MSGWDEGAVFYSDQAQFPRGGDPGGAEITRHSALRKFKEFLRGFTGPTGDFPYRESLVHNRDHVTVAIEDLDAFDAELADKIRKAPADYLPLFETAGSEVLASLRSKVAGETGEMEEPVTGDVQIFLSSKENCLSMRSIGADYMSKLVKIAGIAIAASRVKAKATHVTLICKNCRTVRTVPCRPGLGGAIVPRSCDHLPQPGEEPCPLDPWIAVPDKSKYVDLQTLKLQENPEDVPTGELPRNVLLSVDRHLVQTIVPGTRLTVVGIYSVFQASGTANHKGAVGVKQPYIRIVGLEQSRDDNSNGPSNFTLDEEMEFKEFAQRPDAYAKICSMIGPSIYGHSDVKKAIACLLFGGSKKRLPDGVRLRGDIHALLLGDPSTAKSQASIFLKFVEKTAPIAVYTSGKGSSAAGLTASVTRDSNSREFYLEGGAMVLADGGVVCIDEFDKMRPEDRVAIHEAMEQQTISIAKAGITTVLNSRTSVLAAANPISGRYDDLKTAQDNIDLQTTILSRFDLIFIVKDVRMYEQDKRIANHIIKVHASGAATTSKNMEMDANTNEGENWLKRYIEYCRNTCRPRLSEKAAEMLQNKYVEIRQKMRQQSHETGRAAAIPITVRQLEAIIRLSESLAKMRLTSVATPEHIEEAFRLFNVSTVDAARSGINEHLNLSPEIANEIKQAEAQIKRRMGIGSHISERRLLDELNRMGMNESIVRRALVIMHQRDEVEYKRERHVIVRKA

SEQ ID NO: 7524 - protein, 729 aa, Hordeum vulgare
MSGWDEGAVFYSDQAQFPQGDPAAADITRHSALRKFKEFLRGFTGPTGDFPYRESLVHNRDHVTVAIEDLDAFDAELADRIRKAPADYLPLFETAGSEVLASLRSKVAGETGEMEEPVTGDVQIFLSSKENCVSMRSIGADYMSKLVKIAGIAIAASRVKAKATHVTLLCKNCRSVRTVPCRPGLGGAIVPRSCDHVPQPGEEPCPLDPWIAVPDKSKYVDLQTLKLQENPEDVPTGELPRNVLLSVDRHLVQTIVPGTRLTVVGIYSVFQASGTNNQKGAVGVKQPYIRIVGLEQSRDDNTNGPSHFTLDEEMEFKEFAQRPDAYSKICSMIGPSIYGHGDVKKAIACLLFGGSKKRLPDGARLRGDIHALLLGDPSTAKSQFLKFVEKTAPIAVYTSGKGSSAAGLTASVTRDSNSREFYLEGGAMVLADGGVVCIDEFDKMRPEDRVAIHEAMEQQTISIAKAGITTVLNSRTSVLAAANPISGRYDDLKTAQDNIDLQTTILSRFDLIFIVKDVRMYEQDKRIANHIIKVHASGAATQANKNADVNEGENWLKRYVEYCRNTCRPRLSEKAAEMLQNKYVEIRQKMRQQSHETGRAAAIPITVRQLEAIIRLSESLAKMRLTSVATPEHIEEAFRLFNVSTVDAARSGINEHLNLSPEIANEIKQAEAQIKRRMGIGSHISERRLLDELNRMGMNESIVRRALVIMHQRDEVEYKRERHVIVRKA

SEQ ID NO: 7525 - protein, 673 aa, Hordeum vulgare
RASCTTATMSPSPSRTFDAELADRIRKAPADYLPLFETAGSEVLASLRSKVAGETGEMEEPVTGDVQIFLSSKENCVSMRSIGADYMSKLVKIAGIAIAASRVKAKATHVTLLCKNCRSVRTVPCRPGLGGAIVPRSCDHVPQPGEEPCPLDPWIAVPDKSKYVDLQTLKLQENPEDVPTGELPRNVLLSVDRHLVQTIVPGTRLTVVGIYSVFQASGTNNQKGAVGVKQPYIRIVGLEQSRDDNTNGPSHFTLDEEMEFKEFAQRPDAYSKICSMIGPSIYGHGDVKKAIACLLFGGSKKRLPDGARLRGDIHALLLGDPSTAKSQFLKFVEKTAPIAVYTSGKGSSAAGLTASVTRDSNSREFYLEGGAMVLADGGVVCIDEFDKMRPEDRVAIHEAMEQQTISIAKAGITTVLNSRTSVLAAANPISGRYDDLKTAQDNIDLQTTILSRFDLIFIVKDVRMYEQDKRIANHIIKVHASGAATQANKNADVNEGENWLKRYVEYCRNTCRPRLSEKAAEMLQNKYVEIRQKMRQQSHETGRAAAIPITVRQLEAIIRLSESLAKMRLTSVATPEHIEEAFRLFNVSTVDAARSGINEHLNLSPEIANEIKQAEAQIKRRMGIGSHISERRLLDELNRMGMNESIVRRALVIMHQRDEVEYKRERHVIVRKA

SEQ ID NO: 7526 - protein, 334 aa, Panicum virgatum
MSGGGQDLHLPPGFRFHPTDEELVMHYLCRRCAGLPIAVPIIAEIDLYKFDPWQLPRMAQYGEKEWYFFSPRDRKYPNGSRPNRTAGSGYWKATGADKPVGTPKPLAIKKALVFYAGKAPKGEKTNWIMHEYRLADVDRSARKKNSLRLDDWVLCRIYKKKGGLEKPPVGAGDRKPALAAAAGSPPEQKPFVAAPGRAAPRVRGPGGVLRPAVGLDAAAARGLELLGAGAVPGAAVRLRPGGAEPAQDQRVGAHLLLRPREPRRLHARPRRRRPAAAGHPHVLGQAVLEVTYAREPRERQSVAQPHPGVRLVGLPLSRRRNRRGVGLTQASRHS

SEQ ID NO: 7527 - protein, 289 aa, Panicum virgatum
MSGGGQDLHLPPGFRFHPTDEELVMHYLCRRCAGLPIAVPIVAEIDLYKFDPWQLPRMALYGEKEWYFFSPRDRKYPNGSRPNRAAGSGYWKATGADKPVGTPKPLAIKKALVFYAGKAPKGEKTNWIMHEYRLADVDRTARKKNSLRLDDWVLCRIYNKKGGLEKPPVAAGDRKPALAAAAGSPPEQKPFVAAPGGLPPAFADLAAYYDRPSDSMPRLHADSSCSELVLSPEQQLACDREVQSQPKINEWERTFASDPVNPAGHGGAGAGLGGDPLLQDILMYWGKPF

SEQ ID NO: 7528 - protein, 300 aa, Pseudoroegneria spicata
MSGGGGGSAATQGQQDLQLPPGFRFHPTDEELVMHYLCRRCAGLPISVPIIAEVDLYKFDPWQLPRMALYGEKEWYFFSPRDRKYPNGSRPNRSAGTGYWKATGADKPVGTPKPLAIKKALVFYAGKAPKGDKTNWIMHEYRLADVDRSARKKNSLRLDDWVLCRIYNKKGASERPSTGDRTARSSPGHAAVGSPPEQKPALLPPYAPQPFSDLAAYYEVRPSDSMPRAHADSSCSEHVLTASCERPEVQSQPKISEWERTFASATPGVNPAGSMLDPSAGLPAGDPLLQDILMYWGKPF

SEQ ID NO: 7529 - protein, 304 aa, Leymus cinereus x Leymus triticoides
MSGGQELHLPPGFRFHPTDEELVMHYLCRRCAGAPIAVPIIAEIDLYKFDPWQLPKMALYGEKEWYFFSPRDRKYPNGSRPNRAAGSGYWKATGADKPVGTPKPLAIKKALVFYAGKAPKGEKTNWIMHEYRLADVDRSASARKKNSLRLDDWVLCRIYNKKGGMEKPASADRKPATVGGYGGGPGAMVSSPPEQKPVMGMNTNGGGGGQPFPDFAAYYDRPSDSMPRLHADSSCSEQVLSPDYPGERGGGEVQSQPKISEWERSFATGGDPVNPAAGSILEPHGGFGGDTLLQDMLMYWGKPF

SEQ ID NO: 7530 - protein, 609 aa, Zea mays
METLLAGNPANGVAKPTCNGVGALPVANSHAIIATPPAAATLAPAGATLGRHLARRLVQIGASDVFAVPGDFNLTLLDYLIAEPGLTLVGCCNELNAGYAADGYARSRGVGACAVTFTVGGLSVLNAIAGAYSENLPVVCIVGGPNSNDYGTNRILHHTIGLPDFSQELRCFQTITCYQAIINNLDDAHEQIDTAIATALRESKPVYISVSCNLAGLSHPTFSRDPVPMFISPRLSNKANLEYAVEAAADFLNKAVKPVMVGGPKIRVAKAREAFAAVADASGYPFAVMPAAKGLVPEHHPRFIGTYWGAVSTTFCAEIVESADAYLFAGPIFNDYSSVGYSLLLKREKAVIVQPDRMVVGDGPAFGCILMPEFLRALAKRLRRNTTAYDNYRRIFVPDREPPNGKPNEPLRVNVLFKHIKGMLSGDSAVVAETGDSWFNCQKLRLPEGCGYEFQMQYGSIGWSVGATLGYAQAAKDKRVIACIGDGSFQVTAQDVSTMLRCGQKSIIFLINNGGYTIEVEIHDGPYNVIKNWDYTGLVNAIHNSEGNCWTMKVRTEEQLKEAIATATGAKKDCLCFIEVIVHKDDTSKELLEWGSRVSAANSRPPNPQ

SEQ ID NO: 7531 - protein, 605 aa, Oryza sativa
MELALVGNPSNGVAKPSCNSVGSLPVVSSNAVINPPVTSAAGATLGRHLARRLVQIGATDVFAVPGDFNLTLLDYLIAEPGLKLIGCCNELNAGYAADGYARARGVGACAVTFTVGGLSVLNAIAGAYSENLPVICIVGGPNSNDYGTNRILHHTIGLPDFSQELRCFQTITCYQAVINNLDDAHEQIDTAIATALRESKPVYISVGCNLAGLSHPTFSREPVPLFISPRLSNKANLEYAVEAAADFLNKAVKPVMVGGPKIRVAKAKKAFAGIAESSGYPFAVMPSAKGLVPEHHPRFIGTYWGAVSTTFCAEIVESADAYLFAGPIFNDYSSVGYSLLLKREKAVIVQPDRVVVGNGPAFGCILMTEFLDALAKRLDRNTTAYDNYRRIFIPDREPPNGQPDEPLRVNILFKHIKEMLSGDTAVIAETGDSWFNCQKLRLPEGCGYEFQMQYGSIGWSVGATLGYAQAAKDKRVISCIGDGSFQMTAQDVSTMLRCGQKSIIFLINNGGYTIEVEIHDGPYNVIKNWDYTGLIDAIHNSDGNCWTKKVRTEEELIEAIATATGAKKDCLCFIEIIVHKDDTSKELLEWGSRVSAANSRPPNPQ

SEQ ID NO: 7532 - protein, 603 aa, Medicago truncatula
METMLGSLDIAKPTSNDVVSCKQQNSTATIQPSTAIATSDATLGRHLARRLVQVGVTDVFSVPGDFNLTLLDHLINEPELNLIGCCNELNAGYAADGYARSRGVGACVVTFTVGGLSVLNAIAGAYSENLPLICIVGGPNSNDYGTSRILHHTIGVPDFSQELRCFQTVTCFQAVVNNLEDAHELIDTAISTALKESKPVYISIGCNLPGIPHPTFSRDPVPFSLAPKLSNHMGLEAAVEAAAEFLNKAVKPVLVGGPKLRVAKASDAFVELADASGYALAVMPSAKGMVPEHHPHFIGTYWGAVSTAFCAEIVESADAYLFAGPIFNDYSSVGYSLLLKKEKAIIVQPDRVVVANGPAFGCILMKDFLKALAKRLKHNNAAYENYHRIFVPDGKPLKSAPKEPLRVNVMFQHIQQMLSRETAVIAETGDSWFNCQKLKLPEGCGYEFQMQYGSIGWSVGATLGYAQAVPEKRVIACIGDGSFQVTAQDVSTMLRCGQKTIIFLINNGGYTIEVEIHDGPYNVIKNWNYTGLIDAIHNGEGKCWTTKVFCEEELVEAIATATGPKKDSLCFIEVIVHKDDTSKELLEWGSRVSAANSRPPNPQ

SEQ ID NO: 7533 - protein, 605 aa, Mimulus guttatus
MDTKIGSLDTCASPTCTEVGSLPSNGAVSTIQCSAVAINSAEATLGRHLARRLVQIGVSDVFSVPGDFNLTLLDHLIAEPGLNLIGCCNELNAGYAADGYARSRGVGACVVTFTVGGLSVINAIAGAYSENLPVICIVGGPNSNDYGTNRILHHTIGLPDFSQELRCFQTVTCYQAVVNNLEDAHELIDTAISTALKESKPVYISIGCNLPAIPHPTFSREPVPFALSPKLTNKMGLEAAVEATVEFLNKAVKPVLVGGPKLRVAKACNAFVELADACGYALAVMPSAKGLVPEHHPRFIGTYWGAVSTAFCAEIVESADAYLFAGPIFNDYSSVGYSLLLKKEKAIIVQPDRVIIGNGPAFGCILMKDFLTALAKRLNRNTTAYENYHRIYVPEGHPLKSEPKEALRVNVLFQHIQKMLSAETAVIAETGDSWFNCQKLKLPQGCGYEFQMQYGSIGWSVGATLGYAQAVPEKRVIACIGDGSFQVTVQDVSTMLRCGQKTIIFLINNCGYTIEVEIHDGPYNVIKNWNYTALVDAIHNGEGNCWTTKVRCEEELIEAIETATGAKKDCLCFIEVIVHKDDTSKELLEWGSRVSAANGRPPNPQ

SEQ ID NO: 7534 - protein, 607 aa, Glycine max
MDTRIGSLDAAKPACNDVVSCNHTTSAAIQPCVPATVINGAGGDSTLGGHLARRLVEIGVTDVFSVPGDFNLTLLDHLIAEPALNLVGCCNELNAGYAADGYARARGVGACVVTFTVGGLSVLNAIAGAYSENLPLICIVGGPNSNDYGTSRILHHTIGLPDFSQELRCFQTITCFQAVVNNLEDAHELIDTAISTALKESKPVYISISCNLPGIPHPTFSRDPVPFSLSPRLSNKMGLEAAVEAAAEFLNKAVKPVLVGGPKLRVATASDAFVELADACGYALAVMPSAKGQVPEHHPHFIGTYWGAVSTAFCAEIVESADAYLFAGPIFNDYSSVGYSLLLKKEKAIIVQPDRVVIANGPAFGCVLMKDFLKALAKRLKHNNTAYENYHRIFVPEGHPLKATPREPLRVNVLFQHIQKMLSGETAVIAETGDSWFNCQKLKLPKGCGYEFQMQYGSIGWSVGATLGYAQAVPEKRVIACIGDGSFQVTAQDVSTMLRCGQKTIIFLVNNGGYTIEVEIHDGPYNVIKNWNYTGLIDAIHNGEGKCWTAKVFCEEELVEAIATATGHKRDSLCFIEVIVHKDDTSKELLEWGSRVSAANSRPPNPQ

SEQ ID NO: 7535 - protein, 605 aa, Manihot esculenta
MDSKIGSIDTCKPTNGDMCSPANGTVSTIQTSVPPAVINSHESTLGRHLARRLVQIGISDVFSVPGDFNLTLLDHLIAEPGLNLIGCCNELNAGYAADGYARSRGVGACVVTFTVGGLSVLNAIAGAYSENLPLICIVGGPNSNDYGTNRILHHTIGLPDFSQELRCFQTVTCFQAVVNNLEDAHEQIDTAISTALKESKPVYLSISCNLPAIPHPTFSRDPVPFSISPRSSNQMGLEAAVEAAAEFLNKAVKPVLVGGPKLRVAKACNSFVELADATGYALAVMPSAKGLVPEFHPHFIGTYWGAVSTAFCAEIVESADAYLFAGPIFNDYSSVGYSLLLKKEKAIIVQPDRVVIGNGPAFGCVQMKDFLHALAKRLKPNTTAHENYRRIFVPEGHPLKSEPKEPLRVNILFPHIQNLLSGETAVIAETGDSWFNCQKLKLPKGCGYEFQMQYGSIGWSVGATLGYAQAVPEKRVIACIGDGSFQVTAQDVSTMLRCGQKSIIFLINNGGYTIEVEIHDGPYNVIKNWNYTGLIDAIHNGEGKCWTAKVHCEEELIEAIDAATGPKKDCLCFIEVIVHKDDTSKELLEWGSRVSAANSRPPNPQ

SEQ ID NO: 7536 - protein, 605 aa, Malus domestica
MDTKIGSLDVCKPACTDVGSLPNGAASAIQSSAPSTVINSCDATLGRHLARRLVQIGVTDVFTVPGDFNLTLLDHLIAEPGLTNIGCCNELNAGYAADGYARSRGVGACVVTFTVGGLSVLNAIAGAYSENLPLICIVGGPNSNDYGTNRILHHTIGLPDFSQELRCFQTVTCYQAVVNNLEDAHEMIDTAISTALKESKPVYISISCNLAGIPHPTFSRDPVPFSLSPKLSNNLGLEAAVEAAAEFLNKAVKPVMVGGPKLRVAHAGDAFVELADASGYALAVMPSAKGFVPEHHPHFIGTYWGAVSTAFCAEIVESADAYLFAGPIFNDYSSVGYSLLIKKEKAIVVQPDRVTIANGPSFGCVLMKDFLRALAKKLRHNNTAHENYRRIFVPDGHPLKSAPKEPLRVNVLFHHIQNMLSSETAVIAETGDSWFNCQKLKLPADCGYEFQMQYGSIGWSVGATLGYAQAVPQKRVIAFIGDGSFQVTAQDVSTMIRNGQKTIIFLINNGGYTIEVEIHDGPYNVIKNWNYTGLVDAIHNGEGKCWTTKVRCEEELIEAIETATGAKKDSLCFIEVIVHKDDTSKELLEWGSRVSAANSRPPNPQ

SEQ ID NO: 7537 - protein, 606 aa, Actinidia deliciosa
MDSKIGALDVCKPPCNDVGSIPHNDVVSTLQSSPASTALNSAESTLGRHLARRLVQIGATDVFSVPGDFNLTLLDHLIAEPGLNLIGCCNELNAGYAADGFARSRGVGACVVTFTVGGLSVLNAVAGAYSENLPVICIVGGPNSNDYGTNRILHHTIGLPDFSQELRCFQTVTCFQAVVNNLEDAHELIDTAISTALKECKPVYISISCNLPGLPHPTFCREPVPFVISPRLSNHMGLEAAVEAAAEFLNKAVKPVMVGGPKLRVANASEAFVELADACGYALAVMPSAKGLVPENHPHFIGTYWGAVSTGFCAEIVESADAYLFAGPIFNDYSSVGYSLLLKKDKAIIVQPDRVMIANGPAFGCVLMRDFLGALVKRLKQNTTAYENYHRIYVPEGHPLKCEPKEALRVNVLFQHIQKMLSSETAVIAETGDSWFNCQKLKLPPGCGYEFQMQYGSIGWSVGATLGYAQAAKNKRVIACIGDGSFQVTAQDVSTMLRCGQKTIIFLINNGGYTIEVEIHDGPYNVIKNWNYTGLVDAIHNGEGKCWTTKVHCEEELIEAIGTATGAKKDCLCFIEVIVHKDDTSKELLEWGSRVAAANGRPPNPQ

SEQ ID NO: 7538 - protein, 608 aa, Glycine max
MDTKIGSLDAPKPNSNDVVSCNLTSSAAIQPCLPATVINGAGCSDSTLGGHLARRLVEIGVTDVFSVPGDFNLTLLDHLIAEPALHLVGCCNELNAGYAADGYARARGVGACVVTFTVGGLSVLNAIAGAYSENLPLICIVGGPNSNDYGTSRILHHTIGLPDFSQELRCFQTITCFQAVVNNLEDAHELIDTAISTALKESKPVYISISCNLPGIPHPTFSRDPVRFSLSPRLSNKMGLEAAVEAAAEFLNKAVKPVLVGGPKLRVATASDAFVELADACGYALAVMPSAKGQVPEHHPHFIGTYWGAVSTAFCAEIVESADAYLFAGPIFNDYSSVGYSLLLKKEKAIIVQPDRVVIANGPAFGCVLMKDFLKALAKRLKHNNTAYENYHRIFVPDGHPLKAAPREPLRVNVLFQHIQNMLSGETAVIAETGDSWFNCQKLKLPKACGYEFQMQYGSIGWSVGATLGYAQAVPEKRVIACIGDGSFQVTAQDVSTMLRCGQKTIIFLINNGGYTIEVEIHDGPYNVIKNWNYTGLIDAIHNGEGKCWTAKVFCEEELVEAIATATGPKKDSLCFIEVIVHKDDTSKELLEWGSRVSAANSRPPNPQ

SEQ ID NO: 7539 - protein, 603 aa, Nicotiana tabacum
MDAKIGAIDTCKPANNDVGSLPTTNSVTIHTPTVPFNSPDSTLGRHLARRLVQVGVTDVFGVPGDFNLTLLDHLIAEPGLKFIGCCNELNAGYAADGYARARGVGACVVTFTVGGLSVLNAIAGAYSENLPLICIVGGPNSNDYGTNRILHHTIGLPDFSQELRCFQTVTCYQAVVNNLEDAHELIDTAISTALKESKPVYISIGCNLPGIPHPTFSREPVPFCLSPRLSNQMGLEAAVEAAAEFLNKAVKPVVVGGPKLRVAKASEAFVELADASGYAVAVMPSAKGLVPEHHPHFIGTYWGAVSTAFCAEIVESADAYLFAGPIFNDYSSVGYSLLLKKEKAIIVQPDRVTIANGPAFGCVLMKDFLAALAKRLKHNPTAYENYRRIYVPEGHPLKCEPKEALRVNVLFEHIQRMLSGDTAVIAETGDSWFNCQKLKLPKGCGYEFQMQYGSIGWSVGATLGYAQAAREKRVIAFIGDGSFQVTAQDISTMLRCGQRTIIFLINNGGYTIEVEIHDGPYNVIKNWNYTGLVDAIHNGEGKCWTTKVHCEEELVEAIETATEAKKDCLCFIEVIVHKDDTSKELLEWGSRVSAANSRPPNPQ

SEQ ID NO: 7540 - protein, 606 aa, Tropaeolum majus
MDTKIGSFDVCKPTSNDVGSIPNGTVSTVQDSSVSPTAISSSESTLGRHLARRLTQIGVTDIFTVPGDFNLTLLDHLIAEPGLTNVGCCNELNAGYAADGYARSRGVGACVVTFTVGGLSVLNAIAGAYSENLPLICIVGGPNSNDYGTNRILHHTIGLPDFSQELRCFQTVTCYQAVVNNLEDAHESIDTAISTALKESKPVYISISCNLPGIPHPTFSQEPVPFNLSPKLSNKMGLEVAVEAAADFLNKAVKPVMVGGSKLRVAKAADAFVELADASGYPVAVMPAAKGMVPEHHPHFIGTYWGAVSTAFCAEIVESADAYLFAGPIFNDYSSVGYSLLLKKEKAIVVQPDRVVIGNGPTFGCILMKDFLRALSKRLKRNTTAYDNYHRIYVPEGKPLKCEPKEPLRVNVMFQHIQNMLSSNSAVIAETGDSWFNCQKLKLPKGCGYEFQMQYGSIGWSVGATLGYAQAVPEKRVIACIGDGSFQVTAQDVSTMLRCGQKTIIFLINNGGYTIEVEIHDGPYNVIKNWNYTALVEAIHNGNGNCWTAKVFCEEELIEAIATATGPKKDSLCFIEVIVHKDDTSKELLEWGSRVSAANSRPPNPQ

SEQ ID NO: 7541 - protein, 505 aa, Saccharum officinarum
MERLLAGLLGFLLIASVGSHAARAPDQYWKSALPDTPMPTSLSQLLNTPAGGGTTVNVGWGGVHVDAGHGKPGGTTVDVGHGGVGVNVNPGSSGKKPGGTTVDVGGKGGVGVKVNPGYGKPGGTTVGVGKGGVGVNVNPGYGKPGGTTVGVGKGGVGVNVNPGKPGGSGTTVGVGKGGVGVNVNPGYGKPGGTTVGVGNGGVGVNVNPGKPGGTGTTVGVGKGGVGVGVNPGYGKPGGTTVGVGNGGVGVHVNNPRKKPVNVNVSPFLYNYVASETQLHDDPSVALFFQEKDLLQPGKKVTVQFADTATTGAKFLPRSEAEAIPFSSEKVPEILARFSVDPDSVEAAEMAQTLRDCEAPAAKGEKKACATSLESMVDFATASLGTSHVRAVSTVVAKEGSPKQEYTVTGVKRAAGTDGDGRLVACHAEPYAYAVFACHLTQQTRAYSVSMLGRDGTAVDAVAVCHADTSGWNPKHVAFQVLNVKPGTVPVCHFLPQDHVVWTRSG

SEQ ID NO: 7542 - protein, 475 aa, Panicum virgatum
MDRLLAGLLGFLLLASVGSHAARAPDQYWKSALPDTPMPSSLSQLLNTPAGGTTVNVGWGGVHVDAGHGKPGGTTVDVGKGGVGVNVNPGSGKPGGTTVGVGKGGVGVNVKPGYGKPGGTTVGVGKGGVGVNVKPGYGKPGGTTVGVGKGGVGVNVKPGSGGKPGGTTVGVGKGGVGVNVNPGKPGGTTVGVGKGGVGVGVNPGYGKPGGTTVGVGKGGVGVNVKPRGKPVHVNVSPFVYNYAATETQLHDDPSVALFFQEKELRPGKKMTVQFTNTVPGTKFLPRSEADAIPFSSEKVPEILGRFSLSPDSVEAAEMAQTLRDCEAPAAKGEKKSCATSLESMVDFATAGLGTSHVRAVSTVVARPDSPKQEYTITGVKRAGAGADDGGRLVACHAEPYAYAVFACHQTRRTRAYSVSMLGRDGTAVDAVAVCHADTSGWNPKHVAFQVLNVKPGTVPVCHFLPQDHVVWTRSG

SEQ ID NO: 7543 - protein, 439 aa, Brachypodium distachyon
MSTLVMGSPGARRLMLARVASASTPSPAGVKPGGTTVGVGKGGVGVNVNPGHGKPGGTTVGVGKGGVGVNVNPSSGKPGGTTVDVGKGGVGVNVKPAYGKPGGSGTTVGVGKGGVDVNVKPGSGKPGGTTVGVGKGGVGVNVKPAYGKPGGSGTTVGVGKGGVGVNVKPGYGKPGGTTVGVGKGGVGVHVRPRGKPVNVNVSPFIYNYAATETQVHDDPSAALFFLEKDLHAGKKLAVHFMATTGAGEKFLPRSEADAIPFSSEKVPEILSRFSVKPDSTEAAQMTQTLHDCEEAAAKGEKKSCATSLESMVDFATSSLGTSHVRAVSTVVGKEGSPKQEYAMTSVKRTAGADRLVACHAEPYPYAVFACHLTQATRAYTVSMVGSTDGTAVEAVAVCHADTAGWNPRHVAFQVLKVKPGTVPVCHFLPQDHVVWTRSG

SEQ ID NO: 7544 - protein, 456 aa, Zea mays
MERLIAGLLGFLLVASVGSHAARAPDQYWKSALPNTPMPTSLSQLLDAAPAGGGTTVNVGWGGVHVDAGHGKPGGTTVDVGKGGVGVNVNPGRSGKPGGTTVGVGKGGVGVNVNPGYGKPGGTTVGVGKGGVGVNVNPGKPGGTTVGVGKGGVGVNVNPGKPAGGAGTTVGVGKGGVGVGVNPGHGKPGGTTVGVGKGGVGVHVNPGKKPVHVNVSPFIYTYAASETQLHDDPSVALFFQETDLRPGKKMTVQFASTGTTGTKFLPRSEAEAIPFSSQKVPEILARLSVDPDSVEAAEMAQTLRDCEAPAAKGEKKACATSLESMVDFATASLGTRHVRAVSTVVAKEGSPKQEYTVTGVERAAGGTDDDGRVVACHAEPYAYAVFACHLTPQTRAYSVSMLGRDGTAVDAVAVCHADTSGWNPKHVAFQVLNVKPGTVPVCHFLPQDHVVWTRSG

SEQ ID NO: 7545 - protein, 495 aa, Leymus cinereus x Leymus triticoides
  misc_feature (174)..(174): Xaa can be any naturally occurring amino acid
MDRLLAAGILGFLLIASVGSHAARAPEQYWNSALPNTPMPSSLSQLLNNQAGGTSVNVGWGGVHVDAGHGKPGGTTVDVGKGGVGVNVKPGSAKPGGTTVGVGKGGVGVNVNPGYGKPGGTTVGVGKGGVDVNVKPGSGTTVGVGKGGVGVNVKPGYGKPGGTTVGVGKGGVDXNVKPGSGKPSGTTVGVGKGGVGVNVKPAYGKPGGTGTTVGVGKGGVGVNVKPGYGKPGGTTVGVGKGGVGVQVKPRGKPVHVNVSPFVYNYAATETQLHDDPSAALFFLEKDLHTGKKMKVHFMATPGAGEKFLPRSEADTIPFSSEKVPEILTRFSVAPDSVEAAEMKQTLHECEATAAKGEKKSCATSLESMVDFATSSLGTSHVRAVSTVVGKEGSPKQEYTMTGVKRAAGADQLVACHAEPYAYAVFACHLTQATRAYTVSMVGKDGTAVEAVAVCHADTAGWNPRHVAFQVLKVKPGAAPVCHFLPQDHVVWTRSG

SEQ ID NO: 7546 - protein, 504 aa, Pseudoroegneria spicata
MDRLVAAGILGFLLIASVGSHAARAPEQYWKSALPYTPMPSSLSQLLNNQAGGTSVNVGSGGVHVDAGHGMPGGTTVDVGKGGVGVNVKPGTVKPGGTTVGVGKGGVGVNVKPGYGKPGGTTVGVGKGGVDVNVKPGNGKPSGTTVGVGKGGVGVNVKPGYGKPGGTTVGVGKGGVGVNVKPGGGTTVGVGKGGVGVNVKPAYGKPGGTGTTVGVGKGGVGVNVKPGYGKPGGTTVGVGKGGVGVNVKPGYGKPGGKPRGKPVHVNVSPFVYNYAATETQLHDDPSAALFFLEKDLHAGKKMDVHFMATPGAGEKFLPRSEADTIPFSSEKVPEILSRFSVAPDSVEAAEMKQTLRECEATAAKGEKKSCATSLESMVDFATSSLGTSHVRAVSTVVGKEGSPEQEYTMTGVKRAAGADQLVACHAEPYAYAVFACHLTQATRAYTVSMVGKDGTAVEAVAVCHADTAGWNPRHVAFQVLKVKPGAAPVCHFLPQDHVVWTRSG

SEQ ID NO: 7547 - protein, 506 aa, Triticum aestivum
MDRLVAAGILGFLLIASVGSHAHAARAPEQYWKSALPNTPMPSSLSQLLNNQAGGTSVNVGWGGVHVDAGHGMPGGTTVDVGKGGVGVNVKPGSAKPGGTTVGVGKGGVGVNVKPAYGKPGGTTVGVGKGGVDVNVKPGSGKPSGTTVGVGKGGVGVNVKPGYGKPGGTTVGVGKGGVGVNVKPGDGTTVGVGKGGVGVNVKPAYGKPGGTGTTVGVGKGGVGVNVKPGYGKPGGTTVGVGKGGVGVNVKPGYGKPGGKPRGKPVHVNVSPFLYNYAATETQLHDDPSAALFFLEKDLHAGKKMNVHFMATPGAGEKFLPRSEADAIPFSSEKAPEILSRFSVAPDSAEAAEMKQTLRECEATAAKGEKKSCATSLESMVDFATSSLGTSHVRAASTVVGKEGSPEQEYTMAGVRRAAGADQLVACHAEPYAYAVFACHLTQATRAYTVSMVGKDGTAVEAVAVCHADTAGWNPRHVAFQVLKVKPGGAPVCHFLPQDHVVWTRSG

SEQ ID NO: 7548 - protein, 274 aa, Saccharum officinarum
MDPSAVSFNSGGARRGGGGAQMLLFGGGGSANSNGFFRGVPMAVLGMDDATRVGKRPFFTTHEELLEEEYYDEQAPEKKRRLTAEQVQLLERSFEEENKLEPERKTELARRLGMAPRQVAVWFQNRRARWKTKQLETDYDHLKAAYDALAADHQGLLADNDSLRAQVVSLTEKLQGKETSPSATTAAQEVDQPDEHTAASGTEKLLAQQLKDDLHSSGDCTGHGALSSEEEDGGVVSDEGSFDLPDAMFAAGVTHHGADAEEAQLANWTSWFWN

SEQ ID NO: 7549 - protein, 274 aa, Saccharum officinarum
  misc_feature (20)..(20): Xaa can be any naturally occurring amino acid
MDPSAVSFNSGGARRGGGGXQMLLFGGGGSANSNGFFRGVPMAVLGMDDATRVGKRPFFTTHEELLEEEYYDEQAPEKKRRLTAEQVQLLERSFEEENKLEPERKTELARRLGMAPRQVAVWFQNRRARWKTKQLETDYDHLKAAYDALAADHQGLLADNDSLRAQVVSLTEKLQGKETSPSATTAAQEVDQPDEHTAASGTEKLLAQQLKDDLHSSGDCTGHGALSSEEEDGGVVSDEGSFDLPDAMFAAGVTHHGADAEEAQLANWTSWFWN

SEQ ID NO: 7550 - protein, 272 aa, Zea mays
MDPSAVSFDSGGTRRGGGAQMLLFGGGGSANSNGFFRGVPMAVLGMDDATRVGKRPFFTTHEELLEEEYYDEQAPEKKRRLTAEQVQLLERSFEEENKLEPERKTELARRLGMAPRQVAVWFQNRRARWKTKQLETDYDRLKAAYDALAADHQGLLADNDNLRAQVISLTEKLQGKETYPSATTAAQEVDQPDEHTAVSGTEELLAQQLKDNLHSSGDCTGHGTLSSEEDDGGVVSDEGCSFALPDAMFAAGFTHHGAEEVQLANWTSMFWN

SEQ ID NO: 7551 - protein, 270 aa, Zea mays
MHPSAVSFDSGDGRRRGGAQMLLFGGGGSANSNGFFRGVPMAVLAMDDATRVGKRPFFTTHEELLEEEYYDEQAPEKKRRLTAEQVQLLERSFEEENKLEPERKTELARRLGMAPRQVAVWFQNRRARWKTKQLETDYDRLKAAYNALAADHQGLLADNDSLRAQVICLTEKLQGKETSLSATIAAQEVDQPNEHTTGTEKLLAQQLKDDLHSSCGCTGHGALSSEEEDGGVVSDEGCNFDLPDAMFAVGVTNHGAEEAQLANWTSWFWN

SEQ ID NO: 7552 - protein, 275 aa, Panicum virgatum
MDPGRVGVDSGGARRGGGGGAQMLLFGGGGSANSNGFIRGIPMAVLGMDDAARVGKRPFFTTHEELLEEEYYDEQAPEKKRRLTAEQVQLLERSFEEENKLEPERKTELARRLGMAPRQVAVWFQNRRARWKTKQLETDYDRLKAAYDALAADHQGLLADNDSLRAQVISLTEKLQGKDTSPSATITAQEVDQLDEHTAASGTEKLLVQLKHDHLSSGDCTGHGALSSEEEDGGVISDEVCSFDLPDALFAAAGVTHHGAEEAQLCSWNSWLWNN

SEQ ID NO: 7553 - protein, 480 aa, Sorghum bicolor
MAVTPDQQQPPPPAGASSTPPRLLVHVHETTLVPPSPSPPETSLPLTFLDVFFLHSTPVKRLFLYRLAGPDADVAAIISSLRDSLHQALRAFYPLAGRVRLTPGTSDRYELHYRPGDAVTFTVAECDDDMHFDGLTTDEPREVAKIAALVPPLPDGGKLLAVQATLLPARRGLAIGVTVHHAACDGSGSTHFLHTWAAACRGGAAEPSLPPPPPPPVIDRTLLPDPRRLYDVFVQAAPSSQELEFIKVSADQLLATFVLSKDDLTRVKDVVADEATRRGVAPPRCSSLVATFGFVWSCYQRAKNGGGGEGPMMTCMVIAVDHRSRMKPPLPDKYLGNCVGPAFALAPTGELAVAGAGGLFSACAAVAASIDEAVRDIGTSSMEAWMDRIKEVLLMDLLTVSGSPRFRVYDLDFGFGRPAKVEVVPVTRTGVVAVAESRVGDGGIEVGVSLQPAAMGSYKKCFADAIAWLHQRRHESDDSF

SEQ ID NO: 7554 - protein, 189 aa, Saccharum officinarum
MAMALGGDAERKAKTAEVALRALLCGLGALAAALVATDTQTRTFFSLQKKASYTDMKAMVFLVAVTAVAAGYSLLQLGARCCIALLPSSSSRGGGGMVPGRPLAWCVFSCDQALAYVLLAAVAAALQASVVAKRGQPEMQWMGICALYGTFCRQAGAGIASAVATGLAGRLLRFLSAFNSSGSTAPRPN

SEQ ID NO: 7555 - protein, 544 aa, Zea mays
MACNLAQCATAAAATVAPRTPRPAASASVSFSARKPAGGSLRLQRQACCEPSVAPSRAVFACRAAASGSAADLASGGRRSSGVPVFVMMPLDTVKECGTALHRRKAVQASLSALKSAGVEGVMVDVWWGIAERDGPGRYNFAGYAELMEMARKAGLKVQAVMSFHQCGGNVGDSVSIPLPRWAAEEMERDQDLCYTDQWGRRNYEYVSLGCDAMPVLKGRTPVECYTDFMRAFRDHFADYLGNTIVEIQVGMGPAGELRYPSYPESNGTWKFPGIGAFQCNDRYMRSRLKAAAEAAGKPEWGHGGPTDAGGYNNWPEDTVFFRGDNGGWSTEYGDFFLSWYSQMLLEHGDRILSGATSVFGAAPVEVSVKVAGIHWHYGSRSHAPELTAGYYNTRRHDGYLTIARLLARHGAVLNFTCVEMRDHEQPQEARCMPEALVRQVGAAARAAGVGLAGENALPRYDGTAHDQVVTTAAERAAEDRMVAFTYLRMGPDLFHPDNWRRFAAFVRRMNGAGSCREAAEREAHGVAQATGSLVHEAAVALRS

SEQ ID NO: 7556 - protein, 457 aa, Panicum virgatum
MMPLDTVNKCGTALNRRKAVQASLAALKSAGVEGVMVDVWWGIAESDGPGRYNFAGYMELMEMARKTGLKVQAVMSFHQCGGNVGDSVTIPLPRWVLEEMEEDRDLCYTDQWGRRNCEYVSLGCDAMPVLKGRTPVECYTDFMRAFRDHFADYLGNTIVEIQVGMGPAGELRYPSYPESNGTWRFPGIGAFQCNDRYMLSSLKEAAAAAGKPEWGHGGPTDAGSYNNWPEDTIFFRRENGGWSTEYGDFFLSWYSRMLLEHGDRVLTGATSVFSASPVAISVKVAGIHWHYGTRSHAPELTAGYYNTRHRDGYLPIARLLARHGAVLNFTCVEMRDHEQPREAQCMPEALVRQVGAAARAAGAGLAGENALPRYDGAAHDQVVATAAERAAEDRMVAFTYLRMGADLFHPDNWHRFAAFVRRMSGAGSCREAAEREARGVAQATGSLVREAAVALRS

SEQ ID NO: 7557 - protein, 535 aa, Oryza sativa
MALNLAQSAAAAACFATAGDARRAASVVAMPSSSSSATTSLRMKRQAACEPVACRAVARHVAAAAASSRRNGVPVFVMMPLDTVSKCGSALNRRKAVAASLAALKSAGVEGIMVDVWWGIVESEGPGRYNFDGYVELMEMARKTGLKVQAVMSFHQCGGNVGDSVNIPLPRWVVEEMEKDNDLAYTDQWGRRNFEYISLGCDAMPVFKGRTPVECYTDFMRAFRDHFASFLGDTIVEIQVGMGPAGELRYPSYPESNGTWRFPGIGAFQCNDRYMRSSLKAAAEARGKPEWGHGGPTDAGGYNNWPEDTVFFRGDCGGWSTEYGEFFLSWYSQMLLEHGERVLSGATSVFGDGAGAKISVKVAGIHWHYGTRSHAPELTAGYYNTRHRDGYLPIARMLARHGAVLNFTCVEMRDHEQPQEAQCMPEALVRQVAAAARAAGVGLAGENALPRYDGTAHDQVVAAAADRAAEDRMVAFTYLRMGPDLFHPDNWRRFVAFVRRMSESGSPREAAESAAHGVAQATGSLVHEAAVALRS

SEQ ID NO: 7558 - protein, 308 aa, Saccharum officinarum
MEAAIHSASETRIAVVTGGNKGIGLEVCRQLAGDGATVVLTARDETRGAAAAEKLREAGLSDVIFHQLEITDAPSIARLAEFLKTRFGKLDILINNAAIGAVEYVQDPVDSSTSEDKFRGMDKGQRLECMFKGVRETYDAAREGVKTNYYGTKHVIEALLPLLQASSDGRIVNVSSEFGLLRLINNEELRQELNDVEKLTEERLDEVLATHLRDFEAGEVEARGWPMDFSAYKVAKVAMNAYSRILARKHPELCINCAHPGYVSTDMTIHTGPLTPEEGAGNLVKVALLPEGGPTGAYFALGEEAPFV

SEQ ID NO: 7559 - protein, 308 aa, Saccharum officinarum
MEAAIHSASETRIAVVTGGNKGIGLEVCRQLAGDGATVVLTARDETRGAAAAEKLREAGLSDVIFHQLEITDAPSIARLAEFLKTRFGKLDILINNAAIGAVEYVQDPVDSSTSEDKLRGMDKGQRLECMFKGVRETYDAAREGAKTNYYGTKHVIEALLPLLQASSDGRIVNVSSEFGLLRLINNEELRQELNDVEKLTEERLDEVLATYLRDFEAGEVEARGWPMDFSAYKVAKVAMNAYSRILARKHPELCINCAHPGYVSTDMTIHTGPLTPEEGAGNLVKVALLPEGGPTGAYFALGEEAPFV

SEQ ID NO: 7560 - protein, 332 aa, Zea mays
MEAAAIPTSAPETRIAVVTGGNKGIGLEVCRQLAGAGATVVVLTARDETRGAAAAQELRESGLSDVIFHQLDITDAASVSRLAEFLKARFGKLDILVNNAAVGAVEYVQDPADSSTSEEELSGMDMVQRLQCMLKRVRETYDAATEGIKTNYYGIKHVIEALLPLLQASSDGRIVNVSSDFGLLRLINNEEAKAGAKRRGEAHRGEAGRGAGRVPERLRRRRGGGARVAGGLLGLQGGQGGHERVHEDPSEEPPGAARQLRAPRLREHRHDRPHRASHARARRGQRREGGAAAGGRPDRRVLRVGRGGVLYVTKAPSSLSSSLFANSLLVDF

SEQ ID NO: 7561 - protein, 229 aa, Zea mays
MNAYTRILARSHPGLRVNCAHPGYVSTDMTVHTGPLTPEQGAANVVKVALLPEGGPTGAYFALGEEASFMVAVVTGGNKGIGLEVCRQLASNGITVVLTARDEKRGAAAVEELADAGLSGVVFHQLEVTDAQSIARLAGFLKAWFGKLDILIPFLSFDQRQQLLLLDLKQRMQYLRNEEVKHELDDIEGLTEERLDELLSTFLRDFEAGALKPAAGRRSSPRTRWPRPP

SEQ ID NO: 7562 - protein, 309 aa, Panicum virgatum
MEGAIPNPPNARIAVVTGGNKGIGLEVCRQLAGAGVTVVLTARDETRGAAAVEKLREAGLSDVMFHQLDITDAPSIARLADFLKARFGKLDILINNAAIVGVEYLLDPFDSSPTSEEKFSGMDKRQRIEWLTSVVRGTYDAAREGLQTNYYGTKHVIEALLPLLQASSDGRIVNVSSEWGLLRLINNEELKQELNDVEKLTEARLDEVLDTFLNDFKAGELEARGWPEHFSAYKVSKVTMNAYSRILARRHPELRVNCAHPGYVNTDMTIHSGPLTPEEGAANVVKVALLPEAGVTGAFFEDGEEAPFV

SEQ ID NO: 7563 - protein, 409 aa, Zea mays
MLQIGSQEQREKHTTVMGHDHMSRIKMHMAEGSFGDRIRCQQPGCNEVVDRRVVYCKIHSGELSCQQFSYLQSGLESSGLSVRPVNDSQFKGSVSIAAVPCTEQELHVKHEGGDRGKLKDSSGYTLGQAAQFIFSGASMLCKNDNCSKQAHENSIHCKLHSGGVNKGCMARGCTRGAHGGTPLCIGHGGGRRCVVPGCPNAACGQGRSDRCVRHGGGKRCKFEGCAKGAQGNTDHCIRHGGGRRCRFQGCTKSAQGRTDFCIKHGGGSRCRFQGCGASAKWGTDLCSVHRKSLLGGDNAIPEALAAPSEKRRRAKTPQREAKPSEVFQENVTTAATAGNSTQHTGFLLVAAPVANRDILTNGMAVTGQAAIAPQRIVAPMFMRSPTPSGSVAASAQRWEAGASRGMLGL

SEQ ID NO: 7564 - protein, 375 aa, Zea mays
MGHDHMSRIKMHMAEGSFGDRNRCQQPGCNEVVDGRVVYCKTHSGELSCQQFSHLQSGLESSAVPCTEQELHVKHEGDDRGKLKDSSGYTLGQTAQFVFPGAGMFCKNDSCSKQAHENSIYCKLHSGVSKGCMVRGCTRGAHGGTPLCIGHGGGKRCVIPGCPNAACGQGLSDRCVRHGGGRRCRFEGCAKGAQGNTDYCIRHGGGRRCKFEGCTKSAQGRTDFCIKHGGGSRCKFQGCGTSAKWGTDFCSIHRKALLGGDNAAVPEALPAASEKRRRAKKPKKAAKLSEASQENATAAAAIAGNSTQHMGGLLIAIPVANRDMLTKAVAATGQAAIASAQIVAPLSMKSPTPSGAAAATLTGREAGASREMLGL

SEQ ID NO: 7565 - protein, 389 aa, Panicum virgatum
MGHDHMSRIKMHMAEGSLVDRNRCQQPGCNEVVDGRVLYCKIHSGGLSCQQYNHLQSAQGSSGLLVSPVNDSQFNRPVSSAVTCTEQEMHVKHEGDDRGKLKDSFGNTQGQTTQLVFRGAGRLCKHESCSKQAQENSIYCKLHSGVSKGCMVRGCARGAHGGTPLCIGHGGGKRCIIPGCPNAACGQGRSDRCIRHGGGKRCKFEGCAKGAQGNTDYCIRHGGGRRCKFEGCTKSAQGRTDFCIKHGGGSRCKFQGCGTSAKWGTYFCSVHRKSLLSSDNAIPEALPASSEKRRRAKKPKKAVKPYEPSQESVTTAGIAGSSTQQMGVLLVATPVTNHDILTKGVTVTARAAIAPPQIVAPLSLKSPTASGSVASVEREAGASRAMLGL

SEQ ID NO: 7566 - protein, 318 aa, Saccharum officinarum
MGLPVRRERDAEAELNLPPGFRFHPTDDELVEHYLCRKAAGQRLPVPIIAEVDLYKFDPWNLPERALFGVREWYFFTPRDRKYPNGSRPNRAAGNGYWKATGADKPVAPRGRTLGIKKALVFYAGKAPRGVKTDWIMHEYRLADAGRAAAAKKGSLRLDDWVLCRLYNKKNEWEKMQLGKESAAGVGTTKEEAMDMTTSHSHSHSQSHSHSWGETRTPESEIVDNDPFPELDSFPAFQDPAAAMMMVPKKEQVDDGSAAANAAKSSDLFVDLSYDDIQGMYSGLDMLPPPGEDFYSSLFASPRVKGNQPGGAAGLGPF

SEQ ID NO: 7567 - protein, 313 aa, Panicum virgatum
MGVPVRRERDAEAELNLPPGFRFHPTDDELVEHYLCRKAAGQRLPVPIIAEVDLYKFDPWDLPERALFGTREWYFFTPRDRKYPNGSRPNRAAGNGYWKATGTDKPVAPRGRTLGIKKALVFYAGKAPRGVKTDWIMHEYRLADAGRAAAAKKGSLRLDDWVLCRLYNKKNEWEKMQLGKESAAGAVAKEEAMDMTTSHSHSQSHSHSWGETRTPESEIVDNDPFPELDSFPAFQDPAAAMMVPKKEPQADDGNNNAAKNSDLFVDLSYDDIQSMYSGLDMLPPPGEDFYSSLFASPRVKGNQPAGAAGLAPF

SEQ ID NO: 7568 - protein, 316 aa, Panicum virgatum
MGVPVRRERDAEAELNLPPGFRFHPTDDELVEHYLCRKAAGQRLPVPIIAEVDLYKFDPWDLPERALFGTREWYFFTPRDRKYPNGSRPNRAAGNGYWKATGADKPVAPRGRTLGIKKALVFYAGKAPRGVKTDWIMHEYRLADAGRAAAAKKGSLRLDDWVLCRLYNKKNEWEKMQLGKTESAAGAVPKEEAMDMTTSHSHSQSHSHSWGETRTPESEIVDNDPFPELDSFPAFQDPAAAMMVPKKEPHADDGNNNNAAAKNSNLFVDLSYDDIQSMYSGLDMLPPPGEDFYSSLFASPRVKGNQPAGAAGLAPF

SEQ ID NO: 7569 - protein, 312 aa, Zea mays
MGLPMRRERDAEAELNLPPGFRFHPTDDELVEHYLCRKAAGQRLPVPIIAEVDLYRFDPWDLPERALFGAREWYFFTPRDRKYPNGSRPNRAAGNGYWKATGADKPVAPRGRTLGIKKALVFYAGKAPRGVKTDWIMHEYRLADAGRAAAAKKGSLRLDDWVLCRLYNKKNEWEKMQLGKAAVAGVGATKEEAMDMATSHTHSHSQSHSHSWGETRTPESEIVDNDPFPELDSFPAFQDPAMMMTVPKEEQVDGCSAKSGNLFVDLSYDDIQGMYSGLDMLPPPGEDFYSSLFASPRVKGNQPAGAAGLGQF

SEQ ID NO: 7570 - protein, 316 aa, Oryza sativa
MGMGMRRERDAEAELNLPPGFRFHPTDDELVEHYLCRKAAGQRLPVPIIAEVDLYKFDPWDLPERALFGAREWYFFTPRDRKYPNGSRPNRAAGNGYWKATGADKPVAPRGRTLGIKKALVFYAGKAPRGVKTDWIMHEYRLADAGRAAAGAKKGSLRLDDWVLCRLYNKKNEWEKMQQGKEVKEEASDMVTSQSHSHTHSWGETRTPESEIVDNDPFPELDSFPAFQPAPPPATAMMVPKKESMDDATAAAAAAATIPRNNSSLFVDLSYDDIQGMYSGLDMLPPGDDFYSSLFASPRVKGTTPRAGAGMGMVPF

SEQ ID NO: 7571 - protein, 302 aa, Zea mays
MGQPVTRRRERDAEAELDLPPGFRFHPTDDELVEHYLCRKAAGQRLPVPIIAEVDLYRFDPWDLPERALFGAREWYFFTPRDRKYPNGSRPNRAAGDGYWKATGADKPVAPRAAAADARTLGIKKALVFYAGKAPRGVKTDWIMHEYRLADAGRRAKKGSLRLDDWVLCRLYNKKNEWEKMRLGKGAAAGAVKEEEAMDMSTSHSQITHSWGETRTPESEIVDNDLPFPDPAMMVPKKERVDDGGSARTSDLFVDLSYDDIQGMYSGLDMLPPAGEDLYSSLFASPRVRGNQPTGPAGLGPF

SEQ ID NO: 7572 - protein, 187 aa, Saccharum officinarum
MGIDLVAGGRNKKTKRTAPKSDDVYLKLLVKLYRFLVRRTKSNFNAVILKRLFMSKTNRPPLSLRRLVNFMEGKENQIAVIVGTVTDDKRVYEVPAMKVAALRFTETARARIANAGGECLTFDQLALRAPLGQNTVLLRGPKNAREAVKHFGPAPGVPHSHTKPYVRSKGRKFEKARGRRNSRGFKV

SEQ ID NO: 7573 - protein, 186 aa, Saccharum officinarum
  misc_feature (38)..(38): Xaa can be any naturally occurring amino acid
GIDLVAGGRNKKTKRTAPKSDDVYLKLLVKLYRFLVRXTKSNFNAVILKRLFMSKTNRPPLSLRRLVNFMEGKENQIAVIVGTVTDDKRVYEVPAMKVAALRFTETARARIANAGGECLTFDQLALRAPLGQNTVLLRGPKNAREAVKHFGPAPGVPHSHTKPYVRSKGRKFEKARGRRNSRGFKV

SEQ ID NO: 7574 - protein, 187 aa, Panicum virgatum
MGIDLVAGGRNKKTKRTAPKSDDVYLKLLVKLYRFLVRRTKSDFNAVILKRLFMSKTNRPPLSLRRLVKFMEGKENQIAVIVGSVTDDKRVYEVPAMKVAALRFTETARARIVNAGGECLTFDQLALRAPLGQNTVLLRGPKNAREAVKHFGPAPGVPHSHTKPYVRSKGRKFEKARGRRNSRGFKV

SEQ ID NO: 7575 - protein, 187 aa, Panicum virgatum
MGIDLVAGGRNKKTKRTAPKSDDVYLKLLVKLYRFLVRRTKSDFNAVILKRLFMSKTNQPPLSLRRLVKFMEGKENQIAVIVGTVTDDKRVYEVPAMKVAALRFTETARARIVNAGGECLTFDQLALRAPLGQNTVLLRGPKNAREAVKHFGPAPGVPHSHTKPYVRSKGRKFEKARGRRNSRGFKV

SEQ ID NO: 7576 - protein, 187 aa, Oryza sativa
MGIDLVAGGRNKKTKRTAPKSDDVYLKLIVKLYRFLVRRTKSPFNAVILRRLFMSKTNRPPLSLRRLVRFMEGKENQIAVIVGTVTDDKRVYEVPAMKVAALRFTETARARIVNTGGECLTFDQLALRAPLGQNTVLLRGPKNAREAVKHFGPAPGVPHSNTKPYVRSKGRKFEKARGRRNSKGFKV

SEQ ID NO: 7577 - protein, 187 aa, Brachypodium distachyon
MGIDLVAGGRNKKTKRTAPKSDDVYLKLLVKLYRFLVRRTKNHFNAVILKRLFMSKTNRPPLSLRRLVKFMEGKENQIAVIVGTITDDKKVYEVPAMKVAALRFTETARARIVNAGGECLTFDQLALHAPLGQNTVLLRGPKNAREAVRHFGKAPGVPHSHTKPYVRSKGRKFEKARGRRNSRGFKV

SEQ ID NO: 7578 - protein, 187 aa, Sorghum bicolor
MGIDLVAGGRNKKTKRTAPKSDDVYLKLLVKLYRFLVRRTKSNFNAVILKRLFMSKTNRPPLSMRRLVKFMEGKSDQIAVIVGTVTDDKRINEVPAMKVCALRFTETARARIINAGGECLTFDQLALRAPLGQNTVLLRGPKNAREAVKHFGPAPGVPHSHTKPYVRSKGRKFEKARGRRNSRGFKV

SEQ ID NO: 7579 - protein, 187 aa, Zea mays
MGIDLVAGGRNKKTKRTAPKSDDVYLKLLVKLYRFLVRRTKSNFNAVILKRLFMSKTNRPPLSMRRLVRFMEGKGDQIAVIVGTVTDDKRISEVPAMKVCALRFTETARARIINAGGECLTFDQLALRAPLGQNTVLLRGPKNAREAVRHFGPAPGVPHSHTKPYVRSKGRKFEKARGRRNSRGFKV

SEQ ID NO: 7580 - protein, 187 aa, Saccharum officinarum
MGIDLVARGRNKKTKRTAPKSDDVYLKLLVKLYRFLVRRTKSNFNAVILKRLFMSKTNRPPLSMRRLVKFMEGKGDQIAVIVGTVTDDKRINEVPAMKVCALRFTETARARIINAGGECLTFDQLALRAPLGQNTVLLRGPKNAREAVKHFGPAPGVPHSHTKPYVRSKGRKFEKARGRRNSRGFKV

SEQ ID NO: 7581 - protein, 187 aa, Brachypodium distachyon
MGIDLVAGGRNKKTKRTAPKSDDVYLKLLVKLYRFLVRRTKSHFNAVILKRLFMSKTNRPPLSMRRLVRFMEGKGDQIAVIVGTITDDKRVYEIPAMKVAALRFTETARARIVNAGGECLTFDQLALRAPLGQNTLLLRGPKNAREAVRHFGAAPGVPHSHTKPYVRSKGRKFEKARGRRNSRGFKV

SEQ ID NO: 7582 - protein, 187 aa, Zea mays
  misc_feature (19)..(19): Xaa can be any naturally occurring amino acid
MGIDLVAGGRNKKTKRTAXKSDDVYLKLLVKLYRFLVRRTKSNFNAVILKRLFMSKTNRPPLSMRRLVRFMEGKGDQIAVIVGTVTDDKRISEVPAMKVCALRFTETARARIINAGGECLTFDQLALRAPLGQNTVLLRGPKNAREAVRHFGPAPGVPHSHTKPYVRSKGRKFEKARGRRNSRGFKV

SEQ ID NO: 7583 - protein, 187 aa, Sorghum bicolor
MGIDLVAGGRNKKTKRTAPKSDDVYLKLLVKLYRFLVRRTKSNFNAVILKRLFMSKTNRPPISLRRLVKFMEGKEKNIAVIVGTVTDDKRIQEVPAMKVTALRFTETARARIVNAGGECLTFDQLALRAPLGENTVLLRGPKNAREAVRHFGKAPGVPHSHTKPYVRSKGRKFEKARGRRNSRGFKV

SEQ ID NO: 7584 - protein, 187 aa, Panicum virgatum
MGIDLVAGGRNKKTKRTAPKSDDVYLKLLVKLYRFLVRRTKSNFNAVILKRLFMSKTNQPPLSMRRLVKFMEGKGDQIAVIVGTVTDDKRITEVPAMKVCALRFTETARARIINACGECLTFDQLALRAPLGQNTVLLRGPKNAREAVKHFGPAPGVPHSHTKPYVRSKGRKFEKARGRRNSRGFKV

SEQ ID NO: 7585 - protein, 187 aa, Triticum aestivum
MGIDLVAGGRNKRTKRTAPKSDDVYLKLLVKLYRFLVRRTKSQFNAVILKRLFMSKTNRPPLSLRRLVKFMDGKDNQIAVIVGTITDDKRVYEVPAIKVAALRFTETARARIVNAGGECLTFDQLALRAPLGQYTVLLRGPKNAREAVRHFGKAPGVPHSHTKPYVRSKGRKFEKARGRRNSRGFKV

SEQ ID NO: 7586 - protein, 187 aa, Zea mays
MGIDLVAGGRNKKTKRTAPKSDDVYLKLLVKLYRFLVRRTKSNFNAVILKRLFMSKTNRPPISMRRLVKFMEGKEKNIAVIVGTVTDDKRIQEVPAMKVTALRFTETARARIVNAGGECLTFDQLALRAPLGENTVLLRGPKNAREAVRHFGKAPGVPHSHTKPYVRSKGRKFEKARGRRNSRGFKV

SEQ ID NO: 7587 - protein, 186 aa, Pseudoroegneria spicata
GIDLVAGGRNKRTKRTAPKSDDVYLKLLVKLYRFLVRRTKSQFNAVILKRLFMSKTNRPPLSLRRLVKFMDGKDNQIAVVVGTITDDKRVYEVPAIKVAALRFTETARARIVNAGGECLTFDQLALRAPLGQNTVLLRGPKNAREAVRHFGKAPGVPHSHTKPYVRSKGRKFEKARGRRNSRGFKV

SEQ ID NO: 7588 - protein, 188 aa, Unknown
  Sequence found in Organisms: Sorghum bicolor, Saccharum officinarum
MGIDLVAGGRNKKTKRTAPKSDDVYLKLLVKLYRFLVRRTKSNFNAVILKRLFMSKTNRPPISLRRLVKFMEGKEEKNIAVIVGTVTDDKRIQEVPAMKVTALRFTETARARIVNAGGECLTFDQLALRAPLGENTVLLRGPKNAREAVRHFGKAPGVPHSHTKPYVRSKGRKFEKARGRRNSRGFKV

SEQ ID NO: 7589 - protein, 187 aa, Triticum aestivum
MGIDLVAGGRNKRTKRTAPKSDDVYLKLLVKLYRFLARRTKSQFNAVILKRLFMSKTNRPPLSLRRLVKFMDGKDNQIAVVVGTITDDKRVYEVPAIKVAALRFTETARARIVNAGGECLTFDQLALRAPLGQNTVLLRGPKNAREAVRHFGKAPGVPHSHTKPYVRSKGRKFEKARGRRNSRGFKV

SEQ ID NO: 7590 - protein, 187 aa, Secale cereale
  misc_feature (43)..(43): Xaa can be any naturally occurring amino acid
MGIDLVAGGRNKRTKRTAPKSDDVYLKLLVKLYRFLVRRTKSXFNAVILKRLFMSKTNRPPLSMRRLVRFMEGKEDKIAVIVGTITDDQRVYEIPAMKVAALRFTETARARIVNAGGECLTFDQLALRAPLGQNTLLLRGPKNAREAVRHFGKAPGVPHSHTKPYVRSKGRKFEKARGRRNSRGFKV

SEQ ID NO: 7591 - protein, 187 aa, Triticum aestivum
MGIDLVAGGRNKRTKRTAPKSDDVYLKLLVKLYRFLVRRTKSQFNAVILKRLFMSKTNRPPLSMRRLVRFMEGKEDKIAVIVGTITDDQRVYEIPAMKVAALRFTETARARIVNAGGECLTFDQLALRAPLGQNTLLLRGPKNAREAVRHFGKAPGVPHSHTKPYVRSKGRKFEKARGRRNSRGFKV

SEQ ID NO: 7592 - protein, 188 aa, Oryza sativa
MGIDLVAGGRNKKTKRTAPRSDDVYLKLLVKLYRFLVRRTKSNFNAVILKRLFMSKTNRPPLSLRRLAKFMEGKEENNIAVIVGTVTDDKRIQEIPKMKVTALRFTETARARIVNAGGECLTFDQLALRAPLGENTVLLRGPKNAREAVRHFGKAPGVPHSHTKPYVRSKGRKFEKARGRRNSRGFKV

SEQ ID NO: 7593 - protein, 188 aa, Saccharum officinarum
MGIDLVAGGRNKKTKRTAPKSDDVYLKLLVKLYRFLVRRTKSNFNAVILKRLFMSKTNRPPISLRRLVKFMEGKEEKNIAVIVGTVTDDKRIQEVPAMKVTALRFTETARARIVNAGGECLTFDQLALRAPLGENTVLLRGPKNAREAVRHFGKAPGVPHSHTKPYVRSKGRKVEKARGRKNSRGFKV

SEQ ID NO: 7594 - protein, 188 aa, Saccharum officinarum
  misc_feature (172)..(172): Xaa can be any naturally occurring amino acid
  misc_feature (180)..(180): Xaa can be any naturally occurring amino acid
MGIDLVAGGRNKKTKRTAPKSDDVYLKLLVKLYRFLVRRTKSNFNAVILKRLFMSKTNRPPISLRRLVKFMEGKEEKNIAVIVGTVTDDKRIQEVPAMKVTALRFTETARARIVNAGGECLTFDQLALRAPLGENTVLLRGPKNAREAVRHFGKAPGVPHSHTKPYVRSKGXKFEKARGXRNSRGFKV

SEQ ID NO: 7595 - protein, 209 aa, Triticum aestivum
MGIDLVAGGRNKRTKRTAPKSDDVYLKLLVKLYRFLVRRTKSQFNAVILKRLFMSKTNRPPLSLCRLVKFMDGKDNQIAVVVGTITDDKRVYEVPAIKVAALRFTETARARIVNAGGECLTFDQLALRAPLGQNTVLLRGPKNAREAVRHFVRLLVCRAAIPSLMSARREGSLRRQEEGGTAEASRSRLLLVHVLHSSCLSLSYVIIKC

SEQ ID NO: 7596 - protein, 187 aa, Avena sativa
MGIDLEAGGRNKRTKRTEPKSDDVYLKLLVKLYRFLVRRTKSHFNAVILKRLFMSKTNRAPLSMRRLVRFMEGKGDQIAVIVGTITDDKRVYEVPAMKVAALRFTETARARIVNAGGECLTFDQLALRAPLGQNTVLLRGPKNAREAVRHFGKAPGVPHSHTKPYVRAKGRKFEKARGRRNSRGFKV

SEQ ID NO: 7597 - protein, 187 aa, Triticum aestivum
MGIDLVAGGRNKRTKRTAPKSDDVYLKLLVKLYRFLVRRTKSQFNAVILKRLFMSKTNRPPLSMRRLVRFMEGKADKIAVIVGTITDDQRVYEIPAMKVAALRFTETARARIVNAGGECLTFDQLALRAPLGQNTLLLRGPKNAREAVRHFGKAPGVPHSHTKPYVRSKGRKFEKARGRRNSRGFKV

SEQ ID NO: 7598 - protein, 134 aa, Eragrostis curvula
MSKTNRPPLSLRRLVKFMEGKENQIAVIVGTVTDDKRVYEVPAMKVAALRFTETARARIVNAGGECLTFDQLALRAPLGQNTVLLRGPKNAREAVKHFGAAPGVPHSHTKPYVRSKGRKFEKARGRRNSRGFKV

SEQ ID NO: 7599 - protein, 187 aa, Hordeum vulgare
MGIDLVAGGRNKRTKRTAPKSDDVYLKLLVKLYRFLVRRTKSQFNAVILKRLFMSKTNRPPLSMRRLVRFMDGKADKIAVIVGTITDDQRVYEIPAMKVAALRFTETARARIVNAGGECLTFDQLALRAPLGQNTLLLRGPKNAREAVRHFGKAPGVPHSHTKPYVRSKGRKFEKARGRRNSRGFKV

SEQ ID NO: 7600 - protein, 188 aa, Pennisetum glaucum
MGIDLVAGGRNKKTKRTAPKSDDVYLKLLVKLYRFLVRRTKSSFNAVILKRLFMSKTNRPPISLRRLSKFMEGKEEKNIAVIVGTVTDDKRIQEIPAMKVTALRFTETARARIINAGGECLTFDQLALRAPLGENTVLLRGPKNAREAVRHFGKAPGVPHSHTKPYVRSKGRKFEKARGRRNSRGFKV

SEQ ID NO: 7601 - protein, 188 aa, Panicum virgatum
MGIDLVAGGRNKKTKRTAPKSDDVYLKLLVKLYRFLVRRTKSNFNAVILKRLFMSKTNRPPISLRRLANFMKGKEEKNIAVIVGSVTDDKRIQEIPAMKVTALRFTETARARIINAGGECLTFDQLALRAPLGENTVLLRGPKNAREAVRHFGKAPGVPHSHTKPYVRSKGRKFEKARGRRNSRGFKV

SEQ ID NO: 7602 - protein, 188 aa, Cenchrus ciliaris
MGIDLVAGGRNKKTKRTAPKSDDVYLKLLVKLYRFLVRRTKSSFNAVILKRLFMSKSNRPPISLRRLAKFMEGKEEKNIAVIVGTVTDDKRIQEIPAMKVTALRFTETARARIINAGGECLTFDQLALRAPLGENTVLLRGPKNAREAVRHFGKAPGVPHSHTKPYVRSKGRKFEKARGRRNSRGFKV

SEQ ID NO: 7603 - protein, 188 aa, Eragrostis curvula
MGIDLVAGGRNKKTKRTAPKSDDVYLKLLVKLYRFLVRRTKSNFNAVILKRLFMSKTNRPPISLRRLTKFMAGKEEKNIAVIVGTVTDDKRIQEIPAMKVTALRFTETARARIVKAGGECLTFDQLALRAPLGENTILLRGPKNAREAVRHFGKAPGVPHSHTKPYVRSKGRKFEKARGRRNSRGFKV

SEQ ID NO: 7604 - protein, 188 aa, Panicum virgatum
MGIDLVAGGRNKKTKRTAPKSDDVYLKLLVKLYRFLVRRTKSSFNAVILKRLFMSKTNRPPISLRRLANFMKGKEEKNIAVIVGSVTDDKRIQEIPAMKVTALRFTETARARIINAGGECLTFDQLALRAPLGENTVLLRGPKNAREAVRHFGKAPGVPHSHTKPYVRSKGRKFEKARGRRNSRGFKV

SEQ ID NO: 7605 - protein, 177 aa, Triticum aestivum
MGIDLVAGGRNKKTKRTAPKSDDVYLKLLVKLYRFLVRRTKSNFNAVILKRLFMSKTNRPPLSMRRLVKFMEGKSDQIAVIVGTVTDDKRINEVPAMKVCALRFTETARARIINAGGECLTFDQLALRAPLGQNTVLLRGPKNAREAVKHFGPAPGVPHSHTKPYVRSKGRKFEKAR

SEQ ID NO: 7606 - protein, 188 aa, Brachypodium distachyon
MGIDLVAGGRNKKTKRTAPKSDDVYLRLLVKLYRFLVRRTKSKFNAVILKRLFMSKTNRPPLSMRRLSNFMKGKDEKSIAVIVGTITDDKRIQEIPAMKVTALRFTETARARIINAGGECLTFDQLALRAPMGENTILLRGPKNAREAVRHFGKAPGVPHSHTKPYVRSKGRKFEKARGRRNSRGFKV

SEQ ID NO: 7607 - protein, 187 aa, Catharanthus roseus
MGIDLKAGGKNKKTKRTAPKSDDIYLKLLVKLYRFLVRRTESKFNAVILKRLFMSKTNKAPLSLSRLVDFMKGKDGKIAVIVGTVTDDIRVYEVPALKVAALRFTETARARIEKAGGECLTFDQLALRAPLGQNTVLLRGPKNAREAVKHFGPAPGVPHSHTKPYVRAKGRKFERARGRRNSRGFKV

SEQ ID NO: 7608 - protein, 187 aa, Zingiber officinale
MGIDLVAGGRSKKTRRTAPKSDDVYLKLLVRLYRFLVRRTGSKFNAVILKRLFMSKTNRPPLSLRRLIKFMEGNENKIAVIAGTVTDDKRVYDVPAIKVTALRFTETARARILKAGGECLTFDQLALRAPLGQNTILLRGPKNAREAVKHFGKAPGVPHSHTKPYVRAKGRKFEKARGRRNSRGFRV

SEQ ID NO: 7609 - protein, 187 aa, Ananas comosus
MGIDLVAGGRSKKARRTAPKSDDVYLKLLVKLYRFLVRRTGSKFNAVILKRLFMSKINRPPISLRRLVSFMSGKGDKTGVIVGTVTDDKRVYEVPAMKVTALRFTETARARIVNAGGECLTLDQLALRAPLGQNTVLLRGPKNAREAVKHFGKAPGVPHSHTKPYVRAKGRKFEKARGRRNSRGFRV

SEQ ID NO: 7610 - protein, 177 aa, Saccharum officinarum
NKKTKRTAPKSDDVYLKLLVKLYRFLVRRTKSNFNAVILKRLFMSKTNRPPLSMRRLVKFMEGKGDQIAVIVGTVTDDKRINEVPAMKVCALRFTETARARIINARGECLTFDQLALRAPLGQNTVLLRGPKNAREAVKHFGPAPGVPHSHTKPYVRSKGRKFEKARGRRNSRGFKV

SEQ ID NO: 7611 - protein, 195 aa, Oryza sativa
MGIDLVAGGRNKKTKRTAPRSEDVYLKLIVKLYRFLVRRTKSHFNAVILKRLFMSKTNRPPLSMRRLVRFMEGKVPDRHAISGDQIAVIVGTVTDDKRIYEVPAMKVAALRFTETARARIINAGGECLTFDQLALRAPLGQNTVLLRGPKNAREAVKHFGPAPGVPHSNTKPYVRSKGRKFEKARGRRNSKGFKV

SEQ ID NO: 7612 - protein, 188 aa, Unknown
  Sequence found in Organisms: Zea mays, Triticum aestivum
MGIDLVAGGRNKRTKRVAPKSDDVYLKLLVKLYRFLVRRTKSKFNAVILKRLFMSKTNRPPLSMRRLSNFMKGKEEKNIAVVVGTITDDMRIQEVPAMKVTALRFTETARARIVNAGGECLTFDQLALRAPTGENTILLRGPKNAREAVRHFGKAPGVPHSHTKPYVRSKGRKFEKARGRRNSRGFKV

SEQ ID NO: 7613 - protein, 232 aa, Elaeis guineensis
  misc_feature (180)..(180): Xaa can be any naturally occurring amino acid
  misc_feature (193)..(193): Xaa can be any naturally occurring amino acid
  misc_feature (202)..(202): Xaa can be any naturally occurring amino acid
  misc_feature (206)..(207): Xaa can be any naturally occurring amino acid
MGIDLKAGGRSKKARRTAPKSDDVYLKLLVKLYRFLVRRTGSRFNAVILRRLFMSKVNKPPLSLKRLVTFMQGKEDKIAVIVGTVTDDKRVYEVPAMKVTALRFTETARARIVKAGGECLTFDQLALRAPLGQNTVLLRGPKNAREAVKHFGKAPGVPHSHTKPYVRSKGRKFEKQEEEXTAGDLGFKLVYLXFIPKEEQMXMFLXXRIVDMQIFGVFQVSVEIYQVWHVMF

SEQ ID NO: 7614 - protein, 187 aa, Musa acuminata
  misc_feature (5)..(5): Xaa can be any naturally occurring amino acid
MGIDXVAGGRSKKARRTAPRSDDVYLKLLVKLYRFLVRRTGSKFNAVILKRLFMSKINRPPISLKRLITFMNGKDNKIAVIVGTVTDDKRVYEVPALKVTALRFTETARARILKAGGECLTFDQLALRAPLGQNTVLLRGPKNAREAVKHFGKAPGVPHSHTKPYVRSKGRKFEKARGRRNSRGFRV

SEQ ID NO: 7615 - protein, 188 aa, Hordeum vulgare
MGIDLVAGGRNKRTKRVAPKSDDVYLKLLVKLYRFLVRRTKSKFNAVILKRLFMSKTNRPPLSMRRLSNFMKGKEEKNIAVVVGTITDDMRIQEIPAMKVTALRFTETARARIVNAGGECLTFDQLALRAPTGENTILLRGPKNAREAVRHFGKAPGVPHSHTKPYVRSKGRKFEKARGRRNSRGFKV

SEQ ID NO: 7616 - protein, 187 aa, Festuca arundinacea
GTRPRAASCRNKRTKRTAPKSDDVYLKLLVKLYRFLVRRTKSHFNAVILKRLFMSKINRPPLSMRRLVKFMEDKDNQIAVVVGTITDDKRVYEVPAIKVTALRFTETARARIVNAGGECLTFDQLALRAPLGQNTVLLRGPKNAREAVRHFGKAPGVPHSHTKPYVRSKGRKFEKARGRRNSRGFKV

SEQ ID NO: 7617 - protein, 187 aa, Elaeis guineensis
MGIDLVAGGRSKKARRTAPKSDDVYLKLLVKLYRFLVRRTGSKFNAVILKRLFMSKINKPPISLKRLAKFMEGKDDKIAVIVGTVTDDKRVYEVPAMKVTALRFTETVRARILKAGGECLTFDQLALRAPLGQNTVLLRGPKNAREAVKHFGPAPGVPHSRTKPYVRSKGRKFERARGRRNSRGFRV

SEQ ID NO: 7618 - protein, 188 aa, Pseudoroegneria spicata
MGIDLVAGGRNKRTKRIAPKSDDVYLKLLVKLYRFLVRRTKSKFNAVILKRLFMSKTNRPPLSMRRLSNFMKGKEEKNIAVVVGTITDDMRIQEIPAMKVTALRFTETARARIVNAGGECLTFDQLALRAPTGENTILLRGPKNAREAVRHFGKAPGVPHSHTKPYVRSKGRKFEKARGRRNSRGFKV

SEQ ID NO: 7619 - protein, 188 aa, Triticum aestivum
MGIDLVAGGRNKRTKRVAPKSDDVYLKLLVKLYRFLVRRTKSKFNAVILKRLFMSKTNRPPLSMRRLSNFMKGKEEKNIAVVVGTITDDMRIQEVPAMKVTALRFTETARARIINAGGECLTFDQLALRAPTGENTILLRGPKNAREAVRHFGKAPGVPHSHTKPYVRSKGRKFEKARGRRNSRGFKV

SEQ ID NO: 7620 - protein, 188 aa, Lolium multiflorum
MGIDLEAGGRNKRTKRVAPKSDDVYLKLLVKLYRFLVRRTKSKFNAVILKRLFMSKTNLPPLSMRRLSNFMKGKEEKNIAVVVGTITDDKRIQEIPAMKVTALRFTETARARIVNAGGECLTFDQLALRAPTGENTILLRGPKNAREAVRHFGKAPGVPHSHTKPYVRSKGRKFEKARGRRNSRGFKV

SEQ ID NO: 7621 - protein, 188 aa, Avena sativa
MGIDLEAGGRNKRTKRTCPKSDDVYLKLLVKLYRFLVRRTKSKFNAVILKRLFMSKTNRPPLSMRRLSNFMKGKEEKNIAVVVGTITDDKRIQEIPAMKVTALRFTETARARIVNAGGECLTFDQLALRAPMGENTILLRGPKNAREAVRHFGKAPGVPHSHTKPYVRAKGRKFEKARGRRNSRGFKV

SEQ ID NO: 7622 - protein, 188 aa, Leymus cinereus x Leymus triticoides
  misc_feature (129)..(129): Xaa can be any naturally occurring amino acid
MGIDLVAGGRNKRTKRVAPKSDDVYLKLLVKLYRFLVRRTKSKFNAVILKRLFMSKTNRPPLSMRRLSNFMKGKEEKNIAVVVGTITDDKRIQEIPAMKVTALRFTETARARIINAGGECLTFDQLALXAPTGENTILLRGPKNAREAVRHFGKAPGVPHSHTKPYVRSKGRKFEKARGRRNSRGFKV

SEQ ID NO: 7623 - protein, 187 aa, Musa acuminata
MGIDLVAGGRSKKARRTAPRSDDVYLKLLVKLYRFLVRRTESKFNAVILKRLFMSKNNRPPISLKRLITFMERKDDKIAVIVGTVTDDKRVYDVPAMKVTALRFTETARARILKAGGECLTFDQLALRAPLGQNTVLLRGPKNAREAVKHFGKAPGVPHSHTKPYVRSKGRKFERARGRRNSRGFRV

SEQ ID NO: 7624 - protein, 187 aa, Manihot esculenta
MGIDLKAGGKSKKTKRTAPKSDDIYLKLLVKLYRFLVRRTGSKFNAVILKRLFMSKVNKPPLSLSRLITFMKGKENKIAVVVGTVTDDIRVYEVPALKVTALRFTETARARIEKAGGECLTFDQLALRAPLGQNTVLLRGPKNAREAVKHFGPAPGVPHSHTKPYVRSKGRKYERARGRRNSRGFRV

SEQ ID NO: 7625 - protein, 187 aa, Citrus sinensis
MGIDLVAGGKSKKSKRTAPKSDDIYLKLLVKLYRFLVRRTDSNFNKVILKRLFMSKVNKPPLSLSRLINFMKGKEDKIAVVVGTVTDDIRAYEVPALKVTALRFTETARARIEKAGGECLTFDQLALRAPLGQNTVLLRGPKNAREAVKHFGPAPGVPHSHTKPYVRSKGRKFERARGRRNSRGFRV

SEQ ID NO: 7626 - protein, 176 aa, Gossypium hirsutum
KKTKRTAPKSDDVYLKLLVKLYRFLVRRTKSNFNAVILKRLFMSKTNRPPISMRRLVKFMEGKEKNIAVIVGTVTDDKRIQEVPAMKVTALRFTETARARIVNAGGECLTFDQLALRAPLGENTVLLRGPKNAREAVRHFGKAPGVPHSHTKPYVRSKGRKFEKARGRRNSRGFKV

SEQ ID NO: 7627 - protein, 187 aa, Saccharum officinarum
  misc_feature (104)..(104): Xaa can be any naturally occurring amino acid
  misc_feature (115)..(115): Xaa can be any naturally occurring amino acid
  misc_feature (131)..(131): Xaa can be any naturally occurring amino acid
  misc_feature (138)..(139): Xaa can be any naturally occurring amino acid
  misc_feature (154)..(154): Xaa can be any naturally occurring amino acid
  misc_feature (159)..(160): Xaa can be any naturally occurring amino acid
  misc_feature (166)..(166): Xaa can be any naturally occurring amino acid
  misc_feature (174)..(174): Xaa can be any naturally occurring amino acid
  misc_feature (180)..(180): Xaa can be any naturally occurring amino acid
MGIDLVAGGRNKKTKRTAPKSDDVYLKLLVKLYRFLVRRTKSNFNAVILKRLFMSKTNRPPISLRRLVKFMEGKEENIAVIVGTVTDDKRIQEVPAMKVTALRXTETARARIVNXGGECLTFDQLALRAPXGENTVLXXGPKNAREAVRHFGKXPGVPXXHTKPYXRSKGRKFXKARGRXNNRGFKV

SEQ ID NO: 7628 - protein, 187 aa, Cleome gynandra
MGIDLVAGGKSKKTKRVAPKSDDVYLKLLVKLYRFLVRRTGSNFNAVILKRLFMSKVNKAPISLSRLVKFMQGKEDKNAVIVGTVTDDLRVYEVPALKVTALRFTETARARIEKAGGECLTFDQLALQAPLGQDTVLLRGPKNAREAVKHFGPAPGVPHSHTKPFVRSKGRKFERARGRRNSRGFKV

SEQ ID NO: 7629 - protein, 187 aa, Cleome spinosa
MGIDLKAGGKSKKTKRTAPKSDDVYLKLLVKLYRFLVRRTGSKFNAVILKRLFMSKVNKPPLSLSRLIRYMQGKEDQIGVIVGTVTDDARVYEVPALKITALRFTERARARIEKAGGECLTFDQLALRAPLGQNTVLLRGPKNAREAVKHFGPAPGVPHSHTKPYVRSKGRKFERARGRRKSRGFKV

SEQ ID NO: 7630 - protein, 187 aa, Cleome spinosa
MGIDLIAGGKSKKTKRVAPKSDDVYLKLLVKLYRFLVRRTGSSFNAVILKRLFMSKVNKAPISLSRLVRFMQGKEDKVAVIVGTVTDDLRVYEVPALKVTALRFTETARARIEKAGGECLTFDQLALRAPLGQNTVLLRGPKNAREAVKHFGPAPGVPHSHTKPYVRAKGRKFERARGRRNSRGFKV

SEQ ID NO: 7631 - protein, 187 aa, Linum usitatissimum
MGIDLKAGGKRKKTKRTAPKSNDIYLKLLVKLYRFLVRRTGSSFNGVILKRLFMSKVNKPPLSLSRLIRFMKGKEGKIAVIVGTITDDIRVYDVPAMKVTALRFTETARARIEKAGGECLTFDQLALRAPLGQNTVLLRGPKNAREAVKHFGPAPGVPHSHTKPYVRSKGRKFEKARGRRNSRGFRV

SEQ ID NO: 7632 - protein, 187 aa, Jatropha curcas
MGIDLKAGGKSKKTKRTAPKSDDIYLKLLVKLYRFLVRRTGSKFNAVILKRLFMSKVNKTPLSLSRLIRFMKGKESKIAVVVGTVTDDIRVYEVPALKVTALRFTETARARIEKAGGECLTFDQLALRAPLGQNTVLLRGPKNAREAVKHFGPAPGVPHSHTKPYVRSKGRKFERARGRRNSRGFRV

SEQ ID NO: 7633 - protein, 187 aa, Amborella trichopoda
MGIDLVAGGKSKKTKRTAPKSGDIYLKLLVKLYRFLVRRTGSKFNAVILKRLFMSKINRPPISLSRLIKFMQGKEGKIGVIVGCVTDDTRVYEVPALKVAALRFTETARARIVKAGGECLTFDQLALLAPLGQNTVLLRGPKNAREAVKHFGKAPGVPHSHTKPYVRSKGRKFERARGRRNSRGFRV

SEQ ID NO: 7634 - protein, 187 aa, Musa acuminata
MGIDIVAGGRSKKARRTSPRSDDVYLKLLVKLYRFLVRRTGSKFNAVILKRLFMSKINRPPISLKRLITFMNGKDDKIAVIVGTVTDDKRVYEVPAMKVTALRFTETARARILKAGGECLTFDQLALRAPLGQNTVLLRGPKNAREAVKHFGKAPGVPHSHTKPYVRSKGRKFERARGRRNSRGFRV

SEQ ID NO: 7635 - protein, 187 aa, Theobroma cacao
MGIDLVAGGKSKKSKRTAPKSDDIYLKLLVKLYRFLVRRTGSKFNAVILKRLFMSKVNKPPLSLSRLIEFMKGKEDKIAVVVGTVTDDIRVYEVPALKVTALRFTETARARIEKAGGECLTFDQLALRAPLGQNTVLLRGPKNAREAVKHFGPAPGVPHSHTKPYVRSKGRKFERARGRRNSKGFRV

SEQ ID NO: 7636 - protein, 187 aa, Ricinus communis
MGIDLKAGGKSKKTKRTAPKSDDIYLKLIVKLYRFLVRRTGSKFNAVILKRLFMSKINKAPLSLSRLITFMKGKENKIAVIVGTVTDDVRVYEVPALKVTALRFTETARARIEKAGGECLTFDQLALRAPLGQNTVLLRGPKNAREAVKHFGPAPGVPHSHTKPYVRAKGRKFERARGRRNSRGFRV

SEQ ID NO: 7637 - protein, 187 aa, Gossypium hirsutum
MGIDLVAGGKSKKTKRTAPKSDDIYLKLLVKLYRFLVRRTGSKFNAVILKRLFMSKTNKPPLSLSRLIQFMKGKEDKIAVVVGAVTDDIRVYEVPALKVTALRFTETARARIEKAGGECLTFDQLALRAPLGQNTVLLRGPKNAREAVKHFGPAPGVPHSHTKPYVRAKGRKFERARGRRNSKGFRV

SEQ ID NO: 7638 - protein, 187 aa, Gossypium hirsutum
MGIDLVAGGKSKKTKRTAPKSDDIYLKLIVKLYRFLVRRTGSKFNAVILKRLFMSKVNKPPLSLSRLIEFMKGKEDKIAVVVGTVTDDIRVYEVPALKVTALRFTETARARIDKAGGECLTFDQLALRAPLGQNTVLLRGPKNAREAVKHFGPAPGVPHSHTKPYVRSKGRKFERARGRRNSKGFRV

SEQ ID NO: 7639 - protein, 187 aa, Vigna unguiculata
MGIDLKAGGKSKKTKRTAPKSDDIYLKLLVKLYRFLVRRTGSNFNAVILKRLFMSKVNKPPLSLSRLIRYTKGKEDKIAVVVGAVTDDIRVYEVPALKVAALRFTETARARIEKAGGECLTFDQLALRAPLGQNTVLLRGPKNAREAVKHFGPAPGVPHSHTKPYVRSKGRKFERARGRRNSRGFRV

SEQ ID NO: 7640 - protein, 187 aa, Zingiber officinale
  misc_feature (27)..(27): Xaa can be any naturally occurring amino acid
  misc_feature (52)..(52): Xaa can be any naturally occurring amino acid
  misc_feature (63)..(63): Xaa can be any naturally occurring amino acid
  misc_feature (137)..(137): Xaa can be any naturally occurring amino acid
  misc_feature (161)..(161): Xaa can be any naturally occurring amino acid
MGIDLVAGGRSKKTRRTAPKSDDVYLXLIVRLYRFLVRRTGSKFNAVILKRXFMSKTNRPPLXLRRLIKFMEGKEDKIAVIVGTVTDDKRVYEVPAIKVTALRFTETARARILKAGGECLTFDQLALRAPLGKNTIXLRGPKNAREAVKHFGRAPGVPHSXTKPYVRSKGRKFEKARGRRNSRGFRV

SEQ ID NO: 7641 - protein, 187 aa, Vitis vinifera
MGIDLVAGGKSKKTKRTAPKSDDIYLKLLVKLYRFLVRRTGSKFNAVILKRLFMSKVNKPPLSLSRLVRYMGGKEGKIAVVVGTVTDDIRVYEVPALKVTALRFTETARARIEKAGGECLTFDQLALRAPLGQNTVLLRGPKNSREAVKHFGKAPGVPHSHTKPYVRSKGRKFERARGRRNSRGFRV

SEQ ID NO: 7642 - protein, 187 aa, Allium cepa
MGIDLIAGGRNKKTKRTATKSDDVYLKLLIKLYKFLVRRTGSKFNAVILKRLLMSRTNRPPLSMRRLITFMKGKENNIGVLVGTVTDDNRVYEVPAMKVAALRFTETARARILKAGGECLTLDQLALRAPLGQNTILLRGPKNAREAVKHFGPAPGVPHSHTKPYVRSKGRKFEKARGRRNSRGYRN

SEQ ID NO: 7643 - protein, 187 aa, Carica papaya
MGIDLVAGGKSKGSKRTAPKSDDIYLKLLVKLYRFLVRRTGSNFNAVILKRLFMSKVNKAPLSLSRLIRFMEGKEGKIAVVVGTVTDDVRVYEVPALKVTALRFTETARARIEKAGGECLTFDQLALRAPLGQNTVLLRGPKNAREAVKHFGPAPGVPHSHTKPYVRSKGRKFERARGRRNSKGFRV

SEQ ID NO: 7644 - protein, 187 aa, Cleome gynandra
MGIDLKAGGKSKKTKRTAPKSDDVYLKLLVKLYRFLVRRTGSKFNAVILKRLFMSKVNKPPLSLSRLIRYMQGKEENIGVIVGTVTDDVRAYEVPALKIAALRFTERARARIEKAGGECLTFDQLALRAPLGQNTVLLRGPKNAREAVKHFGSAPGVPHSHTKPYVRSKGRKFEKARGRRKSRGFKV

SEQ ID NO: 7645 - protein, 187 aa, Cleome spinosa
MGIDLKAGGKSKKTKRTAPKSDDVYLKLLVKLYRFLVRRTGSKFNAVILKRLFMSKVNKPPLSLSRLIRYMEGKEDNIGVIVGTVTDDARVYEVPALKITALRFTERARARIEKAGGECLTFDQLALRAPLGQNTVLLRGPKNAREAVKHFGPTPGVPHSHTKPYVRSKGRKFERARGRRKSRGFKV

SEQ ID NO: 7646 - protein, 187 aa, Cucumis sativus
MGIDLVAGGKSKKTKRTAPKSDDIYLKLLVKLYRFLVRRTGSNFNAVILKRLFMSKVNKPPISLSRLIKYMNGKEGRIAVIVGTVTDDIRVYEVPALKVTALRFTETARARIEKAGGECLTFDQLALRAPLGQNTVLLRGPKNSREAVKHFGPAPGVPHSHTKPYVRSKGRKFERARGKRNSRGYRV

SEQ ID NO: 7647 - protein, 187 aa, Musa acuminata
  misc_feature (139)..(139): Xaa can be any naturally occurring amino acid
  misc_feature (166)..(166): Xaa can be any naturally occurring amino acid
MGIDLVAGGRSKKARRTAPRSDDVYLKLLVKLYRFLVRRTGSKFNAVILKRLFMSKSNRPPISLKRLITFMNGKDNKIAVIVGTVTDDKRVYEVPALKVTALRFTETARARILKAGGECLTFDQLALRAPLGQNTVLLXGPKNAREAVRHFGKAPGVPHSHTKPYXRSKGRKFERARGRRNSRGFRV

SEQ ID NO: 7648 - protein, 187 aa, Manihot esculenta
MGIDLKAGGKRKKTKRTAPKSDDIYLKLLVKLYRFLVRRTGSKFNAVILKRLFMSKINKPPLSLSRLIRFMKGKEDKIAVVVGTVTDDIRVYEVPSLKVTALRFTETARARIEKAGGECLTFDQLALRAPLGQNTVLLRGPKNAREAVKHFGPAPGVPHSHTKPYVRAKGRKFERARGRRNSRGFRV

SEQ ID NO: 7649 - protein, 187 aa, Coffea canephora
MGIDLKAGGKVKKTKRTAPKSHDIYLKLLVKLYRFLVRRTGSRFNAVLLKRLFMSKTNKPPLSLSRLVKFMEGKEDKIAVLVGTVTDDTRVYEVPTLKVAALRFTERARARIEKAGGECLTFDQLALRAPLGQNTVLLRGPKNAREAVKHFGPAPGVPHSHTKPYVRATGRKFERARGRRNSRGFRV

SEQ ID NO: 7650 - protein, 187 aa, Gossypium hirsutum
MGIDLVAGGKSKKTKRTAPKSDDIYLKLLVKLYRFLVRRTGSKFNAVILKRLFMSKVNKPPLSLSRLIQYMKGKEDKIAVVVGTVTDDIRVYEVPALKVTALRFTETARARIEKAGGECLTFDQLALRAPLGQNTVLLRGPKNAREAVKHFGPAPGVPHSHTKPYVRSNGRKFERARGRRNSKGFRV

SEQ ID NO: 7651 - protein, 187 aa, Gossypium hirsutum
MGIDLVAGGKSKKTKRTAPKSDDIYLKLLVKIYRFLVRRTGSKFNAVILKRLFMSKVNKPPLSLSRLIEFMKGKEDKIAVVVGTVTDDIRVYEVPALKVTALRFTETARARIEKAGGECLTFDQLALRAPLGQNTVLLRGPKNAREAVKHFGPAPGVPHSHTKPYVRSRGRKFERARGRRNSKGFRV

SEQ ID NO: 7652 - protein, 187 aa, Gossypium hirsutum
MGIDLVAGGKSKKTKRTAPKSDDIYLKLLVKLYRFLVRRTGSKFNAVILKRLFMSKVNKPPLSLSRLIEFMKGKEDKIAVVVGTVTDDIRVYEVPALKVTALRFTETARARIEKAGGECLTFDQLALRAPLGQNTVLLRGPKNSREAVKHFGPAPGVPHSHTKPYVRSKGRKYERARGRRNSKGFRV

SEQ ID NO: 7653 - protein, 187 aa, Carica papaya
MGIDLIAGGKSKQSKRTAAKSDDIYLKLLVKLYRFLVRRTGSNFNAVILKRLFMSKVNKAPISLSRLVKFMQGKEDKIAVIVGTVTDDLRVYEVPALKVTALRFTETARARIEKAGGECLTFDQLALRAPLGQNTVLLRGPKNAREAVKHFGPAPGVPHSHTKPYVRSKGRKFERARGRRNSRGFRV

SEQ ID NO: 7654 - protein, 79 aa, Jatropha curcas
IPFIYKGPKTLAPPLKHICLAGVARRAAKGGTTMGIDLKAGGKSKKTKRTAPKSDDIYLKLLVKLYRFLVRRTGSNSMR

SEQ ID NO: 7655 - protein, 187 aa, Cicer arietinum
MGIDLKAGGKNKKTKRTSPKSNDIYLKLLVKLYRFLVRRTDSNFNAVILKRLFMSKVNRPPLSLSRLIKYMQGKEGKIGVVVGAVTDDIRVYDVPAIKVTALRFTETARARIEKAGGECLTFDQLALRAPLGQNTVLLRGPKNAREAVKHFGPAPGVPHSHTKPYVRSKGRKFEKARGRRKSRGFRV

SEQ ID NO: 7656 - protein, 187 aa, Cleome gynandra
MGIDLKAGGKSKKTKRTAPKSDDVYLKLLVKLYRFLVRRTGSNFNAVILKRLFMSKVNKPPLSLSRLIRYMQKKEDKIGVIVGTVTDDARVYEVPALKITALRFTERARARIEKAGGECLTFDQLALRAPLGQNTVLLRGPKNAREAVKHFGAAPGVPHSHTKPYVRSKGRKFERARGRRKSRGFKV

SEQ ID NO: 7657 - protein, 187 aa, Cleome spinosa
MGIDLKAGGKSKKTKRTAPKSDDVYLKLLVKLYRFLVRRTGSKFNAVILKRLFMSKVNKPPLSLSRLIRYMQGKKDKIGVIVGTVTDDARVYEVPALKITALRFTERARARIEKAGGECLTFDQLALRAPLGQNTVLLRGPKNAREAVKHFGPAPGVPHSHTKPYVRSKGRKFERARGRRKSRGFKV

SEQ ID NO: 7658 - protein, 187 aa, Persea americana
MGIDLVAGGKSKKTRRTAPKSDDIYLKLIVKLYRFLVRRTGSKFNAVILKRLFMSKVNKAPLSLSRLIQFMKGKEDKIAVVVGCVTDDTRVYEVPALKVTALRFTETARARILNAGGECLTFDQLALRAPLGQNTVLLRGPKNSREAVKHFGKAPGVPHSHTKPYVRSKGRKFEKARGRRNSRGFKA

SEQ ID NO: 7659 - protein, 187 aa, Manihot esculenta
MGIDLKAGGKSKKTKRTAPKSDDIYLKLLVKLYRFLVRRTGSKFNAVILKRLFMSKVNKSPLSLSRLITFMKGKESKIAVVVGTVTNDIRVYEVPALKVTALRFTETARARIEKAGGECLTFDQIALRAPLGQNTVLLRGPKNAREAVKHFGPAPGVPHSHTKPYVRSKGRKFERARGRRNSRGFRV

SEQ ID NO: 7660 - protein, 187 aa, Manihot esculenta
MGIDLKAGGKSKKTKRTAPKSDDIYLKLLVKLYRFLVRRTGSKFNAVILKRLFMSKVNKPPLSLSRLITFMKGKESKIAVVVGTVTNDIRVHEVPALKVTALRFTETARARIEKAGGECLTFDQIALRAPLGQNTVLLRGPKNAREAVKHFGPAPGVPHSHTKPYVRSKGRKFERARGRRNSRGFRV

SEQ ID NO: 7661 - protein, 187 aa, Vitis vinifera
MGIDLVAGGKSKRTKRTAPKSDDIYLKLLVKLYRFLVRRTGSKFNAVILKRLFMSKVNKPPLSLSRLVRYMDGKEGKIAVVVGTVTDDLRVYEVPCLKVTALRFTERARARIEKAGGECLTFDQLALRAPLGQNTVLLRGPKNAREAVKHFGKAPGVPHSHTKPYVRSKGRKFERARGRRNSRGFRV

SEQ ID NO: 7662 - protein, 187 aa, Glycyrrhiza uralensis
MGIDLKAGGKSKKTKRTAPKSNDIYLKLLVKLYRFLVRRTGSNFNAVVLKRLFMSKVNRPPLSLSRLIKYTKGKEDKIAVVVGTVTDDIRVYEVPALKVTALRFTETARARIEKAGGECLTFDQLALRAPLGQNTVLLRGPKNAREAVKHFGPAPGVPHSHTKPYVRAKGRKFEKARGRRNSRGFRN

SEQ ID NO: 7663 - protein, 187 aa, Cucumis melo
MGIDLVAGGKSKKTKRTAPKSDDIYLKLLVKLYRFLVRRTGSNFNAVILKRLFMSKVNKPPISLSRLIKYMKGKEAKIAVVVGTVTDDIRVYEVPALKVTALRFTETARARIEKAGGECLTFDQLALRAPLGQNTVLLRGPKNSREAVKHFGPAPGVPHSHTKPYVRSKGRKFERARGKRNSRGYRV

SEQ ID NO: 7664 - protein, 187 aa, Allium cepa
MGIDLIAGGRNKKTKRTATKSDDIYLKLLIKLYKFLVRRTGSKFNAVILKRLLMSRTNRPPLSMRRLVTFMKGKESSVGVLVGTVTDDNRVYEIPAMKVAALRFTETARARILKAGGECLTLDQLALRAPLGQNTVLLRGPKNAREAVKHFGPAPGVPHSHTKPYVRSKGRKFEKARGRRNSRGYRN

SEQ ID NO: 7665 - protein, 187 aa, Arachis hypogaea
MGIDIKAGGKSKKTKRTAPKSNDIYLKLLVKLYRFLVRRTGSNFNAVILKRLFMSKVNKPPLSLSRLIKFMKGKEGKIAVVVGTVTDDIRVYEVPALKVTALRFTETARARIEKAGGECLTFDQLALRAPLGQNTVLLRGPKNSREAVKHFGPAPGVPHSHTKPYVRSKGRKFERARGRRNSKGFRV

SEQ ID NO: 7666 - protein, 187 aa, Arachis hypogaea
MGIDLKAGGKSKKTKRTAPKSNDIYLKLLVKLYRFLVRRTGSNFNAVILKRLFMSKVNKPPLSLSRLIRYMKGKEDKIAVVVGAVTDDIRVYEVPALKVTALRFTETARARIEKAGGECLTFDQLALRAPLGQNTVLLRGPKNAREAVKHFGPAPGVPHSHTKPYVRAKGRKFERARGRRNSRGFRV

SEQ ID NO: 7667 - protein, 181 aa, Ananas comosus
AGGRSKKARRTAPKSDDVYLKLLVKLYRFLVRRTGSKFNAVILKRLFMSKINRPPISLRRLVSFMSGKGDKTGVIVGTVTDDKRVYEVPAMKVTALRFTETARARIVNAGGECLTLDQLALRAPLGQNTVLLRGPKNAREAVKHFGKAPGVPHSHTKPYVRAKGRKFEKARGRRNSRGFRV

SEQ ID NO: 7668 - protein, 187 aa, Populus trichocarpa
MGIDLKAGGKSKKTKRTAPKSDDIYLKLLVKLYRFLVRRTGSKFNAVILKRLFMSKINKPPLSLSRLITFMKGKEDKIAVVVGTITDDIRVYEVPALKVTALRFTETARARIEKAGGECLTFDQLALRAPLGQNTVLLRGPKNAREAVKHFGPAPGVPHSHTKPYIRSKGRKFEKARGKRNSKGFRV

SEQ ID NO: 7669 - protein, 187 aa, Arabidopsis lyrata
MGIDLIAGGKSKKTKRTAPKSDDVYLKLTVKLYRFLVRRTQSKFNAVILKRLFMSKVNKAPLSLSRLVEFMTGKEDKIAVLVGTVTDDLRVHEIPAMKVTALRFTERARARIEKAGGECLTFDQLALRAPLGQNTVLLRGPKNSREAVKHFGPAPGVPHSHSKPYVRGKGRKFEKARGRRKSRGFKV

SEQ ID NO: 7670 - protein, 134 aa, Cleome gynandra
MSKVNKAPLSLSRLAKFMQGKEDKIGVLVGTVTDDVRLYEVPAMKVTALRFTETARARIEKAGGECLTFDQLALRAPLGQNTVLLRGPKNSREAVKHFGPAPGVPHSHTKPYVRSKGRKFERARGRRKSRGFKV

SEQ ID NO: 7671 - protein, 187 aa, Cucumis sativus
MGIDLVAGGKSKKTKRVAPKSDDIYLKLLVKLYRFLVRRTGSNFNAVILKRLFMSKVNKPPLSLSRLIQFTKGKESKIAVVVGTITDDIRVYEVPALKVAALRFTETARARIEKAGGECLTFDQLALRAPLGQNTVLLRGPKNSREAVKHFGPAPGVPHSHSKPYVRSKGRKFERARGKRNSRGYRV

SEQ ID NO: 7672 - protein, 187 aa, Tropaeolum majus
MGIDLIAGGKNKKTKRTAPKSNDIYLKLLVKLYRFLVRRTGSKFNAVVLKRLFMSKVNKAPISLSRLVKNMTGKEEKIAVIVGAVTDDVRAYEVPAMKVTALRFTETARARIEKAGGECLTFDQLALRAPLGQNTILLRGPKNAREAVKHFGPAPGVPHSHTKPYVRSKGRKFEKARGRRNSRGFRN

SEQ ID NO: 7673 - protein, 187 aa, Malus domestica
MGIDLVAGGKSKKTKRTAPKSDDIYLKLLVKLYRFLVRRTSSKFNAVILKRLFMSKVNKAPLSLSRLIKYMTGKEGKIAVVVGTVTDDIRVYEVPCLKVTALRFTETARARIEKAGGECLTFDQLALRAPLGQNTILLRGPKNAREAVKHFGPAPGVPHSHTKPYVRSKGRKFEKARGKRNSKGFRV

SEQ ID NO: 7674 - protein, 187 aa, Malus domestica
MGIDLVAGGKSKKTKRTAPKSDDIYLKLLVKLYRFLVRRTGSKFNAVILKRLFMSKVNKAPLSLSRLIKYMTGKEGKIAVVVGTVTDDIRVYEVPCLKVTALRFTETARARIEKAGGECLTFDQLALRAPLGQNTILLRGPKNAREAVKHFGPAPGVPHSHTKPYVRSKGRKFEKARGKRNSKGFRV

SEQ ID NO: 7675 - protein, 187 aa, Musa acuminata
  misc_feature (8)..(8): Xaa can be any naturally occurring amino acid
  misc_feature (14)..(14): Xaa can be any naturally occurring amino acid
MGIDLVAXGRSKKXRRTASRSDDVYLKLLVKLYRFLVRRTGSKFNAVILRRLFMSKINRPPISLKRLITFMQGKDDKIAVIVGTVTDDKRVYEVPAMKVTALRFTETARARILKAGGECLTFDQLALRAPLGQNTVLLRGPKNAREAVRHFGKAPGVPHSHTKPYVRSKGRKYERARGRRNSRGFRV

SEQ ID NO: 7676 - protein, 187 aa, Phaseolus coccineus
MGIDLKAGGKSKKTKRTAPKSNDIYLKLLVKLYRFLVRRTGSNFNAVILKRLFMSKVNKPPLSLSRLIKYTKGKEGKIAVVVGTITDDIRVYEVPSLKVTALRFTETARARIEKAGGECLTFDQLALRAPLGQNTVLLRGPKNAREAVKHFGPAPGVPHSNTKPYVRSKGRKFEKARGRRNSRGFRV

SEQ ID NO: 7677 - protein, 187 aa, Phaseolus coccineus
MGIDLKAGGKSKKTKRTAPKSDDIYLKLLVKLYRFLVRRTGSNFNAVILKRLFMSKVNKPPLSLSRLIRYTKGKEDKIAVVVGAVTDDIRVYEVPALKVTALRFTETARARIEKAGGECLTFDQLALRAPLGQNTVLLRGPKNAREAVKHFGPAPGVPHSHSKPYVRAKGRKFERARGRRNSRGFRV

SEQ ID NO: 7678 - protein, 187 aa, Ricinus communis
MGIDLKAGGKSKKTKRTAPKSDDIYLKLLVKLYRFLVRRTGSKFNAVILKRLFMSKINKAPLSLSRLITFMKGKESKTAVVVGTVTDDIRVYEVPALKVTALKFTETARARIEKAGGECLTFDQLAMRAPLGQNTVLLRGPKNAREAVKHFGPAPGVPHSHTKPYVRSKGRKFERARGRRNSRGFRV

SEQ ID NO: 7679 - protein, 403 aa, Ricinus communis
MTRQQLGPTKFSSDEVSSQNQVKASVQRKIRQSIADEYPGLEPVLDDLLPKKSPLIVAKCQNHLNLVMVNSVPLFFNIRDGPYMPTLRLLHQYPNIMKKLQVDRGAIKFVLAGANIMCPGLTSPGGALDEEVEAETPVAIMAEGKQHALAIGFTKMSAKDIKTINKGIGVDNMHYLNDGLWKKNPAINSLQNPSYTFVPFPPLQQQQQQPTSRRASMGIDLKAGGKSKKTKRTAPKSDDIYLKLLVKLYRFLVRRTGSKFNAVILKRLFMSKINKAPLSLSRLITFMKGKESKTAVVVGTVTDDIRVYEVPALKVTALKFTETARARIEKAGGECLTFDQLAMRAPLGQNTVLLRGPKNAREAVKHFGPAPGVPHSHTKPYVRSKGRKFERARGRRNSRGFRV

SEQ ID NO: 7680 - protein, 187 aa, Gossypium hirsutum
MGIDLVAGGKSKKTKRTAPKSDDIYLKLLVKLYRFLVRRTGRKFNAVILKRLFMSKVNKPPLSLSRLIQYMKGKEDKIAVVVGTVTDDIRVYEVPALKVTALRFTETARARIEKADGECLTFDQLALRAPLGQNTVLLRGPKNAREAVKHFGPAPGVPHSHTKPYVRSNGRKFERARGRRNSKGFRV

SEQ ID NO: 7681 - protein, 187 aa, Vigna unguiculata
MGIDLKAGGKSKKTKRTAPKSNDIYLKLLVKLYRFLVRRTGSNFNAVILKRLFMSKVNKPPISLSRLIKYTKGKEGKIAVLVGTVTDDIRVYEVPPLKITALRFTETARARIEKAGGECLTFDQLALRAPLGQNTVLLRGPKNAREAVKHFGPAPGVPHSHTKPYVRSKGRKFEKARGRRNSRGFRV

SEQ ID NO: 7682 - protein, 187 aa, Vigna unguiculata
MGIDLKAGGKSKKTKRTAPKSNDIYLKLLVKLYRFLVRRTGSNFNAVILKRLFMSKVNKAPLSLSRLIKYTKGKEEKIAVVVGTVTDDIRVYEVPSLKVTALRFTETARARIEKAGGECLTFDQLALRAPLGQNTVLLRGPKNAREAVKHFGPAPGVPHSHTKPYVRSKGRKFERARGRRNSRGFRV

SEQ ID NO: 7683 - protein, 187 aa, Zingiber officinale
MGIDLIAGGRSKKVRRTAPKSDDVYLKLLVRLYKFLVRRTGSKFNAIILKRLFMSKTNRPPISLRRLIKFMDGQDNKIAVIVGTVTDDKRVYEVPALKVTALRFTETARARILKAGGECLTFDQLALRSPLGQNTIVLRGPKNAREAVKHFGKAPGVPHSHTKPYVRAKGRKFEKARGRRKSRGFKV

SEQ ID NO: 7684 - protein, 187 aa, Vitis vinifera
MGIDLVAGGKSKKTKRTAPKSDDIYLKLLVKLYRFLVRRTGSKFNAVILKRLFMSKINKPPMSLSRLIRYMQGKEDKIAVLVGTVTDDLRVYEVPTLKVTALRFTERARARIEKAGGECLTFDQLALRAPLGQNTVLLRGPKNAREAVKHFGKAPGVPHSHTKPYVRSKGRKFERARGRRNSRGFRV

SEQ ID NO: 7685 - protein, 187 aa, Glycyrrhiza uralensis
MGIDLKAGGKSKKTKRTAPKSNDIYLKLLVKLYRFLVRRTGSNFNAVVLKRLFMSKVNRPPLSLSRLIKYMQGKEGKIAVVVGTITDDIRVYEVPSLKVTALRFTETARARIEKAGGECLTFDQLALRAPLGQNTVLLRGPKNAREAVKHFGPAPGVPHSHTKPYVRAKGRKFERARGRRNSRGFRV

SEQ ID NO: 7686 - protein, 187 aa, Cucumis melo
MGIDLVAGGKSKKTRRVAPKSDDIYLKLLVKLYRFLVRRTGSNFNAVILKRLFMSKVNKPPLSLSRLIQFMKGKESKIAVVVGTITDDIRVYEVPALKVAALRFTETARARIEKAGGECLTFDQLALRAPLGQNTVLLRGPKNSREAVKHFGPAPGVPHSHSKPYVRSKGRKFERARGKRNSRGYRV

SEQ ID NO: 7687 - protein, 187 aa, Populus trichocarpa
MGIDLKAGGKSKKTKRTAPKSDDIYLKLLVKLYRFLVRRTGSKFNAVILKRLFMSKINKPPLSLSRLITFTKGKEDKIAVVVGTITDDIRVYEVPALKVTALRFTETARARIEKAGGECLTFDQLALRAPLGQNTVLLRGPKNAREAVKHFGPAPGVPHSHTKPYIRSKGRKFEKARGKRNSKGFRV

SEQ ID NO: 7688 - protein, 187 aa, Populus trichocarpa
MGIDLKRGGKSKKTKRTAPKSDDIYLKLLVKLYRFLVRRTGSRFNAVILKRLFMSKINKAPLSLSRLITFMKGKEDKIAVLVGTVTDDIRVYEVPALKVTALRFTETARARIEKAGGECLTFDQLALRAPLGQNTVLLRGPKNAREAVKHFGPAPGVPHSHTKPFVRAKGRKFEKARGKRNSRGFRV

SEQ ID NO: 7689 - protein, 187 aa, Populus trichocarpa
MGIDLKAGGKSKKTKRTAPKSDDIYLKLLVKLYRFLVRRTGSKFNAVILKRLFMSKTNKPPLALSRLITYMKGKEGKIAVVVGTITDDIRVYEVPALKVTALRFTETARARIEKAGGECLTFDQLALRAPLGQNTVLLRGPKNAREAVKHFGPAPGVPHSHTKPYIRSKGRKFEKARGKRNSKGFRV

SEQ ID NO: 7690 - protein, 186 aa, Papaver somniferum
MGIDLIAGGKSKKTKRTAPKSDDIYLKLLVKLYRFLVRRTGSNFNAVILKRLFMSKVNKAPLSLSRLIKFMEGKDEKIAVLVGTVTDDVRTYEVPKMKVAALRFTETTRARIEKAGGECLTFDQLALRAPLGQNTVLLRGPKNSREAVKHFGAPGVPHSHSKPYVRSKGRKFEKARGKRNSRGFRV

SEQ ID NO: 7691 - protein, 187 aa, Prunus persica
MGIDLVAGGKSKKTKRTAPKSDDIYLKLLVKLYRFLVRRTGSKFNAVILKRLFMSKVNKAPLSLSRLIRYMQGKDNKIAVVVGTVTDDIRVYEVPQLKVTALRFTETARARIEKAGGECLTFDQLALRAPLGQNVVLLRGPKNAREAVKHFGPAPGVPHSHTKPYVRSKGRKFEKARGKRNSKGFRV

SEQ ID NO: 7692 - protein, 187 aa, Prunus persica
MGIDLVAGGKSKKTKRTAPKSDDIYLKLLVKLYRFLVRRTGSKFSAVILKRLFMSKVNKAPLSLSRLIRYMNGKDGKIAVVVGTVTDDIRVYEVPALKVTALRFTETARARIEKAGGECLTFDQLALRAPLGQNTVLLRGPKNAREAVKHFGPAPGVPHSHTKPYVRSKGRKFEKARGKRNSKGFRV

SEQ ID NO: 7693 - protein, 187 aa, Glycine max
MGIDLKAGGKSKKTKRTAPKSDDIYLKLLVKLYRFLVRRTGSNFNAVVLKRLFMSKVNKPPLSLSRLIRYTKGKEDKIAVVVGAVTDDIRVYEVPALKVTALRFTETARARIEKAGGECLTFDQLALRAPLGQNTVLLRGPKNAREAVKHFGPAPGVPHSHTKPYVRAKGRKFERARGRRNSRGFRV

SEQ ID NO: 7694 - protein, 187 aa, Juglans hindsii x Juglans regia
MGIDLVAGGKIKKSKRTAPKSDDIYLKLLVKLYRFLVRRTGSKFNAVILKRLFMSKTNKPPLSLSRLIRYMKGKDGKIAVVVGTVTDDIRVYEVPALKVTALRFTETARARIEKAGGECLTFDQLALRAPLGQNTVLLRGPKNAREAVKHFGPAPGVPHSHSKPYVRSKGRKFERARGKRNSKGFRV

SEQ ID NO: 7695 - protein, 172 aa, Triticum aestivum
RTAPKSDDVYLKLLVKLYRFLVRRTKSQFNAVILKRLFMSKTNRPPLSMRRLVRFMEGKEDKIAVIVGTITDDQRVYEIPAMKVAALRFTETARARIVNAGGECLTFDQLALRAPLGQNTLLLRGPKNAREAVRHFGKAPGVPHSHTKPYVRSKGRKFEKARGRRNSRGFKV

SEQ ID NO: 7696 - protein, 187 aa, Unknown
  Sequence found in Organisms: Ipomoea nil, Ipomoea nil
MGIDLKAGGKSKQTKRTAPKSDDVYLKLLVKLYRFLVRRTGSKFNAVILKRLFMSKTNKPPVSLSRLITFMSGKEDKIAVLVGTITDDVRAYEVPALKVCALRFTKTARARIEKAGGECLTFDQLALRAPLGQNTVLLRGPKNAREAVKHFGPAPGVPHSHTKPYVRAKGRKFERARGKRNSRGYKV

SEQ ID NO: 7697 - protein, 187 aa, Orobanche aegyptiaca
MGIDLVAGGKSKKTKRTAPKSNDIYLKLLVKLYRFLVRRTGSRFNAVILKRLFMSKINRPPLSLSRLSALMKGKENQIAVLVGTVTDDVRVDEIPAMKVTALRFTETARARIEKAGGECLTFDQLALRAPLGQNTVLLRGSRKAREAVRHFGPAPGVPHSHTKPYVRAKGRKFERARGKRNSRGFRV

SEQ ID NO: 7698 - protein, 187 aa, Malus domestica
MGIDLVAGGKSKKTKRTAPKSDDIYLKLLVKLYRFLVRRTASKFNAVILKRLFMSKVNKAPLSLSRLIKYMQGKDNKIAVVVGTITDDIRVYEVPQMKVTALRFTETARARIEKAGGECLTFDQLALRAPLGQNVVLLRGPKNSREAVKHFGPAPGVPHSHTKPYVRSKGRKFEKARGKRNSKGFRV

SEQ ID NO: 7699 - protein, 187 aa, Citrus sinensis
MGIDLIAGGKSKKSKRTAPKSNDIYLKLLVKLYRFLVRRTDSNFDKVILKRLFMSKVNKPPMSLSRLTKFMKGKEDKIAVVVGTVTDDIRVYEVPALKVTALRFTETARARIEKAGGECLTFDQLALRAPLGQNTVLLRGPKNAREAVKHFGPAPGVPHSHTKPYVRSKGRKFERARGKRNSRGFRV

SEQ ID NO: 7700 - protein, 187 aa, Eucalyptus gunnii
MGIDLKAGGKSKKTKRTAPKSDDIYLKLLVKLYRFLVRRTGSKFNAVVLKRLFMSKVNKPPLSLSRLIRYTQGKEDKIAVVVGTITDDIRVHEVPALKVTALRFTETARARIEKAGGECLTFDQLALRAPLGQNTVLLRGPKNAREAVKHFGPAPGVPHSHTKPYVRSKGRKFERARGRRNSRGFRV

SEQ ID NO: 7701 - protein, 187 aa, Arachis hypogaea
MGIDLKAGGKSKKTKRTAPKSNDIYLKLLVKLYRFLVRRTNSNFNAVILKRLFMSKVNKPPLSLSRLIKYTKGKEGKIAVVVGTITDDIRVYDVPPLKVTALRFTETARARIEKAGGECITFDQLALRAPLGQNTVLLRGPKNAREAVKHFGPAPGVPHSHTKPYVRSKGRKFEKARGRRNSRGFRV

SEQ ID NO: 7702 - protein, 187 aa, Glycine max
MGIDLKAGGKSKKTKRTAPKSNDIYLKLLVKLYRFLVRRTGSNFNAVILKRLFMSKVNKPPLSLSRLIRYTKGKEDKIAVVVGAVTDDIRVYEVPALKVTALRFTETARARIEKAGGECLTFDQLALRAPLGQNTVLLRGPKNAREAVKHFGPAPGVPHSHTKPYVRAKGRKFERARGKRNSRGFRV

SEQ ID NO: 7703 - protein, 187 aa, Helianthus annuus
MGIDLVAGGKSKRTKRTAPRSDDIYLKLLVKLYRFLVRRTGSNFNAVILKRLFMSKINKPPISLSRLIRYMSGKEDKIAVVVGTVTDDVRVHEIPCIKVTALRFTETARARIEKAGGECLTFDQLALRAPLGQNTVLLRGPKNAREAVKHFGPAPGVPHSHTKPYVRSKGRKFEKARGRRNSRGFRN

SEQ ID NO: 7704 - protein, 188 aa, Triphysaria pusilla
MGIDLVAGGKNKKTKRTAPKSNDIYLKLIVKLYRFLVRRTGSSFNAVILKRLFMSKVNRPPLSLSRLVAHMKGKDNQIAVLVGTVTDDIRLQEEVPAIKVTALRFTETARARIEKAGGECLTFDQLALRAPLGQNTVLLRGSRKAREAVKHFGPAPGVPHSHTKPYVRAKGRKFEKARGKRNSKGFRV

SEQ ID NO: 7705 - protein, 87 aa, Ipomoea nil
MGIDLKAGGKSKQTKRTAPKSDDVYLKLLVKLYRFFGEEDRKQVQRCDSEASVYEQDQQASTVSLKADLFHVWKGGQDCCPGGYYHG

SEQ ID NO: 7706 - protein, 187 aa, Eschscholzia californica
MGIDLVAGGKSKKTKRTAPKSDDIYLKLLVKLYRFLVRRTESKFNAVILKRLFMSKVHKAPLSLSRLISYTKGKEGKIAVLVGTITDDTRVYEVPAIKVAALRFTETARARIEKAGGECLTFDQLALRAPLGQNTVLLRGPKNSREAVKHFGRAPGVPHSHSKPYVRSKGRKFEKARGKRNSRGFRV

SEQ ID NO: 7707 - protein, 187 aa, Unknown
  Sequence found in Organisms: Ipomoea nil, Ipomoea batatas
MGIDLKAGGKSKQTKRTAPKSDDVYLKLLVKLYRFLVRRTGSKFNAVILKRLFMSKTNKPPVSLSRLITFMSGKEDKIAVLVGTITDDVRAYEVPALKVCALRFTKTARARIEKAGGECLTFDQLALRAPLGQNTVLLRGPKNSREAVKHFGPAPGVPHSHTKPYVRAKGRKFERARGKRNSRGYKV

SEQ ID NO: 7708 - protein, 187 aa, Ipomoea nil
MGIDLKAGGKSKQTKRTAPKSDDVYLKLLVKLYRFLVRRTGSKFNAVILKRLFMSKTNKPPLSLSRLISFTSGKEDKIAVLVGTITDDVRAYEVPALKVCALRFTKTARARIEKAGGECLTFDQLALRAPLGQNTVLLRGPKNSREAVKHFGPAPGVPHSHTKPYVRAKGRKFERARGKRNSRGYKV

SEQ ID NO: 7709 - protein, 187 aa, Ipomoea nil
MGIDLVAGGKSKQTKRTAPKSDDVYLKLLVKLYRFLVRRTESKFNAAILKRLFMSKTNKAPLSLSRLIQFIQGKEDKIAVLVGTVTDDTRAYEVPKMKVAALRFTETARARIEKAGGECLTFDQLALRAPLGQNTVLLRGPKNSREAVKHFGRAPGVPHSHIKPYVRSKGRKFERARGKRNSRGYKI

SEQ ID NO: 7710 - protein, 187 aa, Tropaeolum majus
MGIDLIAGGKSKKTRRTAPKSDDIYLKLLVKLYRFLVRRTGSKFNSVILKRLFMSKVNKPPISISRLVKYMEGKEDKIAVIVGAVTDDLRAYEVPKMKVTALRFTETARARIEKAGGECLTFDQLALRAPLGQNTILLRGPKNSREAVKHFGPAPGVPHSHTKPYVRSKGRKFEKARGRRNSRGFRN

SEQ ID NO: 7711 - protein, 187 aa, Solanum phureja
MGIDLVAGGKSKKTKRIAPKSDDVYLKLLVKLYRFLARRTGSKFNAVILKRLFMSKINKAPLSLSRLVTYMTGKEDNIAVIVGTVTDDVRAYEVPKIKVTALRFTETARARIEKAGGECLTFDQLALRAPLGQNTVLLRGPKNSREAVKHFGKAPGVPHSHTKPYVRAKGRKFERARGKRNSRGYKV

SEQ ID NO: 7712 - protein, 187 aa, Arabidopsis thaliana [sequence omitted]

SEQ ID NO: 7713 - protein, 187 aa, Unknown
  Sequence found in Organisms: Brassica napus, Brassica oleracea, Brassica rapa, Raphanus sativus
MGIDLIAGGKSKKTKRTAPKSDDVYLKLTVKLYRFLVRRTQSKFNAVILKRLFMSKVNKAPLSLSRLVEFMTGKEDKIAVLVGTITDDLRVHEIPAIKVTALRFTERARARIEKAGGECLTFDQLALRAPLGQNTVLLRGPKNSREAVKHFGPAPGVPHSHSKPYVRSKGRKFEKARGKRKSRGFKV

SEQ ID NO: 7714 - protein, 187 aa, Unknown
  Sequence found in Organisms: Centaurea maculosa, Carthamus tinctorius
MGIDLVAGGKSKKTKRTAPRSDDIYLKLLVKLYRFLVRRTGSNFNAVILKRLFMSKINKPPISLSRLVRYMSGKDDKIAVIVGTVTDDVRVHEIPCMKVTALRFTETARARIEKAGGECLTFDQLALRAPLGQNTVLLRGPKNCREAVRHFGKAPGVPHSHTKPYVRAKGRKFEKARGRRNSRGFRN

SEQ ID NO: 7715 - protein, 187 aa, Cryptomeria japonica
MGIDLVAGGKSKKTKRTAPKSDDIYLKLLVKLYRFLVRRTSSSFNAVVLKRLFMSKIHKAPLSLSRLVRYMEGKEGSTAVLVGTVTDDKRLYELPALKVVALRFTETARARILKAGGECLTFDQLALLAPLGQNTVLLRGPKSHREAVKHFGKAPGVPHSHTKPYVRSKGRKFEKARGRRNSRGYKV

SEQ ID NO: 7716 - protein, 187 aa, Cynara scolymus
MGIDLVAGGKSKKTKRTAPRSDDIYLKLLVKLYRFLVRRTGSNFNAVILKRLFMSKINKPPISLSRLIRYMSGKEDKIAVIVGTVTDDVRVHEIPCMKVTALRFTETARARIEKAGGECLTFDQLALRAPLGQNTVLLRGPKNCREAVRHFGKAPGVPHSHTKPYVRAKGRKFEKARGRRNSRGFRN

SEQ ID NO: 7717 - protein, 187 aa, Liriodendron tulipifera
MGIDLVAGGRSKKTKRTAPKSNDIYLKLLVKLYRFLVRRTGSKFNAVILKRLFMSKVNKPPISLSKLIHFTKGKEDKIAVIVGTVTDDIRIHEVPALKVTALRFTERARARIVKAGGECLTFDQLALRAPLGQNTVLLRGRKNSREAVKHFGKAPGVPHSHTKPYVRSKGRKFERARGRRNSRGFRV

SEQ ID NO: 7718 - protein, 187 aa, Petunia hybrida
MGIDLKAGGKSKKTKRTAPKSDDVYLKLLVKLYRFLVRRTGSKFNAVILKRLFMSKINKPPLSLSRLINYAKGKDDKIAVIVGSITDDARAYDVPALKVCALRFTKTARARIEKAGGECLTFDQLALRAPLGQNTVLLRGPKNAREAVKHFGPAPGVPHSHTKPYVRSKGRKFERARGRRKSRGYKV

SEQ ID NO: 7719 - protein, 187 aa, Populus trichocarpa
MGIDLKAGGKSKKTKRTAPKSDDIYLKLLVKLYRFLVRRTQSKFNAVILKRLFMSKINKAPLSLSRLITYTKGKEGKIAVVVGTVTDDIRVYEVPTLKVTALRFTETARARIEKAGGECLTFDQLALRAPLGQNTVLLRGPKNAREAVKHFGPAPGVPHSHTKPYVRAKGRKFEKARGKRNSKGFRV

SEQ ID NO: 7720 - protein, 187 aa, Raphanus sativus
MGIDLIAGGKSKKTKRTAPKSDDVYLKLTVKLYRFLVRRTQSKFNAVILKRLFMSKVNKAPLSLSRLVEFMAGKEDKIAVLVGTITDDLRVHEIPAIKVTALRFTERARARIEKAGGECLTFDQLALRAPLGQNTVLLRGPKNSREAVKHFGPAPGVPHSHSKPYVRSKGRKFEKARGKRKSRGFKV

SEQ ID NO: 7721 - protein, 187 aa, Glycine max
MGIDLKAGGKSKKTKRTAPKSNDIYLKLLVKLYRFLVRRTGSNFNAVILKRLFMSKVNKPPLSLSRLIKYTKGKEDKIAVVVGSITDDIRVYEVPPLKVTALRFTETARARIEKAGGECLTFDQLALRAPLGQNTVLLRGPKNAREAVKHFGPAPGVPHSHTKPYVRAKGRKFERARGRRNSRGFRV

SEQ ID NO: 7722 - protein, 187 aa, Glycine max
MGIDLKAGGKSKKTKRTAPKSNDIYLKLLVKLYRFLVRRTGSKFNAVILKRLFMSKVNKPPLSLSRLIKYTKGKEDKIAVVVGNITDDIRVYEVPALKVTALRFTETARARIEKAGGECLTFDQLALRAPLGQNTVLLRGPKNAREAVKHFGPAPGVPHSHTKPYVRAKGRKFERARGRRNSRGFRV

SEQ ID NO: 7723 - protein, 187 aa, Nicotiana tabacum
MGIDLKAGGKSKKTKRTAPKSDDVYLKLLVKLYRFLVRRTGSKFNAVILKRLFMSKTNKPPLSLSRLISYAKGKEGKIAVIVGTITDDVRAYDVPTLKVCALRFTKTARARIEKAGGECLTFDQLALRAPLGQNTLLLRGPKNAREAVKHFGPAPGVPHSHTKPYVRSKGRKFERARGRRKSRGYKV

SEQ ID NO: 7724 - protein, 187 aa, Nicotiana tabacum
MGIDLKAGGKNKKTKRTAPKSDDVYLKLLVKLYRFLVRRTGSKFNTVILKRLFMSKTNKPPLSLSRLISYTKGKEDKIAVIVGSVTDDVRAYEVPTLMVCALRFTKTARARIEKAGGECLTFDQLALRAPLGQNTVLLRGPKNAREAVRHFGPAPGVPHSHTKPYVRSKGRKFERARGRRKSRGYKV

SEQ ID NO: 7725 - protein, 188 aa, Triphysaria pusilla
  misc_feature (13)..(13): Xaa can be any naturally occurring amino acid
MGIDLVAGGKNKXTKRTAPKSNDIYLKLIVKLYRFLVRRTGSSFNAVILKRLFMSKVNRPPLSLSRLVAHMKGKDNQIAVLVGTVTDDIRLQEEVPAIKVTALRFTETARARIEKAGGECLTFDQLALRAPLGQNTVLLRGSRKAREAVKHFGPAPGVPHSHTKPYVRAKGRKFEKARGKRNSKGFRV

SEQ ID NO: 7726 - protein, 187 aa, Gerbera hybrid cultivar
MGIDLVAGGKSKRTKRTAPRSDDIYLKLLVKLYRFLVRRTGSNFSAVVLKRLFMSKVNKPPISLSRLIRYMSGKEDKIAVIVGTVTDDVRVHEIPCMKVTALRFTETARARIEKAGGECLTFDQLALRAPLGQNTVLLRGPKNSREAVRHFGPAPGVPHSHTKPYVRSKGRKFEKARGRRNSRGFRN

SEQ ID NO: 7727 - protein, 187 aa, Lotus japonicus
MGIDLKAGGKSKKTKRTAPKSNDIYLKLLVKLYRFLVRRTGSNFNSVILKRLFMSKVNKAPLSLSRLIRYTKGKEGKIAVVVGAVTDDIRVYEVPALKVAALRFTETARARIEKAGGECLTFDQLALIAPLGQNTVLLRGPKNAREAVKHFGPAPGVPHSHTKPYVRSNGRKFEKARGKRNSKGFRV

SEQ ID NO: 7728 - protein, 187 aa, Pisum sativum
MGIDLKAGGKNKKSKRTAPKSNDIYLKLLVKLYRFLVRRTGSNFNAVILKRLFMSKVNKPPLSLSRLIKYTKGKEGKLAVVVGTVTDDIRVYDVPAIKVTALRFTETARARIEKAGGECLTFDQLPLRAPLGQNTVLLRGPKNAREAVKHFGRAPGVPHSHTKPYVRAKGRKFEKARGKRNSRGFRV

SEQ ID NO: 7729 - protein, 187 aa, Malus domestica
MGIDLVAGGKSKKTKRTAPKSDDIYLKLLVKLYRFLVRRTGSKFNAVILKRLFMSKVNKAPLSLSRLIKYMQGKDSKIAVVVGTVTDDIRVYEVPQLKVTALRFTETARARIEKAGGECLAFDQLALRAPLGQNVVLLRGPKNSREAVKHFGPAPGVPHSHTKPYVRSKGRKFEKARGKRNSKGFRV

SEQ ID NO: 7730 - protein, 187 aa, Arabidopsis thaliana
MGIDLIAGGKSKKTKRTAPKSDDVYLKLTVKLYRFLVRRTNSKFNGVILKRLFMSKVNKAPLSLSRLVEFMTGKEDKIAVLVGTITDDLRVHEIPAMKVTALRFTERARARIEKAGGECLTFDQLALRAPLGQNTVLLRGPKNSREAVKHFGPAPGVPHSHSKPYVRAKGRKFEKARGKRKSRGFKV

SEQ ID NO: 7731 - protein, 187 aa, Brassica juncea
  misc_feature (66)..(66): Xaa can be any naturally occurring amino acid
MGIDLIAGGKSKKTKRTAPKSDDVYLKLTVKLYRFLVRRTQSKFNAVILKRLFMSKVNKAPLSLSXLVEFMTGKEDKIAVLVGTITDDLRVHEIPAIKVTALRFTERARARIEKAGGECLTFDQLALRAPLGQNTVLLRGPKNSREAVKHFGPAPGVPHSHSKPYVRSKGRKFEKARGKRKSRGFKV

SEQ ID NO: 7732 - protein, 187 aa, Unknown
  Sequence found in Organisms: Brassica napus, Brassica oleracea
MGIDLIAGGKSKKTKRTAPKSDDVYLKLTVKLYRFLVRRTQSKFNAVILKRLFMSKVNKAPLSLSRLVEFMTGKEDKIAVLVGTITDDLRVHEIPAIKVTALRFTERARARIEKAGGECLTFDQLALRAPLGQNTVLLRGPKNSREAVKHFGRAPGVPHSHSKPYVRSKGRKFEKARGKRKSRGFKV

SEQ ID NO: 7733 - protein, 187 aa, Brassica rapa
MGIDLIAGGKSKKTKRTAPKSDDVYLKLTVKLYRFLVRRTQSKFNAVILKRLFMSKVNKAPVSLSRLVEFMTGKEDKIAVLVGTITDDLRVHEIPAIKVTALRFTERARARIEKAGGECLTFDQLALRAPLGQNTVLLRGPKNSREAVKHFGPAPGVPHSHSKPYVRSKGRKFEKARGKRKSRGFKV

SEQ ID NO: 7734 - protein, 187 aa, Phaseolus coccineus
MGIDLKAGGKSKKTKRTAPKSNDIYLKLLVKLYRFLVRRTGSNFNAVILKRLFMSKVNKPPLSLSRLIRYTKGKEDKIAVVVGTITDDIRVYEVPQLKITALKFTERARARIEKAGGECLTFDQLALRAPLGQNTVLLRGPKNAREAVKHFGPAPGVPHSHSKPYVRSKGRKFEKARGRRNSRGFRV

SEQ ID NO: 7735 - protein, 187 aa, Unknown
  Sequence found in Organisms: Castanea mollissima, Quercus alba
MGIDLVAGGKVKKSKRTAPKSNDIYLKLLVKLYRFLVRRTGSNFNAVILKRLFMSKVNKPPLSLSKLIRYMEGKDGKIAVVVGTVTDDIRVYEVPALKVTALRFTETARARIEKAGGECLTFDQLALRAPLGQNTILLRGPKKGREAVKHFGPAPGVPHSHTKPYVRAKGRKFERARGKRNSRGFRV

SEQ ID NO: 7736 - protein, 186 aa, Gossypium hirsutum
MGIDLVAGGKSKKTKRTAPKSDDIYLKLIVKLYRFLVRTGSKFNAVILKRLFMCKVNKPPLPLSRLIEFMKGKEDKIAVVVGTVTDDIRIYEVPALKVTALRFTKTARARIDKAGGECLTFDQLALRAPLGQNTVLLRGPKNAREAVKHFGPAPGVPHSHTKPYVRSKARKFERARGRRNSKGFRV

SEQ ID NO: 7737 - protein, 187 aa, Adiantum capillus-veneris
MGIDLPAGGRNKKTKRTAPKSDNVYLKLIVKLYRFLVRRTGSPFNAVVLKRLFMSRTNRPPLSLSRLIRYMKGKEDKIGVVVGTVTDDVRVYEVPALKVAALRFTETARARILKAGGECFTFDQLALKAPTGSNTILLRGPKNAREAVKHFGRAPGVPHSHTKPYVRSKGRKFERARGRRNSRGYRV

SEQ ID NO: 7738 - protein, 187 aa, Actinidia deliciosa
MGIDLKAGGKSKKTKRTAPRSQDIYLKLLVKLYRFLVRRTGSKFNAVILKRLFMSKVNKPPISLSRLIRFTKGKEGKIAVIVGTITDDIRVHEVPCLKVAALRFTETARARIEKAGGECLTFDQLALRAPLGQNTVLLRGPKNAREAVKHFGKAPGVPHSHTKPYVRSKGRKFERARGRRNSRGFRN

SEQ ID NO: 7739 - protein, 187 aa, Lotus japonicus
MGIDLKAGGKSKKTKRIAPKSNDIYLKLLVKLYRFLVRRTGSNFNAVILKRLFMSKVNKPPISLSRLIKYAKGKEDKVVVIVGTVTDDIRVYEVPALKVTALRFTETARARIEKAGGECLTFDQLALRAPLGQNTVLLRGPKNAREAVKHFGPAPGVPHSHTKPYVRSKGRKFEMARGKRNSKGFRV

SEQ ID NO: 7740 - protein, 187 aa, Pinus taeda
MGIDLIAGGKSKKTKRTAPKSQDIYLKLLVKLYRFLVRRTNSSFNAVILKRLFMSKTNKPPLSLSRLVRYMQGKDDKIAVVVGTITDDNRIYELPPVKVTALRFTETARARILKAGGECLTFDQLALRAPLGQNTVLLRGPKSHREAVKHFGRAPGVPHSHTKPYVRSKGRKFEMARGRRNSRGFKV

SEQ ID NO: 7741 - protein, 187 aa, Raphanus sativus
MGIDLIAGGKSKKTKRTAPKSDDVYLKLIVKLYRFLVRRTQSKFDAVILKRLFMSKVNKAPLSLSRLVEFMTGKEDKIAVLVGTITDDLRVHEIPAIKVTALRFTERARARIEKAGGECLTFDQLALRAPLGQNTVLLRGPKNSREAVKHFGPAPGVPHSHSKPYVRSKGRKFEKARGKRKSRGFKV

SEQ ID NO: 7742 - protein, 187 aa, Senecio madagascariensis
MGIDLVAGGKSKRTKRTAPRSDDIYLKLIVKLYRFLVRRTGSSFNAVILKRLFMSKVNRPPISLSRLVRYMSAKEDKIAVIVGTVTDDVRVHEIPCMKVTALRFTETARARIEKAGGECLTFDQLALRAPLGQNTVLLRGPKNSREAVRHFGKAPGVPHSHTKPYVRSKGRKFEKARGRRNSRGFRN

SEQ ID NO: 7743 - protein, 187 aa, Glycine max
MGIDLKAGGKSKKTKRTAPKSNDIYLKLLVKLYRFLVRRTGSNFNAVILKRLFMSKVNKPPISLSRLIKYTKGKEDKIAVIVGTVTDDIRVYEVPALKITALKFTERARARIEKAGGECLTFDELALRAPLGQNTVLLRGPKNAREAVKHFGPAPGVPHSHTKPYVRAKGRKFERARGRRNSRGFRV

SEQ ID NO: 7744 - protein, 187 aa, Glycine max
MGIDLKAGGKSKKTKRTAPKSNDIYLKLLVKLYRFLVRRTDSNFNAVILKRLFMSKVNKPPISLSRLIKYTKGKEDKIAVVVGTVTDDIRVYEVPALKITALKFTERARARIEKAGGECLTFDQLALRAPLGQNTVLLRGPKNAREAVKHFGPAPGVPHSHTKPYVRAKGRKFERARGRRNSRGFRV

SEQ ID NO: 7745 - protein, 187 aa, Picea glauca
MGIDLVAGGKSKKTKRTAPKSEDIYLKLLVKLYRFLVRRTSSSFNAVILKRLFMSKTNKPPLSLSRLARYMQGKDDKIAVVVGTITDDNRVYELPPVKVTALRFTETARARILKAGGECLTFDQLALRAPLGQNTVLLRGPKSHREAVKHFGRAPGVPHSHTKPYVRSKGRKYEMARGRRNSRGFKV

SEQ ID NO: 7746 - protein, 187 aa, Euphorbia esula
MGIDLKAGGKSKKTKRTEPKSDDIYLKLLVKLYRFLVRRTGSKFNAVILKRLFMSKINKTPLSLSRLIKYMEGKDGKIAVVVGTITDDIRVYEVPALKVTALRFTETARARIEKAGGECLTFDQLALRAPLGQNTILLRGPKNSREAVKHFGPAPGVPHSHTKPYVRAKGRKFEKARGKRNSRGFRV

SEQ ID NO: 7747 - protein, 187 aa, Helianthus annuus
MGIDLIAGGKSKRTKRTAPRSDDIYLKLLVKLYRFLVRRTGSNFNAVILKRLFMSKVNKPPISLSRLIRYMSGKDDKIAVVVGTVTDDVRVHEIPCMKVTALRFTETARARIEKAGGECLTFDQLALRAPLGQNTVLLRGPKNSREAVKHFGPAPGVPHSHTKPYVRSKGRKFEKARGRRNSRGFRN

SEQ ID NO: 7748 - protein, 187 aa, Helianthus annuus
MGIDLVAGGKSKRTKRTAPRSDDIYLKLLVKLYRFLVRRTGSNFNAVILKRLFMSKVNKPPISLSRLIRYMSAKEDKIAVVVGTVTDDVRVHEIPCIKVTALRFTETARARIEKAGGECLTFDQLALRAPLGQNTVLLRGPKNSREAVKHFGPAPGVPHSHTKPYVRSKGRKFEKARGRRNSRGFRN

SEQ ID NO: 7749 - protein, 187 aa, Thellungiella halophila
  misc_feature (10)..(10): Xaa can be any naturally occurring amino acid
MGIDLIAGGXSKKTKRTAPKSDDVYLKLLVKLYRFLVRRSGSKFNAVILKRLFMSKVNKAPLSLSRLVTFMKGKEGKIAVLVGTITDDLRIHEIPAMKVTALRFTERARARIEKAGGECLTFDQLALKAPLGQNTVLLRGPKNSREAVKHFGLAPGVPHSNTKPYVRSKGRKFEKARGRRKSRGFKV

SEQ ID NO: 7750 - protein, 187 aa, Nicotiana tabacum
MGIDLVAGGKSKKTKRTAPKSDDVYLKLLVKLYRFLVRRTGSQFNAVILKRLFMSKINKAPLSLSRLITYMKGKEDKVAVVVGTVTDDVRAYEVPSLKVTALRFTETARARIEKAGGECLTFDQLALRAPLGQNTVLLRGPKNSREAVKHFGRAPGVPHSHTKPYVRAKGRKFERARGKRKSRGFKV

SEQ ID NO: 7751 - protein, 187 aa, Eschscholzia californica
MGIDLVAGGKSKKTKRTAPKSDDIYLKLLVKLYRFLVRRTESKFNAVILKRLFMSKVHKAPLSLSRLITYTKGKEGKIAVLVGTVTDDTRVYEVPAIKVAALRFTETARARIEKAGGECLTFDQLALRAPLGQNTVLLRGPKNSREAVKHFGRAPGVPHSHSKPYVRSKGGNSKRLEEKEQQGVQGL

SEQ ID NO: 7752 - protein, 75 aa, Brassica napus
MGIDLIAGGKSKKTKRTAPKSDDVYLKLTVKLYRFLVRRTQSKFNAVILKRLFMSKVNKAPLSLSRLVEYDRQGR

SEQ ID NO: 7753 - protein, 187 aa, Coffea canephora
MGIDLKAGGKSKKTKRTAPKSDDIYLKLLVKLYRFLVRRTGSKFNVVILKRLFMSKINKPALSLSRLITYTKGKEDKIAVVVGTVTDDTRVYEVPSLKVTALRFTETARARIEKAGGECLTFDQLALRAPLGQNTVLLRGPKNSREAVKHFGPAPGVPHSNTKPYVRSSGRKFERARGRRNSRGFRV

SEQ ID NO: 7754 - protein, 187 aa, Solanum melongena
MGIDLVAGGKSKKTKRTAPKSDDVYLKLLVKLYRFLTRRTGSKFNAVILKRLFMSKINKAPLSLSRLITYMKGKEDKVAVVVGTVTDDIRAYDVPSLKVTALRFTETARARIEKAGGECLTFDQLALRAPLGQNTVLLRGPKNSREAVKHFGKAPGVPHSHTKPYVRSKGRKFERARGKRNSRGYKV

SEQ ID NO: 7755 - protein, 187 aa, Ipomoea batatas
MGIDLKAGGKSKQTKRTAPKSDDVYLKLLVKLYRFLVRRTGSKFNAVILKRLFMSKTNKPPLSLSKLISYMCGKDDKIAVLVGTITDDVRAYEVPALKVCALRFTKTARARIEKAGGECLTFDQLALRAPLGQNTVLLRGPKNSREAVKHFGPAPGVPHSHTKPYVRAKGRKFERARGKRNSRGYKV

SEQ ID NO: 7756 - protein, 186 aa, Physcomitrella patens
MGIDLKAGGRNKKTKRTAPKSGNVYLKLLVKLYRFLVRRTDAPFNSVILKRLFMSRTNRAPLSMSRLVKYMAGKDDKIAVLVGTITDDVRQFEVPALKVAALRFTETARARILKAGGECLTFDQLALRAPTGANTVLLRGPKNAREAVKHFGAPGVPQSHAKPYVRSKGRKFEKARGRRNSRGFKV

SEQ ID NO: 7757 - protein, 186 aa, Physcomitrella patens
MGIDLKAGGRNKKTKRTAPKSDNVYLKLLVKLYRFLVRRTDAPFNSVVLKRLFMSRINRPPISMSRLVKYMTGKEGKIAVIVGTVTDDTRIYEVPALKVAALRFTETARARILKSGGEVLTFDQLALRAPTGSNCVLLRGPKNAREAVKHFGAPGVPQSHAKPYVRSKGRKFEKARGRRNSRGFKV

SEQ ID NO: 7758 - protein, 185 aa, Bruguiera gymnorhiza
MGIDLKAGGKSKKTKRTAPKSNDIYLKLLVKLYRFLVRRTGSKFNAVVLKRLFMSKVNKPPLSLSRLIRFMKDKENKIAVVVGTVTDDIRVYEVPALKVTALRFTETARARIEKAGGECLTFDQLALRAPLGQNTVLLRGPKNAREAVKHFGPAPGVPHSHTKPYVRSKGRKFERARGKKKNKGF

SEQ ID NO: 7759 - protein, 187 aa, Cichorium intybus
MGIDLVAGGKSKRTKRNAPRSDDIYLKLLVKLYRFLVRRTGSNFNAVILKRLFMSKVNKPPISLSRLIRYMAGKEEKIAVIVGTVTDDVRVHEIPCMKVTALRFTETARARIEKAGGECLTFDQLALRAPLGQNTVLLRGPKNSREAVRHFGKAPGVPHSHTKPYVRSTGRKFEKARGRRNSRGFRN

SEQ ID NO: 7760 - protein, 187 aa, Trifolium pratense
MGIDLKAGGKSKKTKRTAPKSNDIYLKLLVKLYRFLGRRTGSNFNAVILKRLFMSKVNKPPLSLSRLIKYTKGKEGKIAVVVGTITDDIRVYEVPAIKVTALRFTETARARIEKAGGECLTFDQLALRAPLGQNTVLLRGPKNAREAVKHFGRAPGVPHSHTKPYVRASGRKFEKARCKRNSRGFRV

SEQ ID NO: 7761 - protein, 187 aa, Taraxacum officinale
MGIDLVAGGKSKRTKRNAPRSDDIYLKLLVKLYRFLVRRTGSNFNAVILKRLFMSKVNKPPISLSRLVRYMAGKDDKIAVIVGTVTDDVRVHEIPCMKVTALRFTETARARIEKAGGECLTFDQLALRAPLGQNTVLLRGPKNCREAVRHFGKAPGVPQSHTKPYVRSKGRKFEKARGRRNSRGFRN

SEQ ID NO: 7762 - protein, 187 aa, Lactuca sativa
MGIDLVAGGKSKRTKRTAPRSDDIYLKLLVKLYRFLVRRTGSNFNAVILKRLFMSKVNKPPISLSRLIRFMSGKEDKIAVVVGTVTDDVRVHEIPCIKVTALRFTETARARIEKAGGECLTFDQLALRAPLGQNTVLLRGPKNCREAVRHFGKAPGVPHSHTKPYVRSTGRKFEKARGRRNSRGFRN

SEQ ID NO: 7763 - protein, 187 aa, Lactuca sativa
MGIDLVAGGKSKRTKRTAPRSDDIYLKLLVKLYRFLVRRTGSNFNAVILKRLFMSKVNKPPISLSRLIRYMSGKEDKIAVVVGTVTDDVRVHEIPCIKVTALRFTETARARIEKAGGECLTFDQLALRAPLGQNTVLLRGPKNCREAVRHFGKAPGVPHSHTKPYVRSKGRKFEKARGRRNSRGFRN

SEQ ID NO: 7764 - protein, 187 aa, Lotus japonicus
MGIDLKAGGKSKKKNRTAPKSNDIYLKLLVKLYRFLVRRTGSKFNAVILKRLFMSKVNKPPLSLSRLVKFMKGKDGKIAVVVGTVTDDIRVYEVPTLKVTALRFTETARARIEKAGGECLTFDQLALAAPLGQGTVLLRGPKNAREAVRHFGRAPGVPHSHTKPYVRSKGRKFEMARGKRNSRGFKV

SEQ ID NO: 7765 - protein, 187 aa, Pinus taeda
MGIDLIAGGKSKKTKRTAPKSQDIYLKLLVKLYRFLVRRTNSSFNAVILKRLFMSKTNKPPLSLSRLVRYMQEKDDKIAVVVGTITDDNRIYELPPLKVTALRFTETARARILKAGGECLTFDQLALRAPLGQNTVLLRGPKSHREAVKHFGRAPGVPHSHTKPYVRSKGRKFEMARGRRNSRGFKV

SEQ ID NO: 7766 - protein, 186 aa, Solanum tuberosum
  misc_feature (172)..(172): Xaa can be any naturally occurring amino acid
MGIDLVAGGKSKKTKRIAPKSDDVYLKLLVKLYRFLARRTGSKFNAVILKRLFMSKINKAPLSLSRLVTYMTGKEDNIAVIVGTVTDDVRAYEVPKIKVTALRFTETARARIEKAGGECLTFDQLALRAPLGQNTVLLRGPKNSREAVKHFGKAPGVPHSHTKPYVRAKGRXFERARGKRNSRGYK

SEQ ID NO: 7767 - protein, 187 aa, Raphanus sativus
MGIDLIAGGKSKKTKRTAPKSDDVYLKLLVKLYRFLVRRTGSKFDAVILKRLFMSKVNKAPLSLSKLVEFMNGKDGKIAVLVGTITDDLRVHEIPAMKVTALRFTERARARIEKAGGECLTFDQLALVAPLGQNTVLLRGPKNSREAVKHFGPAPGVPHSHSKPYVRSKGRKFEKARGKRKSRGFKV

SEQ ID NO: 7768 - protein, 187 aa, Raphanus sativus
MGIDLIAGGKSKKTKRTAPKSDDVYLKLLVKLYRFLVRRTGSKFDAVILKRLFMSKVNKAPLSLSKLVEFMKGKDGKIAVLVGTITDDLRVHEIPAMKVTALRFTERARARIEKAGGECLTFDQLALVAPLGQNTVLLRGPKNSREAVKHFGPAPGVPHSHSKPYVRSKGRKFEKARGKRKSRGFKV

SEQ ID NO: 7769 - protein, 187 aa, Raphanus sativus
MGIDLIAGGKSKKTKRTAPKSDDVYLKLIVKLYRFLVRRTQSKFDAVILKRLFMSKVNKAPLSLSRLVEFMAGKEDKIAVLVGTITDDLRVHEIPAIKVTALRFTERARARIEKAGGEFLTFDQLALRAPLGQNTVLLRGPKNSREAVKHFGPAPGVPHSHSKPYVRSKGRKFEKARGKRKSRGFKV

SEQ ID NO: 7770 - protein, 187 aa, Raphanus sativus
  misc_feature (177)..(178): Xaa can be any naturally occurring amino acid
MGIDLIAGGKSKKTKRTAPKSDDVYLKLTVKLYRFLVRRTQSKFNAVILKRLFMSKVNKAPLSLSRLVEFMTGKEDKIAVLVGTITDDLRVHEIPAIKVTALRFTERARARIEKAGGECLTFDQLALRAPLGQNTVLLRGPKNSREAVKHFGPAPGVPHSHSKPYVRSKGRKFEKAXXKRKSRGFKV

SEQ ID NO: 7771 - protein, 187 aa, Carthamus tinctorius
  misc_feature (26)..(26): Xaa can be any naturally occurring amino acid
MGIDLVAGGKSKKTKRTAPRSDDIYXKLLVKLYRFLVRRTGSNFNAVILKRLFMSKVNKPPISLSRLVRYMSGKEDKIGVIVGTVTDDVRVHEIPCMKVTALRFSETARARIEKAGGECLTFDQLALRAPLGQNTVLLRGPKNSREAVRHFGKAPGVPHSHTKPYVRSNGRKFEKARGRRNSRGFRN

SEQ ID NO: 7772 - protein, 187 aa, Camellia sinensis
MGIDLKAGGKSKKTKRTAPKSQDIYLKLLVKLYRFLVRRTGSKFNAVILKRLFMSKVNKPPISLSRLTRFMQGKGEKIAVVVGTITDDIRAHEVPALKVTALRFTETARARIEKAGGECLTFDQLALRAPLGQNTVLLRGPKNSREAVKHFGKAPGVPHSHTKPYVRSKGRKFEQARGRRNSRGYKV

SEQ ID NO: 7773 - protein, 187 aa, Nicotiana tabacum
MGIDLKAGGKSKKTKRTAPKSDDVYLKLLVKLYRFLVRRTGSKFNAVILKRLFMSKINKPPLSLSRLISYAKGKEDKVVVIVGTITDDVRAYEVPALKVCALRFTKTARARIEKAGGECLTFDQLALRAPLGQNTLLLRGPKNAREAVKHFGPAPGVPHSHTKPFVRSKGRKFERARGRRNSRGYKA

SEQ ID NO: 7774 - protein, 187 aa, Nicotiana tabacum
  misc_feature (6)..(6): Xaa can be any naturally occurring amino acid
MGIDLXAGGKSKKTKRTAPKSDDVYLKLLVKLYRFLVRRTGSKFNAVILKRLFMSKINKPPLSLSRLISYAKGKEDKVVVIVGTITDDVRAYEVPALKVCALRFTKTARARIEKAGGECLTFDQLALRAPLGQNTLLLRGPKNAREAVKHFGPAPGVPHSHTKPFVRSKGRKFERARGRRNSRGYKA

SEQ ID NO: 7775 - protein, 187 aa, Solanum lycopersicum
MGIDLVAGGKSKKTKRIAPKSDDVYLKLLVKLYRFLSRRTGSKFNAVILKRLFMSKINKAPLSLSRLVTYMTGKEDNIAVVVGTVTDDVRAYEVPKIKVTALRFTETARARIEKAGGECLTFDQLALRAPLGQNTVLLRGPKNSREAVKHFGKAPGVPHSHTKPYVRAKGRKFERARGKRNSRGYKA

SEQ ID NO: 7776 - protein, 188 aa, Triphysaria pusilla
MGIDLVAGGKNKKTKRTAPKSNDIYLKLIVKLYRFLVRRTGSSFNAVILKRLFMSKVNRPPLSLSRLVSHMKGKDNQIAVLVGTVTDDIRLQEEVPAIKVTALRFTETARARIEKAGGECLTFDQLALRAPLGQNTVLLRGSRKAREAVRHFGAAPGVPHSHTKPYVRAKGRKFEKARGKRNSKGFRV

SEQ ID NO: 7777 - protein, 218 aa, Physcomitrella patens
GARIHSKSLFLCFPAQRSRCSFSSAGSAPPTTMGIDLKAGGRNKKTKRTAPKSGNVYLKLLVKLYRFLVRRTDAPFNSVILKRLFMSRTNRAPLSMSRLVKYMAGKDDKIAVLVGTITDDVRQFEVPALKVAALRFTETARARILKAGGECLTFDQLALRAPTGANTVLLRGPKNAREAVKHFGAPGVPQSHAKPYVRSKGRKFEKARGRRNSRGFKV

SEQ ID NO: 7778 - protein, 188 aa, Triphysaria pusilla
MGIDLVAGGKNKKTKRTAPKSNDIYLKLIVKLYRFLVRRTGSSFNAVILKRLFMSKVNRPPISLSRLVAHMKGKDNQIAVLVGTVTDDIRLQEEVPAIKVTALRFTETARARIEKAGGECLTFDQLALRAPLGQNTVLLRGSRKAREAVRHFGAAPGVPHSHTKPYVRAKGRKFEKARGKRNSKGFRV

SEQ ID NO: 7779 - protein, 122 aa, Beta vulgaris
MGIDLKAGGKSKKTKRTAPKSNDVYLKLLVKLYRFLVRRTGSKFNAVVLKRLFMSKINKAPLSLSRLVKYMEGKDGRIAVLVGTITDDIRVYEVPTMKVCALRFTETARARIEKGRWRVYHF

SEQ ID NO: 7780 - protein, 119 aa, Taraxacum officinale
  misc_feature (119)..(119): Xaa can be any naturally occurring amino acid
MGIDLVAGGKSKRTKRTAPRSDDIYLKLLVKLYRFLVRRTGSNFNAVILKRLFMSKVNKPPISLSRLVRYMSGKDDKIAVVVGTVTDDVRVHEIPCIKVTALRFTETARAESRKLVENX

SEQ ID NO: 7781 - protein, 205 aa, Physcomitrella patens
SLFKPSSFYPARFLSVVAAMGIDLKAGGRNKKTKRTAPKSGNVYLKLLVKLYRFLVRRTDAPFNAVVLKRLFMSRINRPPISMSRLVRYMKGKEDKIAVIVGSVTDDTRIYEVPALKVAALRFTETARARILKNGGEVLTFDQLALRAPTGSNCVLLRGPKNAREAVKHFGAPGVPRSHAKPYVRSKGRKFEKARGRRNSRGFKV

SEQ ID NO: 7782 - protein, 208 aa, Physcomitrella patens
SSSQAPSLQQICLPAGLSPSTTMGIDLKAGGRNKKTKRTAPKSQNVYLKLLVKLYRFLVRRTDAPFNSVVLKRLFMSRTNRAPLSMSRLVKYMTGKEGKIAVLVGTITDDVRQFEVPALKVCALRFTETARARILKAGGECLTFDQLALRAPTGSNTVLLRGPKNAREAVKHFGAPGVPQSHAKPYVRSKGRKFEKARGRRNSRGFKV

SEQ ID NO: 7783 - protein, 186 aa, Arabidopsis lyrata
GIDLIAGGKSKKTKRTAPKSDDVYLKLLVKLYRFLVRRSESKFNAVILKRLFMSKVNKAPLSLSRLVEFMTGKEDKIAVLVGTITDDLRVHEIPAIKVTALRFTERARARIEKAGGECLTFDQLALKAPLGQNTVLLRGPKNSREAVKHFGPAPGVPHSSTKPYVRHKGRKFEKARGKRKSRGFKV

SEQ ID NO: 7784 - protein, 187 aa, Unknown
  Sequence found in Organisms: Brassica napus, Brassica oleracea, Brassica rapa
MGIDLIAGGKSKKTKRTAPKSDDVYLKLLVKLYRFLVRRTGSKFDAVILKRLFMSKVNKAPLSLSKLVEFMKGKDGKIAVLVGTITDDLRVHEIPAMKVTALRFTERARARIEKAGGECLTFDQLALVAPLGQNTVLLRGPKNSREAVKHFGKAPGVPHSHTKPYVRAKGRKFEKARGKRKSRGFKV

SEQ ID NO: 7785 - protein, 187 aa, Brassica napus
MGIDLIAGGKSKKTKRTAPKSDDVYLKLLVKLYRFLVMRTGSKFDAVILKRLFMSKVNKAPLSLSKLVEFMNGKDGKIAVLVGTITDDLRVHEIPAMKVTALRFTERARARIEKAGGECLTFDQLALVAPLGQNTVLLRGPKNSREAVKHFGPAPGVPHSHSKPYVRSKGRKFEKARGKRKSRGFKV

SEQ ID NO: 7786 - protein, 187 aa, Ipomoea batatas
MGIDLVAGGKSKQTKRTSPKSDDVYLKLLVKLYRFLVRRTESKFNAAILKRLFMSKINKAPLSLSRLIQFMQGKEDKIAVLVGTVTDDTRAYEVPKMKVVALRFTETARARIEKAGGECLTFDQLALRTPLGQNTVLLRGPINSREAVKHFGRAPGVPHSHTKPYVRSKGRKFERARGKRNSRGYKI

SEQ ID NO: 7787 - protein, 187 aa, Orobanche aegyptiaca
MGIDLVAGGKSKKTKRTAPKSDDIYLNLLVKLYRFLVRRTGSKFNEVILKRLFMSKVNKPPVSLSKLTALMKGKEDKIAVIVGTVTDDIRVHEIPAIKVTALRFTETARARIEKAGGECLTFDQLALKAPLGQNTVLLRGSPKAREAVKHFGPAPGVPHSHTKPYVRSKGRKFEKARGRRNSKGFRV

SEQ ID NO: 7788 - protein, 186 aa, Physcomitrella patens
MGIDLKAGGRNKKTKRTAPKSGNVYLKLLVKLYRFLVRRTDAPFNAVVLKRLFMSRINRPPISMSRLVRYMKGKEDKIAVIVGSVTDDTRIYEVPALKVAALRFTETARARILKNGGEVLTFDQLALRAPTGSNCVLLRGPKNAREAVKHFGAPGVPRSHAKPYVRSKGRKFEKARGRRNSRGFKV

SEQ ID NO: 7789 - protein, 186 aa, Physcomitrella patens
MGIDLKAGGRNKKTKRTAPKSQNVYLKLLVKLYRFLVRRTDAPFNSVVLKRLFMSRTNRAPLSMSRLVKYMTGKEGKIAVLVGTITDDVRQFEVPALKVCALRFTETARARILKAGGECLTFDQLALRAPTGSNTVLLRGPKNAREAVKHFGAPGVPQSHAKPYVRSKGRKFEKARGRRNSRGFKV

SEQ ID NO: 7790 - protein, 187 aa, Cajanus cajan
MGIDLKAGGKSKKTKRTAPKSDDIYLKLAVKLYRFLVRRTSSNFNAVILKRLFMSKVNKPPLSLSRLIRYMKGKEDKIAVVVGAVTDDIRAYEVPALKVTALRFTKTARARILKAGGECISFEELALRAPLGQNTVLLRGPKNAREAVKHFGPAPGVPHSHTKPYVRAKGRKFERARGRRNSRGFRV

SEQ ID NO: 7791 - protein, 187 aa, Tragopogon dubius
MGIDLVAGGKSKRTKRTAPRSDDIYLKLLVKLYRFLVRRTGSNFNAVILKRLFMSKVNKPPISLSRLIRYMSGKDDKIAVVVGTVTDDVRVDEIPCIKVTALRFTETARARIEKAGGECLTFDQLALRAPLGQNTVLLRGPKNCREAVRHFGKAPGVPHSHTKPYVRSKGRKFEKARGRRNSRGFRN

SEQ ID NO: 7792 - protein, 187 aa, Tragopogon dubius
MGIDLVAGGKSKRTKRTAPRSDDIYLKLLVKLYRFLVRRTGSNFNAVILKRLFMSKVNKPPISLSRLIRYMSGKDSKIGVIVGTVTDDVRVDEIPCMKVTALRFTETARARIEKAGGECLTFDQLALRAPLGQNTVLLRGPKNCREAVRHFGKAPGVPHSHTKPYVRSTGRKFEKARGRRNSRGFRN

SEQ ID NO: 7793 - protein, 187 aa, Brassica juncea
MGIDLIAGGKSKKTKRTAPKSDDVYLKLLVKLYRFLVRRTGSKFDAVILKRLFMSKVNKAPLSLSKLVEFMNGKDGKIAVLVGTITDDLRVHEIPAMKVTALRFTERARARIEKAGGECLTFDQLALVAPLGQNTVLLRGPKNSREAVKHFGKAPGVPHSHTKPYVRAKGRKFEKARGKRKSRGFKV

SEQ ID NO: 7794 - protein, 187 aa, Unknown
  Sequence found in Organisms: Brassica napus, Brassica oleracea
MGIDLIAGGKSKKTKRTAPKSDDVYLKLLVKLYRFLVRRTGSKFDAVILKRLFMSKVNKAPLSLSKLVEFMKGKDGKIAVLVGTITDDLRVHEIPAMKVTALRFTERARARIEKAGGECLTFDQLALVAPLGQNTVLLRGPKNSREAVKHFGLAPGVPHSHSKPYVRSKGRKFEKARGKRKSRGFKV

SEQ ID NO: 7795 - protein, 187 aa, Unknown
  Sequence found in Organisms: Brassica napus, Brassica rapa
MGIDLIAGGKSKKTKRTAPKSDDVYLKLLVKLYRFLVRRTGSKFDAVILKRLFMSKVNKAPLSLSKLVEFMKGKDGKIAVLVGTITDDLRVHEIPAMKVTALRFTERARARIEKAGGECLTFDQLALVAPLGQNTVLLRGPKNSREAVKHFGPAPGVPHSHSKPYVRAKGRKFEKARGKRKSRGFKV

SEQ ID NO: 7796 - protein, 187 aa, Centaurea maculosa
  misc_feature (17)..(17): Xaa can be any naturally occurring amino acid
  misc_feature (169)..(169): Xaa can be any naturally occurring amino acid
  misc_feature (180)..(180): Xaa can be any naturally occurring amino acid
MGIDLVAGGKSKKTKRXAPRSDDIYLKLLVKLYRFLVRRTGSNFNAVILKRLFMSKVNKPPISLSRLVRYMSGKEDKIGVIVGTVTDDVRVHEIPCMKVTALRFSETARARIEKAGGECLTFDQLALRAPLGQNTVLLRGPKNSREAVRHFGKAPGVPHSHTKPYVRSXGRKFEKARGRXNSRGFRN

SEQ ID NO: 7797 - protein, 187 aa, Centaurea maculosa
MGIDLVAGGKSKKTKRNAPRSDDIYLKLLVKLYRFLVRRTGSSFNAVILKRLFMSKINKPPISLSRLIRYMTGKDDKIAVIVGTVTDDVRVHEIPCMKVTALRFTETARARIEKAGGECLTFDQLALRAPLGQNTVLLRGPKNCREAVRHFGKAPGVPHSHTKPYVRSKGRKYEKARGRRNSRGFRN

SEQ ID NO: 7798 - protein, 187 aa, Cichorium intybus
MGIDLVAGGKSKRTKRTAPRSDDIYLKLLVKLYRFLVRRTGSNFNAVILKRLFMSKVNKPPISLSRLIRYMSGKEDKIAVVVGTVTDDVRVHEIPCIKVTALRFTETARARIEKAGGECLTFDQLALRAPLGQNTVLLRGPKNSREAVRHFGKAPGVPHSHTKPYVRSTGRKFEKARGRRNSRGFRN

SEQ ID NO: 7799 - protein, 187 aa, Cynara scolymus
MGIDLVAGGKSKKTKRTAPRSDDIYLKLLVKLYRFLVRRTGSNFNAVILKRLFMSKVNKPPISLSRLIRYMSGKDDKIAVIVGTVTDDVRVHEIPCMKVTALRFSETARARIEKAGGECLTFDQLALRAPLGQNTVLLRGPKNSREAVRHFGKAPGVPHSHTKPYVRANGRKFEKARGRRNSRGFRN

SEQ ID NO: 7800 - protein, 187 aa, Adiantum capillus-veneris
MGIDLPAGGRNKKTKRTAPKSDNVYLKLVVKLYRFLVRRTGSPFNAVVLKRLFMSRTNRPPLSLSRLTRYMKDKEDKIGVVVGTVTDDVRLYELPALKIAALRFTETARARILKAGGDCLTFDQLALKAPTGSNTVLLRGPKNAREAVKHFGRAPGVPHSHTKPYVRSKGRKFERARGRRNSRGYKV

SEQ ID NO: 7801 - protein, 187 aa, Ipomoea nil
  misc_feature (71)..(71): Xaa can be any naturally occurring amino acid
  misc_feature (100)..(100): Xaa can be any naturally occurring amino acid
  misc_feature (129)..(129): Xaa can be any naturally occurring amino acid
  misc_feature (142)..(142): Xaa can be any naturally occurring amino acid
  misc_feature (162)..(162): Xaa can be any naturally occurring amino acid
MGIDLVAGGKSKQTKRTAPKSDDVYLKLLVKLYRFLVRRTESKFNAAILKRLFMSKTNKAPLSLSRLIQFXQGKEDKIAVLVGTVTDDTRAYEVPKMKVXALRFTETARARIEKAGGECLTFDQLALRXPLGQNTVLLRGPXNSREAVKHFGRAPGVPHSHXKPYVRSKGRKFERARGKRNSRGYKI

SEQ ID NO: 7802 - protein, 187 aa, Lactuca sativa
MGIDLVAGGKSKRTKRNSPRSDDIYLKLLVKLYRFLVRRTGSNFNAVILKRLFMSKVNKPPISLSRLIRYMSGKDEKIAVIVGTVTDDVRVHEIPCLKVTALRFTETARARIENAGGECLTFDQLALRAPLGQNTVLLRGPKNSREAVRHFGKAPGVPHSHTKPYVRSKGRKFEKARGRRNSRGFRN

SEQ ID NO: 7803 - protein, 187 aa, Lactuca sativa
MGIDLVAGGKSKRTKRNSPRSDDIYLKLLVKLYRFLVRRTGSNFNAVILKRLFMSKVNKPPISLSRLIRYMSGKDEKIAVIVGTVTDDVRVHEIPCMKVTALRFTETARARIEKAGGECLTFDQLALRAPLGQNTVLLRGPKNSREAVRHFGKAPGVPHSHTKPYVRSKGRKFEKARGRRNSRGFRN

SEQ ID NO: 7804 - protein, 187 aa, Lactuca sativa
MGIDLVAGGKSKRTKRTAPRSDDIYLKLLVKLYRFLVRRTGSNFNAVILKRLFMSKVNKPPISLSRLIRYMSGKDDKIAVVVGTVTDDVRVHEIPCIKVTALRFTETARARIEKAGGECLTFDQLALRAPLGQNTVLLRGPKNCREAVRHFGKAPGVPHSHTKPYVRSKGRKFEKARGRRNSRGFRN

SEQ ID NO: 7805 - protein, 187 aa, Nicotiana benthamiana
MGIDLKAGGKSKKTKRTAPKSDDVYLKLLVKLYRFLVRRTGSKFNAVILKRLFMSKINKPPLSLSRLISYAKGKEDKVVVIVGTITDDVRAYEVPALKVCALRFTKTARARIEKAGGECLTFDQLALRAPLGQNTLLLRGPKNAREAVKHFGAAPGVPHSHTKPFVRSKGRKFERARGRRNSRGYKA

SEQ ID NO: 7806 - protein, 186 aa, Quercus alba
MGIDLVAGGKRKKKIRTAPKSNDIYLKLLVKLYRFLVRRTGSKFNAVILKRLFMSKVNKPPLSLSKLIRYMEGKEGKIAVVVGTVTDDIRVYEVPAVKVTALRFTETARARIEKAGGECLTFDQLALRAPLGQNTVLLRGHKKREAVKHFGPAPGVPHSHTKPYVRAKGRKFERARGKRNSKGFRV

SEQ ID NO: 7807 - protein, 187 aa, Capsicum annuum
MGIDLVAGGKSKKTKRTAPKSDDVYLKLLVKLYRFLVRRTGSKFNAVILKRLFMSKINKAPLSLSRLISYMKGKEDKVAVIVGTVTDDIRAYEVPSLKVTALRFTETARARIEKAGGECLTFDQLALRAPLGQNTVLLRGPRNSREAVKHFGRAPGVPGSHSKPYVRSKGRKFERARGKRNSRGYKA

SEQ ID NO: 7808 - protein, 187 aa, Capsicum annuum
MGIDLKAGGKSKKTKRTAPKSDDVYLKLLVKLYRFLVRRTGSKFNAVILKRLFMSKTNKPPLSLSRLISFAKGKEDKTVAIVGTITDDVRAYEVPKLKVCALRFTKTARARIEKAGGECLTFDQLALRAPLGQNTLLLRGPKNAREAVKHFGPAPGVPHSHSKPYVRSKGRKFERARGKRKSRGYKV

SEQ ID NO: 7809 - protein, 187 aa, Petunia hybrida
MGIDLKAGGKCKKTRRTAPKSDDVYLKLLVKLYRFLVRRTGSKFNAVILKRLFMSKINKAPLSLSRMINYAKGKEDKVVVIVGTITDDARAYDVPALKVCALRFTKTARARIEKAGGECLTFDQLALRAPLGQNTLLLRGPKNAREAVKHFGPAPGVPHSHTKPYVRSKGRKFERARGRRNSRGYKV

SEQ ID NO: 7810 - protein, 185 aa, Petunia hybrida
IDLKAGGKCKKTKRTAPKSDDVYLKLLVKLYRFLVRRTGSKFNAVILKRLFMSKTNKPPLSLSRLISYTKGKEDKTAVIVGSITDDARAYEVPKLKVCALRFTKTARARIEKAGGECSTFDQLALRAPLGQNTVLLRGPKNAREAVKHFGPAPGVPHSHTKPYVRSKGRKFERARGRRKSRGYKV

SEQ ID NO: 7811 - protein, 187 aa, Raphanus sativus
MGIDLIAGGKSKKTKRTAPKSDDVYLKLLVKLYRFLVRRTGSKFDAVILKRLFMSKVNKAPLSLSKLVEFMNGKDGKIAVLVGTITDDLRVHDLPAMKVTALRFTERARARIEKAGGECLTFDQLALVAPLGQNTVLLRGPKNSREAVKHFGPAPGVPHSHSKPYVRSKGRKFEKARGKRKSRGFKV

SEQ ID NO: 7812 - protein, 184 aa, Raphanus sativus
DLIAGGKSKKTKRTAPKSDDVYLKLTVKLYRFLVRRTQSKFNAVILKRLFMSKVNKAPLSLSRLVEFMTGKEDKIAVLVGTITDDLRVHEIPAIKVTALRFTERARARIEKAGGECLTFDQLALRAPLGQNTVLLRGPKNSREAVKHFGPAPGVPHSHSKPYVRSKGRKFEKARGKRKSRGFKV

SEQ ID NO: 7813 - protein, 187 aa, Raphanus sativus
  misc_feature (34)..(34): Xaa can be any naturally occurring amino acid
  misc_feature (69)..(69): Xaa can be any naturally occurring amino acid
MGIDLIAGGKSKKTKRTAPKSDDVYLKLLVKLYXFLVRRTGSKFDAVILKRLFMSKVNKAPLSLSKLVXFMNGKDGKIAVLVGTITDDLRVHEIPAMKVTALRFTERARARIEKAGGECLTFDQLALVAPLGQNTVLLRGPKNSREAVKHFGPAPGVPHSHSKPYVRSKGRKFEKARGKRKSRGFKV

SEQ ID NO: 7814 - protein, 187 aa, Carthamus tinctorius
MGIDLVAGGKSKKTKRNAPRSDDIYLKLLVKLYRFLVRRTGSSFNAVILKRLFMSKINKPPISLSRLIRYMAGKDDKIAVIVGTVTDDVRVHEIPCMKVTALRFTETARARIEKAGGECLTFDQLALRAPLGQNTVLLRGPKNCREAVRHFGKAPGVPHSHTKPYVRSKGRKYEKARGRRNSRGFRN

SEQ ID NO: 7815 - protein, 187 aa, Thellungiella halophila
MGIDLIAGGKSKKTKRTAPKSDDVYLKLTVKLYRFLFRRTNSKFNGVILKRLFMSKVNKAPLSLSRLVEFMTGKEDKIAVLVGTITDDLRVHEIPAIKVTALRFTERARARIEKAGGECLTFDQLALRAPLGQNTVLLRGPKNSREAVKHFGPAPGVPHSHSKPYVRSTGRKFEKARGKRKSRGFKV

SEQ ID NO: 7816 - protein, 187 aa, Panax ginseng
MGIDLKAGGKSKRTKRTAPRSDDIYLKLIVKLYRFLVRRTGSKFNAVILKRLFMSKINKPPISLSRLIRFMSGKEDKIGVIVGTITDDVRVHEVPCMKVTALRFTETARARIEKAGGECLTFDQLALRAPLGQNTVLLRGPKNSREAVKHLGKAPGVPDSHSKPYVRSKGRKFEKARGRRNSRGFRV

SEQ ID NO: 7817 - protein, 186 aa, Physcomitrella patens
MGIDLKAGGRNKKTKRTAPKSQNVYLKLLVKLYRFLVRRTDAPFNSVVLKRLFMSRINRAPLSMSRLVKYMAGKDDKIAVLVGTITDDVRQFEVPALKVCALRFTETARARIVKAGGECLTFDQLALRAPTGANTVLLRGPKNAREAVKHFGAPGVPQSHAKPYVRSKGRKFEKARGRRNSRGFKV

SEQ ID NO: 7818 - protein, 187 aa, Unknown
  Sequence found in Organisms: Brassica napus, Brassica oleracea
MGIDLIAGGKSKKTKRTAPKSDDVYLKLLVKLYRFLVRRTGSKFDAVILKRLFMSKVNKAPLSLSKLAEFMKGKDGKIAVLVGTITDDLRVHEIPAMKVTALRFTERARARIEKAGGECLTFDQLALVAPLGQNTVLLRGPKNSREAVKHFGLAPGVPHSHSKPYVRSKGRKFEKARGKRKSRGFKV

SEQ ID NO: 7819 - protein, 186 aa, Castanea mollissima
MGIDLVAGGKRKKKVRTAPKSNDIYLKLLVKLYRFLVRRTGSKFNAVILRRLFMSKVNKPPLSLSKLIRYMEGKEGKIAVVVGTVTDDIRVYEVPAVKVTALRFTETARARIEKAGGECLTFDQLALRAPLGQNTVLLRGHKKREAVKHFGPAPGVPHSHTKPYVRAKGRKFERARGKRNSKGFRV

SEQ ID NO: 7820 - protein, 187 aa, Taraxacum officinale
MGIDLVAGGKSKRTKRNAPRSDDIYLKLLVKLYRFLVRRTGSNFNAVILKRLFMSKVNKPPISLSRLIRYMSGKDEKIAVVVGTVTDDVRVHEIPCLKVTALRFTETARARIEKAGGECLTFDQLALRAPLGQNTVLLRGPKNSREAVRHFGKAPGVPHSHTKPYVRSKGRKFEKARGRRNSRGFRN

SEQ ID NO: 7821 - protein, 187 aa, Mesembryanthemum crystallinum
MGIDLKAGGKSKKTKRTAPKSNDVYLKLLVKLYRFLVRRTDSSFNAVVLKRLFMSKINKAPLALSRLITYMKGKEDKIAVIVGNVTDDVRVYEVPALKVTALRFTETARARIEKAGGECLTFDQLALRAPLGQNTILLRGPRNAREAVRHFGKAPGVPHSHTKPYVRSDGRKFERARGRRNSRGYKN

SEQ ID NO: 7822 - protein, 187 aa, Actinidia deliciosa
MGIDLKAGGKSKKTKRTAPRSQDIYLKLLVKLYRFLVRRTGSKFNAVILKRLFMSKINKPPISLSRLIRFTQGKEGKIAVVVGTITDDIRVHEVPCLKVTALRFTETARARIEKAGGECLTFDQLALRAPLGQNTVLLRGPKNAREAVKHFGKAPGVPHSHTKPYVRSKGRKYERARGRRNSRGFRN

SEQ ID NO: 7823 - protein, 187 aa, Lactuca sativa
MGIDLVAGGKSKRTKRNSPRSDDIYLKLLVKLYRFLVRRTGSNFNAVILKRLFMSKVNKPPISLSRLIRYMSGKDEKIAVIVGTVTDDVRVHEIPCLKVTALRFTETARARIEKAGGECLTFDQLALRAPLGQNTVLLRGPKNSREAVRHFGKAPGVPHSHTKPYVRSKGRKFEKARGRRNSRGFRN

SEQ ID NO: 7824 - protein, 187 aa, Lactuca sativa
MGIDLVAGGKSKRTKRNAPRSDDIYLKLLVKLYRFLVRRTGSNFNAVILKRLFMSKVNKPPISLSRLIRYMAGKDDKIAVVVGTVTDDVRVDEIPCIKVTALRFTETARARIEKAGGECLTFDQLALRAPLGQNTVLLRGPKNCREAVRHFGKAPGVPHSHTKPYVRSKGRKFEKARGRRNSRGFRN

SEQ ID NO: 7825 - protein, 186 aa, Liriodendron tulipifera
MGIDLVAGGRCKKTKRTAPRSGDIYLKLLVKLYRFLVRRTGSKFNAVILKRLFMSKVNKPPVSLSKLIEFMKGKDDKIAVVVGCITDDTRVYEVPALKVTALRFTETARARIVKAGGECLTFDQLALRAPLGQNTVLLRGSKKREAVKHFGKAPGVPGSHSKPYVRSKGRKFERARGRRNSRGFRV

SEQ ID NO: 7826 - protein, 187 aa, Selaginella moellendorffii
MGIDIEAGGRNKKTKRTAPKSDNVYLKLLVKLYRFLVRRTNSKFNAVILKRLFMSKTNQPPVSLSRLSASMEKKSGKIAVLVGTVTDDPRLATVPAMTVVALRFTRTARARITNAGGKCLTFDELALLAPTGCNTVLLRGRKSAREAVKHFGPAPGVPHSHTKPYVRSKGRKFEKARGRRNSRGFRV

SEQ ID NO: 7827 - protein, 187 aa, Selaginella moellendorffii
MGIDIEAGGRNKKTKRTAPKSDNVYLKLLVKLYRFLVRRTNSKFNAVILKRLFMSKTNQPPVSLSRLSASMEKKSGKIAVLVGTVTDDPRLAAVPAMTVVALRFTRTARARITNAGGKCLTFDELALLAPTGCNTVLLRGRKSAREAVKHFGPAPGVPHSHTKPYVRSKGRKFEKARGRRNSRGFRV

SEQ ID NO: 7828 - protein, 187 aa, Picea glauca
MGIDLIAGGKSKQTRRTAPKSEDIYLKLLVKLYRFLVRRTSSRFNAVILKRLFMSKTNKPPLSLSRLARYMQGKEDKIAVVVGTITDDNRVYELPPVKITALRFTETARARILKAGGECLTFDQLALRAPLGQNTVLLRGPKSHREAVKHFGRAPGVPHSHTKPYVRSKGRKYEMARGRRNSRGFKV

SEQ ID NO: 7829 - protein, 187 aa, Helianthus annuus
MGIDLIAGGKSKRTKRTAPRSDDIYLKLLVKLYRFLVRRTGSNFNVVILKRLFMSKVNKPPISLSRLIRYMSGKDDKIAVVVGTVTDDVRVHEIPCLKVTALRFTETARARIEKAGGECLTFDQLALRAPLGQNTVLLRGPKNSREAVKHFGPAPGVSHSHTKPYVRSKGRKFEKARGRRNSRGFRN

SEQ ID NO: 7830 - protein, 187 aa, Zamia vazquezii
MGIDLVAGGKSKKTKRTAPKSDDIYLKLLVKLYRFLVRRTNSRFNAVVLKRLFMSKVNRPPVSLSRLARYMKGKDDKIAVVVATVTDDIRVYELPPLKITALRFTETARARILKAGGECWTFDQLALRAPLGQNTVLLRGPKSHREAVKHFGRPPGVPHSHTKPYVRSKGRKFEKARGRRKSRGFKV

SEQ ID NO: 7831 - protein, 244 aa, Brassica rapa
  misc_feature (184)..(184): Xaa can be any naturally occurring amino acid
MGIDLIAGGKSKKTKRTAPKSDDVYLKLTVKLYRFLVRRTQSKFNAVILKRLFMSKVNKAPLSLSRLVEFMTGKEDKIAVLVGTITDDLRVHEIPAIKVTALRFTERARARIEKAGGECLTFDQLALRAPLGQNTVLLRGPKNSREAVKHFGPAPGVPHSHSKPYVRSKGRKFEKARGKRKSRXSPRVLFASYLINFYRNRIFVSELLLFQTIFLSFLLYWNHRELITHLCTYMHLFKLYNIKV

SEQ ID NO: 7832 - protein, 216 aa, Beta vulgaris
  misc_feature (183)..(183): Xaa can be any naturally occurring amino acid
  misc_feature (187)..(187): Xaa can be any naturally occurring amino acid
  misc_feature (190)..(190): Xaa can be any naturally occurring amino acid
  misc_feature (197)..(197): Xaa can be any naturally occurring amino acid
MGIDLKAGGKSKKTKRTAPKSNDVYLKLLVKLYRFLVRRTGSSFNGVVLKRLFMSKINKAPLSLSRLITYMKGKEDKIAVIVGAVTDDIRVYEVPALKVTALRFTETARARIEKAGGECLTFDQLALRAPLGQNTVLLRGPKNAREAVKHFGKAPGVPHSHTKPYVRANGRKFERARGRRNSXGYGXKLXYLILKLXCFLSHYSSFGGVGSIVNQI

SEQ ID NO: 7833 - protein, 205 aa, Actinidia deliciosa
MSRSSRTLYVGNLPGDIREREVEDIFYKYGPVAHIDLKIPPRPPGYAFVEFEEARDAEDAIRGRDGYDFDGHRLRVELAHGGRGHSSSTDHYSNHSSGRGSGRGGVSRRSDYRVLVSGLPGSASWQDLKDHMRRAGDVCFSQVFRDGSGTTGIVDYTSYDDMKYAIRKLDDSEFRNAFTQAIVRVKEYKSSRSRSNSRSRSRSRS

SEQ ID NO: 7834 - protein, 209 aa, Physcomitrella patens
TALSESPTPSQGSLLAGSDSSATMGIDLKAGGRNKKTKRTAPKSQNVYLKLLVKLYRFLVRRTDAPFNSVVLKRLFMSRINRAPLSMSRLVKYMAGKDDKIAVLVGTITDDVRQFEVPALKVCALRFTETARARIVKAGGECLTFDQLALRAPTGANTVLLRGPKNAREAVKHFGAPGVPQSHAKPYVRSKGRKFEKARGRRNSRGFKV

SEQ ID NO: 7835 - protein, 187 aa, Solanum melongena
MGIDLKAGGKSKKTKRTAPKSDDVYLKLLVKLYRFLARRTGSKFNAVILKRLFMSKINKPPLSLSRLISYAKGKEDKIVAIVGTITDDVRAYEVPKLRVCALRFTKTARARIEKAGGECLTFDQLALRAPLGQNTLLLRGPKNAREAVKHFGPAPGVPHSHTKPYVRSKGRKFERARGKRKSRGYKV

SEQ ID NO: 7836 - protein, 187 aa, Salvia sclarea
MGIDLVAGGKVKKTKRTAPKSNDIYLKLLVKLYRFLVRRTGSKFNAVVLKRLFMSRINRPPLSLSRLSALMNGKEDKIAVLVGSVTDDIRVHDIPKMKVAALRFTERARARIEKVGGECLTFDQLALRAPLGQNTVLLRGSRNAREAVKHFGPAPGVPHSHTKPYVRAKGRKFERARGNRNSRGFRV

SEQ ID NO: 7837 - protein, 187 aa, Salvia sclarea
MGIDLVAGGKVKKTKRTAPKSNDIYLKLLVKLYRFLVRRTGSKFNAVVLKRLFMSRINRPPLSLSRLSALMKGKEDKIAVLVGSVTDDIRVHDIPAMKITALRFTERARARIEKAGGECLTFDQLALRAPLGQNTVLLRGSRNAREAVKHFGPAPGVPHSHTKPYVRAKGRKFERARGKRNSRGFRV

SEQ ID NO: 7838 - protein, 187 aa, Tragopogon dubius
MGIDLVAGGKSKRTKRTAPRSDDIYLKLLVKLYRFLVRRTGSNFSSVILKRLFMSKVNRPPISLSRLIRYMSGKDEKIAVIVGTVTDDVRVDDIPCLKVTALRFTETARARIEKAGGECLTFDQLALRAPLGQNTVLLRGPKNSREAVRHFGKAPGVPHSHTKPYVRSTGRKFEKARGRRNSRGFRN

SEQ ID NO: 7839 - protein, 187 aa, Artemisia annua
MGIDLIAGGKSKRTKRNAPRSDDIYLKLLVKLYRFLVRRTGSNFNAVILKRLFMSKVNKPPISLSRLTRYMSGKDDKIAVIVGTVTDDVRVDEIPCMKVTALRFTETARARIEKAGGECLTFDQLALRAPVGQNTVLLRGPKNCREANRHFGKAPGVPHSHTKPYVRSKGRKFEKARGRRNSRGFRN

SEQ ID NO: 7840 - protein, 187 aa, Artemisia annua
MGIDLIAGGKSKRTKRTAPRSDDIYLKLLVKLYRFLVRRTGSKFNAVILKRLFMSKVNKPPISLSRLVRYMSAKDDKIAVVVGTVTDDVRVDEIPCMKVTALRFTETARARIEKAGGECLTFDQLALRAPVGQNTVLLRGPKNCREAVRHFGKAPGVPHSHTKPYVRSKGRKFEKARGRRNSRGFRN

SEQ ID NO: 7841 - protein, 187 aa, Ocimum basilicum
MGIDLVAGGKVKKTKRTAPKSNDIYLKLLVKLYRFLVRRTGSRFNAVVLKRLFMSRINRPPLSLSRLSALMKGKEDKIAVLVGSVTDDVRAHDIPAIKVTALRFTERARARIEKAGGECLTFDQLALRAPLGQNTVLLRGSRNAREAVKHFGPAPGVPHSHTKPYVRSKGRKFERARGKRNSRGFRV

SEQ ID NO: 7842 - protein, 187 aa, Cichorium intybus
MGIDLVAGGKSKRTKRTAPRSDDIYLKLLVKLYRFLVRRTGSNFNAVILKRLFMSKVNKPPISLSRLIRYMSGKDGKIGVVVGTVTDDVRVHEIPCLKVTALRFTETARARIEKAGGECLTFDQLALRAPLGQNTVLLRGPKNSREAVRHFGKAPGVPHSHTKPYVRSTGRKFEKARGRRNSRGFRN

SEQ ID NO: 7843 - protein, 187 aa, Cycas rumphii
MGIDLIAGGKSKKTKRTAPKSNDIYLKLLVKLYRFLVRRTNSRFNAVILKRLFMSRTNKPPLSLSRLVRFMTGKDDKIAVVVGTITDDTRVFELPPLKITALKFTETARARILKAGGECWSFDQLALRAPLGQNTVLLRGPKSHREAVKHFGRAPGVPHSHTKPYVRSKGRKFEKARGRRKSRGFKV

SEQ ID NO: 7844 - protein, 187 aa, Medicago truncatula
MGIDLKAGGKNKKTKRTAPKSNDIYLKLLVKLYRFLVRRTGSNFNAVILKRLFMSKVNKPPLSLSRLIKYTNGKEGKIAVVVGAITDDVRVNEVPAIKVTALRFTERARARIESAGGECLTFDQLALRAPLGQNTVLLRGPKNAREAVKHFGRAPGVPQSHTKPYVRGKSRKIEKARGKRKSRGFRV

SEQ ID NO: 7845 - protein, 185 aa, Nicotiana benthamiana
IDLKAGGKSKKTKRTAPKSDDVYLKLLVKLYRFLVRRTGSKFNAVVLKRLFMSKINKPPLSLSRLISYAKGKEDKVVVIVGTITDDVRAYEVPALKVCALRFTKTARARIEKAGGECLTFDQLALRAPLGQNTLLLRGPKNAREAVKHFGPAPGVPHSHTKPFVRSKGRKFERARGRRNSRGYKA

SEQ ID NO: 7846 - protein, 187 aa, Papaver somniferum
MGIDLIAGGKSKKTKRTAPKSDDIYLKLLVKLYRFLLRRTGSKFNGVILKRLFMSKVNKAPLSLSRLIKFMDNKGEKIGVLVGTVTDDVRIVKEVPKMKIAALRFTETARARIEKAGGECLTFDQLALRAPLGQNTVLLRGPKNSREAVKHFGAPGVPHSHSKPYVRSKGRKFEKARGKRNSRGFRV

SEQ ID NO: 7847 - protein, 186 aa, Raphanus sativus
GIDLIAGGKSKKTKRTAPKSDDVYLKLLVKLYRFLVRRTGSKFDAVILKRLFMSKVNKAPLSLSKLVEFMNDKDGKIAVLVGTITDDLRVHEIPAMKFTALRFTERARARIEKAGGECLTFDQLALVAPLGQNTVLLRGPKNSREAVKHFGPAPGVPHSHSKPYVRSKGRKFEKARGKRKSRGFKV

SEQ ID NO: 7848 - protein, 187 aa, Picea glauca
MGIDLIAGGKSKQTKRTAPKSEDIYLKLLVKLYRFLVRRTSSRFNAVILKRLFMSKTNKPPLSLSRLARYMQGKDDKVAVVVGTITDDNRVYELPPVKVTALRFTETARARILKAGGECLTFDQLALCAPLGQNTVLLRGPKSHREAVKHFGRAPGVPHSHTKPYVRSKGRKYEMARGRRNSRGFKV

SEQ ID NO: 7849 - protein, 134 aa, Brassica juncea
MSKVNKAPLSLSRLVEFMTGKEDKIAVLVGTITDDLRVHEIPAIKVTALRFTERARARIEKAGGECLTFDQLALRAPLGQNTVLLRGPKNSREAVKHFGPAPGVPHSHSKPYVRSKGRKFEKARGKRKSRGFKV

SEQ ID NO: 7850 - protein, 201 aa, Cynara scolymus
  misc_feature (61)..(61): Xaa can be any naturally occurring amino acid
NLAFHFSAGTLRRSLGIDLVAGGKSKKTKRTAPRSDDIYLKLLVKLYRFLVRRTGSSFNAXILKRLFMSKINKPPISLSRLIRYMAGKDDKIAVIVGTVTDDVRVHEIPCLKVTALRFTETARARIEKAGGECLTFDQLALRAPLGQNTVLLRGPKNCREAVRHFGKAPGVPHSHTKPYVRSKGRKYEKARGRRNSRGFRN

SEQ ID NO: 7851 - protein, 220 aa, Mesembryanthemum crystallinum
  misc_feature (181)..(181): Xaa can be any naturally occurring amino acid
  misc_feature (184)..(184): Xaa can be any naturally occurring amino acid
  misc_feature (186)..(186): Xaa can be any naturally occurring amino acid
  misc_feature (188)..(189): Xaa can be any naturally occurring amino acid
  misc_feature (191)..(192): Xaa can be any naturally occurring amino acid
  misc_feature (196)..(196): Xaa can be any naturally occurring amino acid
  misc_feature (201)..(201): Xaa can be any naturally occurring amino acid
  misc_feature (204)..(204): Xaa can be any naturally occurring amino acid
  misc_feature (206)..(206): Xaa can be any naturally occurring amino acid
  misc_feature (210)..(210): Xaa can be any naturally occurring amino acid
  misc_feature (214)..(214): Xaa can be any naturally occurring amino acid
  misc_feature (216)..(217): Xaa can be any naturally occurring amino acid
MGIDLKAGGKSKKTKRTAPKSNDVYLKLLVKLYRFLVRRTGSKFNAVILKRLFMSKINKPPLSLSRLIKYMEGKDGRIGVLVGTVTDDVRVYEVPTLKICALRFTETARARIEKAGGECLTFDQLALRAPLGQNTVLLRGPKNAREAVKHFGKAPGVPHSHTKPYVRANGRKFERARGRRXSRXYXNXXSXXFEAXMLVSXNVXNXCYYXVLCXRXXVIC

SEQ ID NO: 7852 - protein, 188 aa, Medicago truncatula
MGIDLKAGGKSKKTKRTAPKSNDIYLKLLVKLYRFLVRRTESNFNKVILKRLFMSKVNKPPLSLSRLIRYTKGKEGKIAVVVGAVTDDIRVYEVPAIKVTALRFTEKARARIEKAGGECLTFDQLALRAPLGQNTVLLRGPKNAREAVKHFGRAPGVPHSNTKPYVRGKKSRKVEAARGKRKSRGFKV

SEQ ID NO: 7853 - protein, 187 aa, Mimulus guttatus
MGIDLVAGGKSKKTKRTAPRSNDVYIKLLVKLYRFLTRRTGSSFNSIILKRLIMSRVNRPPLSLSRLSSLMKGKEGQIAVLVGSITDDIRVHEIPAMKVAALRFTETARARIEKAGGECLTFDQLALRAPLGQNTVLLRGSRKAREAVRHFGPAPGVPHSHTKPYVRSKGRKFEKARGKRNSKGFRV

SEQ ID NO: 7854 - protein, 187 aa, Mimulus guttatus
MGIDLVAGGKSKKTKRTKPKSDDIYIKLLVKLYSFLVRRTGSKFNEVVRKRLTMSRVNRPPLSLSRLSALMKGKENQIAVLVGSVTDDIRVHEIPAMKVAALRFTETARARIEKAGGECLTFDQLALRAPLGQNTVILRGSRKAREAVRHFGAAPGVPHSHTKPYVRSKGRKFEKARGRRKSRGFRV

SEQ ID NO: 7855 - protein, 187 aa, Salvia sclarea
MGIDLVAGGKVKKTKRTAPKPNDIYLKLLVKLYRFLVRRTGSKFNAVVLKRLFMSRINRPPLSLSRLSALTKGKEDKIAVLVGSVTDDIRVHDIPAMKITALRFTERARARIEKAGGECLTFDQLALRAPLGQNTVLLRGSRNAREAVKHFGPAPGVPHSHTKPYVRAKGRKFERARGRRNSRGFRV

SEQ ID NO: 7856 - protein, 187 aa, Unknown
  Sequence found in Organisms: Solanum tuberosum, Solanum phureja
MGIDLKAGGKSKKTKRTAPKSDDVYLKLLVKLYRFLARRTGSKFNAVILKRLFMSKINKPPLSLSRLISYAEGKGDKTVVLVGTVTDDVRAYEVPKLKVCALKFTKTARARIEKAGGECLTFDQLALRAPLGQNTLLLRGPKNAREAVKHFGPAPGVPHSHTKPYVRAKGRKFERARGKRKSRGYKV

SEQ ID NO: 7857 - protein, 187 aa, Antirrhinum majus
MGIDLVRGGKSKKTKRTAPKSNDIYLKLLVKLYRFLVRRTGSSFNAVVLKRLFMSKVNKAPLSLSRLIALMKNKEDKVAVLVGTVTDDIRVHEVPALKVTALRFTETARARIEKAGGECLTFDQLALRAPLGQNTVLLRGPRKAREAVKHFGPAPGVPHSHTKPYVRAKGRKFERARGKRNSKGFRV

SEQ ID NO: 7858 - protein, 187 aa, Antirrhinum majus
MGIDLVRGGKSKKTKRTAPKSNDIYLKLLVKLYRFLVRRTGSSFNAVVLKRLFMSKVNKAPLSLSRLIALMKNKEDKTAVLVGTVTDDIRVHEVPALKVTALRFTETARARIEKAGGECLTFDQLALRAPLGQNTVLLRGPRKAREAVKHFGPAPGVPHSHTKPYVRAKGRKFERARGKRNSKGFRV

SEQ ID NO: 7859 - protein, 184 aa, Trifolium pratense
MGIDLKAGGKSKKTKRTAPKSNDIYLKLLVKLYRFLDRRTDSNFNSVILKRLFMSKVNRPPISLSRVIEYLKGKDGKIGVIVGAVTDDIRVYEVPAIKIAALRFTETARARIEKAGGECLTFDQLALRAPLGQNTVLLRGPKNSREAVKHFGRAPGVPHSHTKPYVRAKGRKFEKARGKRNSRG

SEQ ID NO: 7860 - protein, 187 aa, Lactuca sativa
MGIDLVAGGKSKRTKRNAPRSDDIYLKLLVKLYRFLVRRTGSNFNAVILKRLFMSKVNKPPISLSRLIRYMAGKDDKIAVVVGTVTDDVRVDEIPCIKVTALRFTETARARIEKAGGECLTFDQLALRAPLGQNTVLLKGPKNCREAVRHFGKAPGVPHSHTKPYVRSTGRKFEKARGRRNSRGFRN

SEQ ID NO: 7861 - protein, 187 aa, Artemisia annua
MGIDLIAGGKSKRTKRNAPRSDDIYLKLLVKLYRFLFRRTGSKFNAVILKRLFMSKINKPPISLSRLARYMAGKDEKIAVIVGTVTDDVRVPEIPCMKVTALRFTETARARIEKAGGECLTFDQLALRAPVGQNTVLLRGPKNSREAVRHFGKAPGVPHAHTKPYVRSKGRKFEKARGRRNSRGFRN

SEQ ID NO: 7862 - protein, 187 aa, Ocimum basilicum
  misc_feature (26)..(26): Xaa can be any naturally occurring amino acid
MGIVLVAGGKVKKTKRTAPKSNDIYXKLLVKLYRFLVRRTGSRFNAVVLKRLFMSRINRPPLSLSRLSALMKGKEDKIAVLVGSVTDDVRAHDIPAIKVTALRFTERARARIEKAGGECLTFDQLALRAPLGQNTVLLRGSRNAREAVKHFGPAPGVPHSHTKPYVRSKGRKFERARGKRNSRGFRV

SEQ ID NO: 7863 - protein, 174 aa, Glycyrrhiza uralensis
MGIDLKAGGKSKKTKRTAPKSNDIYLKLLVKLYRFLVRRTGSNFNAVILKRLFMSKVNRPPLSLSRLIRYMKGKEGKIAVVVGTVTDDIRVHEVPALKVTALRFTETARARIEKAGGECLTFDQLALRAPLGQNTVLLRGPKNAREAVKHFGPAPGVPHSHTKPYVRAKGRKFE

SEQ ID NO: 7864 - protein, 187 aa, Marchantia polymorpha
MGIDLKAGGRNKKTTRTAPKSDNVYLKLLVKLYRFLVRRTDASFNAVVLKRLFMSKTHRAPISMSRLSRYMKGKEDKIAVIVGTVTDDVRLYEVPALKVAALRFTETARARILKNGGEIYTFDELALKAPTGTGCVLLRGPKNSREAVKHFGRAPGVPHSHTKPYVRHKGRKFEKARGRRNSRGFKV

SEQ ID NO: 7865 - protein, 187 aa, Medicago truncatula
MGIDLKAGGKSKNTKRTEPKSNDIYLKLLVKLYRFLVRRTDSNFNAVILKRLFMSKVNRPPISLSKMIEYMKGKDGKIGVVVGAVTDDIRVYEVPVLKIAALRFTETARARIEKAGGECLTFDQLALRAPLGQNTVLLRGPKNAREAVKHFGRAPGVPHSHSKPYVRSKGRKQEKARGKRKSRGFRV

SEQ ID NO: 7866 - protein, 187 aa, Unknown
  Sequence found in Organisms: Solanum lycopersicum, Solanum tuberosum
MGIDLKAGGKSKKTKRTAPKSDDVYLKLLVKLYRFLARRTGSKFNAVILKRLFMSKINKPPLSLSRLISYAEGKGDKTVVLVGTVTDDVRAYEVPKLKVCALKFTKTARARIEKAGGECLTFDQLALRAPLGQNTLLLRGPKNAREAVKHFGPAPGVPHSHTKPYVRAKGRKFERARGKRKSRGYKA

SEQ ID NO: 7867 - protein, 199 aa, Artemisia annua
NISFAGTPKPPSSWVLILLQEKSKRTKRNAPRSDDIYLKLLVKLYRFLVRRTGSKFNAVILKRLFMSKINKPPISLSRLARYMAGKDEKIAVIVGTVTDDVRVPEIPCMKVTALRFTETARARIEKAGGECLTFDQLALRAPVGQNTVLLRGPKNSREAVRHFGKAPGVPHAHTKPYVRSKGRKFEKARGRRNSRGFRN

SEQ ID NO: 7868 - protein, 188 aa, Triphysaria pusilla
MGIDLVAGGKSKKTKRTAPKSNDIYLKLIVKLYRFLVRRTGSSFNAVVLKRLFMSRVNKAPISLSKLAALMKGKEGKIAVLVGTVTDDIRLQDEVPAMKVTALRFTETARARIEKAGGECLTFDQLALRAPLGQNTVLLRGSPKAREAVKHFGPAPGVPHSHTKPYVRAKGRKFEKARGKRNSKGFRV

SEQ ID NO: 7869 - protein, 188 aa, Triphysaria pusilla
  misc_feature (66)..(66): Xaa can be any naturally occurring amino acid
MGIDLVAGGKSKKTKRTAPKSNDIYLKLIVKLYRFLVRRTGSSFNAVVLKRLFMSRVNKAPISLSXLAALMKGKEGKIAVLVGTVTDDIRLQDEVPAMKVTALRFTETARARIEKAGGECLTFDQLALRAPLGQNTVLLRGSPKAREAVKHFGPAPGVPHSHTKPYVRAKGRKFEKARGKRNSKGFRV

SEQ ID NO: 7870 - protein, 188 aa, Triphysaria pusilla
MGIDLVAGGKSKKTKRTAPKSNDIYLKLIVKLYRFLVRRTGSKFNAVILKRLFMSKINKPPLSLSKLSALMNGKEDKTAVLVGTVTDDIRLQGEIPAMKVTALRFTETARARIEKAGGECLTFDQLALRAPLGQNTVLLRGCRKAREAVRHFGAAPGVPHSHTKPYVRAKGRKFEKARGKRNSKGFRV

SEQ ID NO: 7871 - protein, 183 aa, Panax ginseng
MGIDLEAGGKSKRTKRTAPRSDDIYLKLIVKLYRFLVRRTGSKFNAVILKRLFMSKINKPPISLSRLIRFMTGKEDKIAVIVGTITDDIRVHEVPCLKVTALRFTETARARIEKAGGECLTFDQLALRAPLGQNTVLLKGPKNAREAAKHFGKAPGVPDSHSKPYVRAKGRKFEKARGRRNSR

SEQ ID NO: 7872 - protein, 195 aa, Petunia hybrida
MGIDLVAGGKSKKTKRTAPKSDDVYLKLLVKLYRFLVRRTGSQFNAVILKRLFMSKINKAPLSLSRLVIFMKGKEDKVAVVVGTITDDMRVYEVPSIKVAALRFTETARARIEKAGGECISFDQLALRAPLGQNTVLLRGPKNSREAVKHFGRAPGVPHSHTKPYVRAKGRKFERARGKRNSRGYRFNEVCLIAQ

SEQ ID NO: 7873 - protein, 187 aa, Triphysaria pusilla
GIDLVAGGKSKKTKRTAPKSNDIYLKLIVKLYRFLVRRTGSSFNAVVLKRLFMSRVNKAPISLSELAALMKGKEGKIAVLVGTVTDDIRLQDEVPAMKVTALRFTETARARIEKAGGECLTFDQLALRAPLGQNTVLLRGSPKAREAVKHFGPAPGVPHSHTKPYVRAKGRKFEKARGKRNSKGFRV

SEQ ID NO: 7874 - protein, 187 aa, Triphysaria pusilla
GIDLVAGGKSKKTKRTAPKSNDIYLKLIVKLYRFLVRRTGSSFNAVVLKRLFMSRVNKAPISLSKLAALMKGKEGKIAVLVGTVTDDIRLQDEVPAMKVTALRFTETARARIEKAGGECLTFDQLALRAPLGQNTVLLRGSPKAREAVKHFGPAPGVPHSHTKPYVRAKGRKFEKARGKRNSKGFRV

SEQ ID NO: 7875 - protein, 298 aa, Zea mays
MVWFQCEDCGENLKKPKLAGHFRSCSAYKLSCIDCGELFSHDTVQGHTQCISEAEKYGPKGQTKPSNGAQGKADKPKPNADVDINVGLSTRPPWFCSLCKTTTTSKQTLLLHADGKKHRAKAKAFHVSQKQKDGAEQTPDVKEAGVVPTKESAQVNGGVSGDHERNEDKDAGKRKRMDDMTIEPGNTKRQLTQSGDEKSENKAKSKADELASGTDCKSVQKQKIKWKKIITKTLKANADGVMKLKKLQKLVSKELQECGVSKDKEELRATLMDKIASSSRFYVDGKNVRLVAKNEEES

SEQ ID NO: 7876 - protein, 367 aa, Zea mays
MAPGLLAAAAVLAAVAASLAAHVALNCPVQPVPSHRPPPTPPPNNLLQRLEKLGEGALDAPEDVYVDAAAGGALYTATRDGWLQRMMHPNNGSWERWRFVGGTGLLGVAPSADGTMLVCDADKGLLRVGDEGVTLLASEVEGSPIRFADAAIEASDGTVYFSDASTRFGFDRWFHDFLEFSSTGRLLRYDPRSGETSVVLDRLGFANGVALPRDEAFVVVCETMRFRCIKVWLKGDKAGEAETFVDLPGWPDNIRLGSDGHFWIAVLQLRSPWLDFITRWTFTKRVVASFPALSEWSKGAAKGAMVAQVSEDGTILRVLDDSQGKVINFVTSVTEFNGDIFLGSLATNFVGKLSLARVAQKQGAVSS

SEQ ID NO: 7877 - protein, 387 aa, Sorghum bicolor
MAPGLLAAAGVVAAVASLAAHVALNCPVQPVPSTPRPPTPPPNNLLQRLEKLGEGALDAPEDVYFDAAAGGVLYTATRDGWLQRMHPNNGSWERWRFVGGTGLLGVAPSADGTMLVCDADKGLLRVGEEGVTLLASEVEGTTIRFADAAIEASDGTVYFSDASTRFGFDRWFYDFLESRVTGRLLRYDPRNGETSVVLDRLSCANGVALSRDETFVVVCETWRFRCLKVWLKGEKAGKAETFVDLPGAPDNIRLGSDGHFWIALHLISSPWLDFITRWTFTKRVVASFPVLLKWSKATIKGAMVAQVSEDGNILRVLDDSEGKVINSVTSVTEFNGDIFLGSLATNFVGKLSLVQLCFAWVDGFQVLIDFSFCQHSESWIIRPDNPN

SEQ ID NO: 7878 - protein, 368 aa, Sorghum bicolor
MAPGLLAAAGVVAAVASLAAHVALNCPVQPVPSTPRPPTPPPNNLLQRLEKLGEGALDAPEDVYFDAAAGGVLYTATRDGWLQRMHPNNGSWERWRFVGGTGLLGVAPSADGTMLVCDADKGLLRVGEEGVTLLASEVEGTTIRFADAAIEASDGTVYFSDASTRFGFDRWFYDFLESRVTGRLLRYDPRNGETSVVLDRLSCANGVALSRDETFVVVCETWRFRCLKVWLKGEKAGKAETFVDLPGAPDNIRLGSDGHFWIALHLISSPWLDFITRWTFTKRVVASFPVLLKWSKATIKGAMVAQVSEDGNILRVLDDSEGKVINSVTSVTEFNGDIFLGSLATNFVGKLSLVQVTHEQGAVSSLDV

SEQ ID NO: 7879 - protein, 344 aa, Saccharum officinarum
MEAEKKTPAVSDVGAWAMNVVSSVSLIMANKQLMSSSGYAFAFATTLTGFHFTVTALVGWISNATGYSVSKHVPLWELVWFSLVANTSITGMNLSLMLNSVGFYQISKLSMIPVVCLMEWVLNSKHYTTKVISAVIVVAAGVGICTVTDVEVNAKGFICACVAVFCTSLQQITIGSFQKKYNIGSFELLSKTAPIQALSLVILGPFVDYYLNGRSLLNYPFSGGATFFILLSCSLAVFCNMSQYLCIGRFSATSFQVLGHMKTVCVLILGWILFDSALTVKNILGMLLAVMGMVVYSWAVEAEKKAAAPIPRNKSDMLDGEDVPLKARVSGVPAGDLEDGEMKS

SEQ ID NO: 7880 - protein, 344 aa, Saccharum officinarum
MEAEKKTPAVSDVGAWAMNVVSSVSLIMANKQLMSSSGYAFAFATTLTGFHFTVTALVGWISNATGYSVSKHVPLWELVWFSLVANTSITGMNLSLMLNSVGFYQISKLSMIPVVCLMEWVLNSKHYTTKVISAVIVVAAGVGICTVTDVEVNAKGFICACVAVFCTSLQQITIGSFQKKYNIGSFELLSKTAPIQALSLVILGPFVDYYLNGRSLLNYPFSGGATFFILLSCSLAVFCNMSQYLCIGRFSATSFQVLGHMKTVCVLILGWILFDSALTVKNILGMLLAVMGMVVYSWAVEAEKKAAAPIPRNKSDMLDGEDVPLKARVSGVPTVDLEDGEMKS

SEQ ID NO: 7881 - protein, 344 aa, Zea mays
MEAEKKPPAVSDVGAWAMNVVSSVSLIMANKQLMSSSGYAFAFATTLTGFHFTVTALVGWISNATGYSVSKHVPLWELVWFSLVANTSITGMNLSLMLNSVGFYQISKLSMIPVVCLMEWVLNSKHYTTKVISAVIVVAAGVGICTVTDVEVNAKGFICACVAVFCTSLQQITIGSFQKKYNIGSFELLSKTAPIQALSLIILGPFVDYYLNGRSLLNYPFSGGATFFILLSCSLAVFCNMSQYLCIGRFSATSFQVLGHMKTVCVLILGWILFDSALTVKNILGMLLAVMGMVVYSWAVEAEKKAAAPIPRNKGGMLDGEDVPLKARVSGVPAVDLEDGDVKG

SEQ ID NO: 7882 - protein, 344 aa, Zea mays
MEAEKKAPAVSDVGAWAMNVVSSVSLIMANKQLMSSSGYAFAFATTLTGFHFTVTALVGWISNATGYSVSKHVPLWELVWFSLVANTSITGMNLSLMLNSVGFYQISKLSMIPVVCLMEWVLNSKHYTTKVISAVVVVAAGVGICTVTDVEVNAKGFICACVAVFCTSLQQITIGSFQKKYNIGSFELLSKTAPIQAISLIILGPFVDYYLNGRSLLNYPFSGGATFFILLSCSLAVFCNMSQYLCIGRFSATSFQVLGHMKTVCVLILGWILFDSALTVKNILGMLLAVMGMVVYSWAMEAEKKVAAPVPRIKSEMLDGEDVPLKARVSGVPAVDLEDGEMKS

SEQ ID NO: 7883 - protein, 344 aa, Panicum virgatum
MEAEKKPPAVSDVGAWAMNVVSSVGIIMANKQLMSSSGYAFAFATTLTGFHFTVTALVGWISNATGYSVSKHVPLWELVWFSLVANTSITGMNLSLMLNSVGFYQISKLSMIPVVCLMEWVLNSKHYTTKVISAVVVVAAGVGICTVTDVEVNAKGFLCACVAVFCTSLQQITIGSFQKKYNIGSFELLSKTAPIQAISLIILGPFVDYYLNGRSLLNYNFSGGATFFILLSCSLAVFCNMSQYLCIGRFSATSFQVLGHMKTVCVLILGWILFDSALTVKNILGMLLAVMGMVVYSWAVESEKKAATPIPRNKSDMLDGEDVPLKARVSGLPSVDLEEGEMKS

SEQ ID NO: 7884 - protein, 345 aa, Oryza sativa
MEAEKKPPAVSDVGAWAMNVVSSVGIIMANKQLMSSSGYAFSFATTLTGFHFTVTALVGWISNATGYSVSKHVPLWELVWFSLVANTSITGMNLSLMLNSVGFYQISKLSMIPVVCLMEWVLNSKHYTTKVISAVVVVAAGVGICTVTDVEVNAKGFICACVAVFCTSLQQITIGSFQKKYNIGSFELLSKTAPIQAVSLIILGPFADYYLNGRWLLNYNFSTGATFFILLSCSLAVFCNMSQYLCIGRFSATSFQVLGHMKTVCVLILGWILFDSALTVKNILGMLLAVMGMVVYSWAVETEKKASAPIPRNKSDMLDDSEDVPLKARVSGLPSSDLEEGEMKS

SEQ ID NO: 7885 - protein, 349 aa, Triticum aestivum
MEPAEKKPPAVSDLGAWGMNVVSSVGLIMANKQLMSSAGYAFSFATTLTGFHFTVTALVGWISKATGYSASKHVPLWELVWFSLVANASITGMNLSLMLNSVGFYQISKLSMIPVVCLMEWVLNSKHYTTKVISAVVVVAAGVGICTVTDVEVNAKGFICACVAVFCTSLQQITIGSFQKKYNIGSFELLSKTAPIQAVSLIILGPFVDYYLNGRWLLNYSFSTGATFFILLSCSLAVFCNMSQYLCIGRFSATSFQVLGHMKTVCVLILGWVLFDSALTIKNILGMLLAIMGMVVYSWAMESEKKATSAIPRNKSDMLDGEDVPLKSRTSGIPLSSELDDLEEGPMKS

SEQ ID NO: 7886 - protein, 348 aa, Leymus cinereus x Leymus triticoides
MEPAEKKPPAVSDLGAWGMNVVSSVGLIMANKQLMSSAGYAFSFATTLTGFHFTVTALVGWISKATGYSASKHVPLWELVWFSLVANASITGMNLSLMLNSVGFYQISKLSMIPVVCMMEWVLNSKHYTTKVISAVVVVAAGVGICTVTDVEVNAKGFICACVAVFCTSLQQITIGSFQKKYNIGSFELLSKTAPIQAVSLIILGPFVDYYLNGRWLLNYSFSTGATFFILLSCSLAVFCNMSQYLCIGRFSATSFQVLGHMKTVCVLILGWVLFDSALTIKNILGMLLAIMGMVVYSWAMESEKKATSAIPRNKSDMLDGEDVPLKSRTSGIPLSSELDLEEGPMKS

SEQ ID NO: 7887 - protein, 349 aa, Hordeum vulgare
MEPAEKKPPAVSDLGAWGMNVVSSVGLIMANKQLMSSAGYAFSFATTLTGFHFTVTALVGWISKATGYSASKHVPLWELVWFSLVANASITGMNLSLMLNSVGFYQISKLSMIPVVCMMEWVLNSKHYTTKVISAVVVVAAGVGICTVTDVEVNAKGFICACVAVFCTSLQQITIGSFQKKYNIGSFELLSKTAPIQAVSLIILGPFVDYYLNGRWLLNYSFSTGATFFILLSCSLAVFCNMSQYLCIGRFSATSFQVLGHMKTVCVLILGWVLFDSALTIKNILGMLLAIMGMVVYSWAMESEKKATSAIPRNKSDMLDGEDVPLKSRTSGIPLSSELDDLEEGPMKS

SEQ ID NO: 7888 - protein, 349 aa, Brachypodium distachyon
MEPEKKPPAVSDLGAWGMNVVSSVGIIMANKQLMSSSGYAFSFATTLTGFHFTVTALVGWISKATGYSASKHVPLWELIWFSLVANTSITGMNLSLMLNSVGFYQISKLSMIPVVCLMEWVLNSKHYTSKVISAVVVVAAGVGICTVTDVEVNAKGFICACVAVFCTSLQQITIGSFQKKYNIGSFELLSKTAPIQAVSLIILGPFVDYYLNGRSLLEYSFSTGATFFILLSCSLAVFCNMSQYLCIGRFSATSFQVLGHMKTVCVLILGWILFDSALTIKNILGMLLAIMGMVVYSWAMESEKKATALIPRNKSDMLDGEDVPLKSRTSGLPASDLDLDLEEGGPTKS

SEQ ID NO: 7889 - protein, 481 aa, Brachypodium distachyon
MTITGVWHHLYYTRISRELSRVEKTIPRNNTAAVWPAAPGNQSTSDRQSSETAMHPKRPVGRVAFHDEGLPLHLDKKSFRFLASLLATAGKAPFHPLAQPSGNSYEEKNTDIVQLPNVEQELLQICTTRFWGDGAGEEAAGVSDLGAWGMNVVSSVGIIMANKQLMSSSGYAFSFATTLTGFHFTVTALVGWISKATGYSASKHVPLWELIWFSLVANTSITGMNLSLMLNSVGFYQISKLSMIPVVCLMEWVLNSKHYTSKVISAVVVVAAGVGICTVTDVEVNAKGFICACVAVFCTSLQQITIGSFQKKYNIGSFELLSKTAPIQAVSLIILGPFVDYYLNGRSLLEYSFSTGATFFILLSCSLAVFCNMSQYLCIGRFSATSFQVLGHMKTVCVLILGWILFDSALTIKNILGMLLAIMGMVVYSWAMESEKKATALIPRNKSDMLDGEDVPLKSRTSGLPASDLDLDLEEGGPTKS

SEQ ID NO: 7890 - protein, 497 aa, Sorghum bicolor
MENGTSNGSTGGAACCNGNGAVRGPHVAMLATPGMGHLIPLAELAKRLASRHGATATLITFASTASATQRAFLASLPPAVTSLSLPPVDLSDLPRGAAIETLMSEECARSVPALTSILLDLKRTTGGRLAAFVADLFGADSLDAARAAGVRRRCIFFPTNLHALTLMLHLPELDASVSCEFRDLPEPLRLPGCVPIPGPDILMPLQDKANPCYRWMVHHGGKYRDADAILVNSFDAVEPGPAKILRQPAADHRPVVYPIGPLIHADGREDDKDALCLEWLDRQPARSVMFVSFGSGGALPTEEMRELALGLELSGQRFLWVVRSPSDEGAVNDNYYDAESKKDPFAYLPEGFVDRVTATGVGLVVPSWAPQTKVLAHAATGGFLTHCGWNSVLESLVYGVPMVAWPLFAEQRQNAVMLSDGVGAALRVPESSKGREEIAATVREVMQGEGKGAAVRAKVAELQKAAAEGLRDGGAAATALAEVVEGWTTTGGQEEED

SEQ ID NO: 7891 - protein, 536 aa, Saccharum officinarum
  misc_feature (13)..(13): Xaa can be any naturally occurring amino acid
  misc_feature (68)..(68): Xaa can be any naturally occurring amino acid
  misc_feature (93)..(93): Xaa can be any naturally occurring amino acid
  misc_feature (252)..(252): Xaa can be any naturally occurring amino acid
  misc_feature (356)..(356): Xaa can be any naturally occurring amino acid
  misc_feature (399)..(399): Xaa can be any naturally occurring amino acid
PTITIHHTQPPPXSGVAAHSTPPGEKAAPTAQKWRTAAATAPPPPPAATATATAPPPAPAPSGAARGXHVAMLATPGMGHLIPLAELAKRLAXRHGATATLITFASTASATQRAFLASLPPAVTSLSLPPVDLSDLPRGAAIETLMSEECARSVPALTTILLDLKRSTGGRLAAFVADLFGADSLDAARAAGVRRRCIFFPTNLHALTLILHLPELDASVPCEFRDLPEPLRLPGCVPIPGPDILMPLQDKXDPCYRWMVHHGAKYREADAILVNSFDAVEPGPAKILRQPADHHPAVYPIGPLIHADGRKDDKDALCLEWLDRQPARSVIFVSFGSGGALPTEQMRELALGLELXGQRFLWVVRSPSDEGAVNDNYYDAESKKDPFAYLPEGFVERTXGVGLVVPSWAPQTKVLAHESTGGFLTHCGWNSVLESLVYGVPMVAWPLYAEQRQNAVMLSDGVGAALRVPESKVREKIAATVREVMQGEGKGAAVRAKVAELQKAAAEGLRDGGAAAAALAEVVQGWTATTGGQEED

SEQ ID NO: 7892 - protein, 488 aa, Panicum virgatum
MENGNGASPCCNGNGNGNGAAAAAPPPHVAMLVTPGMGHLIPLAELAKRLARRHGATATLLTFASAASATQRAFLASLPPAVTSLALPPVDLSDLPRGAAIETLMSEECARSVPALTDILRDLRRRTRLVAFVADLFGADSFDAARAAGVARRYLFFPTNLHALTLFLHLPELDAAVPGEFRDLAEPLRLPGCVPIPGPDVLMPLQDKSNPCYRWMVHHGAKYREADAILVNSFDAAEPGPAKILRQPAPGRPAVFPVGPLIQADRGGSDGPCPCLEWLDRQPARSVIFVSFGSGGALPAEQMRELALGLELSGQRFLWVVRSPSDEGAVNDNYYDAESKKDPFAYLPEGFVDRTRDVGLVVPSWAPQIKVLAHGATGGFLTHCGWNSVLESLVYGVPMVAWPLYAEQRQNAVMLSEGVGAAIRVPESKGREKIAAAVREVMEGEGRGAAVRAKVAELQKAAAEGLQEGGAATAALAEVVEKWTCEEN

SEQ ID NO: 7893 - protein, 313 aa, Saccharum officinarum
MPHRLVPFLLLLAATGAGAANPRQLFLVSQPPVTLTNHHGQLLTGNYSVNLLWYGRFTPAQRAVVADFILSLSGPGPASASAPPSVAAWWATTARYHPGAARLSLGRQVLDPTLSLGRRLSESSLASLAARLGPHRDTVAVVVTAPDVLVDGFCLSRCGLHASASPPAPASSAHGGRGRFAYAWVGNPAEQCPGECAWPFHQPPYGPQAAPLVSPNADVGMDGAVITLATLLAGAVTNPYGGGFFQGPAEAPLEAVSACAGVFGAGAYPGYPGQVRVDAATGASYNAVGVAGRRFLLPAMWDPATAQCSTPLV

SEQ ID NO: 7894 - protein, 313 aa, Saccharum officinarum
  misc_feature (6)..(6): Xaa can be any naturally occurring amino acid
  misc_feature (8)..(8): Xaa can be any naturally occurring amino acid
MPHRLXPXLLLLAATGAGAANPRQLFLVSQPPVTLTNHHGQLLTGNYSVNLLWYGRFTPAQRAVVADFILSLSGPGPASASAPPSVAAWWATTARYHPGAARLSLGRQVLDPTLSLGRRLSESSLASLAARLGPHRDTVAVVVTAPDVLVDGFCLSRCGLHASASPPAPASSAHGGRGRFAYAWVGNPAEQCPGECAWPFHQPPYGPQAAPLVSPNADVGMDGAVITLATLLAGAVTNPYGGGFFQGPAEAPLEAVSACAGVFGAGAYPGYPGQVRVDAATGASYNAVGVAGRRFLLPAMWDPATAQCSTPLV

SEQ ID NO: 7895 - protein, 53 aa, Zea mays
MGGRLTRNSCRGVAALACAAARRTTSRKRLWGMAAFALLGRDEMDWSLPSGRD

SEQ ID NO: 7896 - protein, 307 aa, Zea mays
MPHSLFLLVVLLAAAQASAATPRQLFLVSRPPITLTNHHGQLLTGNYSVNLLWYGRFTPAQRAVVADFILSLSGTGPGSVAAWWATTSRYHPGAARLSLGRQVLDPSRSLGRRLSESSLASLATRLAPHRGSVAVVVTAPDVLVDGFCLSRCGLHASSPTPNATRGRGRGRYVYAWVGNPAEQCPGECAWPFHQPLYGPQPAAAPLVAPNADVGMDGAVITLATLLAGAVTNPYGGGFFQGPAEAPMEAVTACAGVFGAGAYQGYPGQLRVDAATGASYNAVGIAGRRFLLPAMWDPETAQCSTPLD

SEQ ID NO: 7897 - protein, 563 aa, Zea mays
MGVSEEAARVWAELPVRVDWAAAAAQCASLWAHARALLVAPAVRVLVLLSLAMTVMILAEKLFVCAVCLAVRALRLGPDRRYRWEPIGGGVGDEEEESGSGHGAKYPMVLVQIPMYNEREVYKLSIGAACELEWPSERFMIQVLDDSTDPVVKDLVETECQRWKSKGVNIKYEVRGNRKGYKAGALKEGLKHDYVEDCEYIAMFDADFQPEPDFLLRAVPFLVHNPEIALVQARWKFVNSGECLLTRFQEMSLDYHFKYEQEAGSSLHSFFGFNGTAGVWRIAAIDDAGGWKDRTTVEDMDLAVRAMLQGWKFVYVGDIKVKSELPSTFKAYRFQQHRWSCGPANLFKKMMVEILENKKVSLWSKIYLWYNFFFVGKVAAHTVTFIYYCCAIPVSVLLPEIQIPLWGVVYIPTLITLLKALGTPSSFHLVILWVLFENVMSLHRIKAAASGLLDAGGRVNEWVVTEKLGDTSKAKPGANGSDDVKVIDVKLTEPLVPKLVKRRARFWERYNCSELFVGTCILLCGFYDLLFAKKGYYIFLFLQGTAFLVVGFGYVGTLPHCNA

SEQ ID NO: 7898 - protein, 252 aa, Panicum virgatum
MGSSSHQKGRIRTKKPLGIQLFECVQGSPISFRSCQALVLVLTFLSYASYHATRKTTSIVKSVLDPKTNLGMLHWPSHLYLQNLKGSENNTLSSGWAPFNAKDGTALLGEIDLAFLGVYAIGMFFAGHLGDRVDLRILLTIGMIGTGLFTAAFGAGYWFNIHSFYYFLGMQMMAGPVSVIWMAFSSCSGWQLVWEEQEGADNGNLECSHICRKHIWLSDCCCNVEVWMVLVLCCARYHDRTSRAHGVPVVAC

SEQ ID NO: 7899 - protein, 519 aa, Saccharum officinarum
MGSSSHQKNKMCSRKPLGIQLFECVRGSPISFRSCQALVLLLTFLSYASYHATRKTTSIVKSVLDPKKNLGMLHWPSHLYLQNLKGAENNTTLSSGWAPFNAEDGTALLGEIDLAFLGVYAIGMFFAGHLGDRVDLRILLTIGMIGTGLFTAAFGAGYWFDVHNFYYFLGMQMISGLFQSSGWPSVVAVVGNWFGKSKRGLIMGIWNAHTSVGNISGSLIAAAMLKYGWCWSFAVPGIMIALVGLTVFLFLPVGPDVIGIQEDLHLKDYEKSDTDTPLLERRSSDVKEKAVGFIEAWRIPGVAPFALCLFFCKLVAYTFLYWLPFYISHTAIGGQYLSDSEAGVLSTLFDVGGVVGGILAGHISDHLDARALTAASFTFSAIPALFFYRIYGNVSLAWNIALMFVTGMLVNGPYALITTAVSADLGTHSSLNGNSRALATVTAIIDGTGSIGAAVGPLLTAYISARSWSAVFTMLMASALVAGLLLSRLVVADVAAKMESRKTPAPGASDPARVLHGRN

SEQ ID NO: 7900 - protein, 534 aa, Saccharum officinarum
  misc_feature (335)..(335): Xaa can be any naturally occurring amino acid
  misc_feature (339)..(339): Xaa can be any naturally occurring amino acid
  misc_feature (461)..(461): Xaa can be any naturally occurring amino acid
  misc_feature (493)..(493): Xaa can be any naturally occurring amino acid
MGSSSHQKNKMCSRKPLGIQLFECVRGSPISFRSCQALVLLLTFLSYASYHATRKTTSIVKSVLDPKKNLGMLHWPSHLYLQNLKGAENNTTLSSGWAPFNAEDGTALLGEIDLAFLGVYAIGMFFAGHLGDRVDLRILLTIGMIGTGLFTAAFGAGYWFDVHNFYYFLGMQMISGLFQSSGWPSVVAVVGNWFGKSKRGLIMGIWNAHTSVGNISGSLIAAAMLKYGWCWSFAVPGIMIALVGLTVFLFLPVGPDVIGIQEDLHLKDYEKSDTDTPLLERRSSDVKEKAVGFIEAWRIPGVAPFALCLFFCKLVAYTFLYWLPFYISHTAIGGXYLSXSEAGVLSTLFDVGGVVGGILAGHISDHLDARALTAASFTFSAIPALFFYRIYGNVSLAWNIALMFVTGMLVNGPYALITTAVSADLGTHSSLNGNSRALATVTAIIDGTGSIGAAVGPLLTXYISARSWSAVFTMLMASALVAGLLLSRLVVAXVAAKMESRKTPAPGASDPARVLHGRNRKFPFCLPPLGGLCG

SEQ ID NO: 7901 - protein, 515 aa, Oryza sativa
MGSPSKTRRMKPLGIQLYECARGSPISFRSCQALVLILTFLSYASYHATRKTTSIVKSVLDPKTENLGMLHWPSHLYLQDLRDAQGNMTALYSGWAPFNADDGTALLGEIDLAFLGVYAIGMFFAGHLGDRVDLRILLTIGMIGTGFFTAAFGAGNWLNIHNFYYFLGVQMMAGLFQSSGWPSVVAVVGNWFGKSKRGLIMGIWNAHTSVGNISGSLIAAAMLKFGWSWSFAVPGVMIAVVGLAVFLFLPVGPEMIGIEEDIHEKDAEKDDMSAPLLEERSASKEKAVGFIQAWRIPGVAPFALCLFFCKLVAYTFLYWLPFYISHTAIGGVYLSDTAAGVLSTLFDVGGVVGGILAGHISDRLDARALTAASFTFSAIPALFFYRIYGSFSLYSNIALMFVTGMLVNGPYALITTAVSADLGTHSSLNGNSRALATVTAIIDGTGSIGAAVGPLLTGYISAKSWSGVFTMLMASAFVAGLLLSRLVMAEISAKMESRRPDAAASDLPVSSMEQS

SEQ ID NO: 7902 - protein, 520 aa, Brachypodium distachyon
MGSSSGCRSKMGTTKPLGIQLFECVRGGPLSFRSSQALVLILTFLSYASYHATRKTTSIVKSVLDPKTANVGMLHWPSNLYLQHLNKAENNNTAIHNGWAPFNGDGGTALLGEIDLAFLGVYAIGMFFAGHLGDRVDLRILLTIGMVGTGLFTAAFGAGYWFNIHSFYYFLGVQMIAGLFQSSGWPSVVAVVGNWFGKSKRGLIMGIWNAHTSVGNISGSLIAAAMLKFGWCWSFAVPGAMIALVGIAVFLFLPVGPEVIGIEEDRRVKDSEKDDMDAPLLEKRQSDARDEAVGFIQAWRIPGVAPFALCLFFCKLVAYTFLYWLPFYLSHTAIGGEYLSDSAAGVLSTLFDVGGVVGGILAGHISDRLDARALTAASFTFSAIPALFFYRIYGSVSLAWNVALMFLTGVLVNGPYALITTAVSADLGTHSSLNGNSRALATVTAIIDGTGSIGAAVGPLLTGYISAKSWSGVFTMLMASALIAGLLLSRLVVAEISAKMESRRAADHASDLPVSSLEEA

SEQ ID NO: 7903 - protein, 532 aa, Zea mays
MGSSSGHQRSKTRSRNRKPLGIQLFERVRGSGSPISFRSCQALVLVLTFLSYASYHATRKTTSIVKSVLDPKTKTNLGTSSAHYWPPSHLFYLQNLKGADSNSTALSSGGGGWAPFNAAEDGTALLGEIDLAFLGAYAAGMFFAGHLGDRVDLRVLLAVGMVGTGLFTAAFGAGYWLDVHSFYYFLAVQMVAGLFQSSGWPSVVAVVGNWFGKSKRGLIMGVWNAHTSVGNISGSLVAAAMLRYGWCWSFVVPGVVIALVGLAVFLLLPVAPDVIGVQEDLCLKDAPLLERRRADVEEKAVGFIEAWRIPGVAPFALCLFFCKLVAYTFLYWLPFYISHTAIGGEYLSDSAAGVLSTLFDVGGVVGGILAGHISDHLDARALTAASFTFSAIPALFFYRVYGNVSLAWNIALMFVTGMLVNGPYALITTAVSADLGTHSSLNGNSRALATVTAIIDGTGSIGAAVGPLLTGYISARSWSAVFTMLMASALVAGLLLSRLVAAEVVAKMESRRTPAPAASDLLPVSSSSMDEP

SEQ ID NO: 7904 - protein, 533 aa, Zea mays
MGSSSGHQRSKTRSRNRKPLGIQLLERVRGSPISFRSCQALVLVLTFLSYASYHATRKTTSVVKSVLDPKTKTNLGTSSAHYWPPSHLFYLHNLKDADNSSAGGSLSSGGGGGWVPFNEAEDGTALLGEIDLAFLGAYAAGMFFAGHLGDRVDLRVLLTVGMVGTGLFTAAFGAGYWLDVHSFYYFLAVQMVAGLFQSSGWPSVVAVVGNWFGKSKRGLIMGVWNAHTSVGNISGSLVAAAMLRYGWCWSFVVPGVVIALVGLAVFLLLPVAPDVIGVQEDLCLKDAPLLERRRADVEEKAVGFIEAWRIPGVAPFALCLFFCKLVAYTFLYWLPFYISHTAIGGEYLSDSAAGVLSTLFDVGGVVGGILAGHISDHLDARALTAASFTFSAIPALFFYRVYGNVSLAWNIALMFVTGMLVNGPYALITTAVSADLGTHSSLNGNSRALATVTAIIDGTGSIGAAVGPLLTGYISARSWSAVFTMLMASALVAGLLLSRLVAAEVVAKMESRRTPAPAASDLLPVSSSSMDEP

SEQ ID NO: 7905 - protein, 330 aa, Sorghum bicolor
SSAAAPAGEASTSEPAAKGKPIVVRVKRKPSQTRPDAFWLEINERPAKKAMLDFSSLSISDPPSSSSAASAKASEEPRVKKLLVQHIETVHHSEAVEDVLHSLLLADLNSKEIKSKTKEWNDRIKQDKKPEELRSAARQRHEDMGRNARFAQIWKSRKGENNDADDSLREICHLYDAVQVDHDDEKHPAEPRITSFEEGAVLCNFLPLIREYLPSAAEEIESDIISLAQSEDSEVYDIYTVKEVDDTNMEATSAASYPRLQVDDGEDECYDDDYPYDTDDSNAEDNPLFDYPDELSEDEDDGSNDEDPFGDEEGSDTEYEKEEVEAEEDE

SEQ ID NO: 7906 - protein, 332 aa, Sorghum bicolor
MASSAAAPAGEASTSEPAAKGKPIVVRVKRKPSQTRPDAFWLEINERPAKKAMLDFSSLSISDPPSSSSAASAKASEEPRVKKLLVQHIETVHHSEAVEDVLHSLLLADLNSKEIKSKTKEWNDRIKQDKKPEELRSAARQRHEDMGRNARFAQIWKSRKGENNDADDSLREICHLYDAVQVDHDDEKHPAEPRITSFEEGAVLCNFLPLIREYLPSAAEEIESDIISLAQSEDSEVYDIYTVKEVDDTNMEATSAASYPRLQVDDGEDECYDDDYPYDTDDSNAEDNPLFDYPDELSEDEDDGSNDEDPFGDEEGSDTEYEKEEVEAEEDE

SEQ ID NO: 7907 - protein, 123 aa, Zea mays
MAHPMPPLSASQSTITTVLKILPKPPAAPESRSNNCAFGAKFDSRRALLCGLVAAAAAAGTMLGADIAGAASKRRPPPPAPAEAKKDPNVSGVQAKVLASRKRKEAMKEAVAKLREKGKPVDK

SEQ ID NO: 7908 - protein, 96 aa, Zea mays
MQIFVKTLTGKTITLEVESSDTIDNVKAKIQDKEGIPPDQQRLIFAGKQLEDGRTLADYNIQKESTLHLVLRLRGGMQIFVKTPDRQDYHPRGGVL

SEQ ID NO: 7909 - protein, 476 aa, Zea mays
ASHSVPPPPRCVCVCLRRPQCPQPEPAHALLRRRRSLVRERVAKQALELPPAAGAVQPGRARRSMNGVGDAHAAAAAAAMVQQTLGMSLPMAAFVPEQGSANRLTRPPGLPPLPQAFAAQQRGDVCMEAVDPAAGPRKAHRRSRSDVPFGYFPPAGHHQLPPPKVEAGWGGHLPAGGGGGGDDDLFNAYLNLEGLDGLNSSDDRLDDGDSRGSSMRTNGADSSENESEECAADSRAGIRLCAAAADRREGLKRAAAAPVARHARSLSMDSLIGKLNFSAGATGAASGVIPGPNRFSLEFGTGEFSPVEMKKIMADEKLAEMALADPKRVKRVLANRQSAARSKERKMRYIGELEHKVQILQTEATTLSAQLTLLQRDSAGIATQNNELKFRLQAMEQQAQLRDALNEALTAEVQRLKVATAELGDSCSSSNLAQQIQISVQDQMFQLHQQQATPIPFYQLQQAQQNGAGKKHEPTE

SEQ ID NO: 7910 - protein, 217 aa, Panicum virgatum
ARHARSLSMDSLIGKLNFSAGAMPSGGVMPGPNRSASSSAAASSHRRDEEDHADEKLAEMALADPKRVKRVLANRQSAARSKERKMRYIAELEQKVQILQTEATTLSAQLTLLQRDSAGIATQNNELKFRLQAMEQQAQLRDALNEALTAEVQRLKIATAELGDSCSSNNLAQQLQLSAQDQMFQLQQQQQQVTPIPFYQLQQAQQNGAGKNQDSTE

SEQ ID NO: 7911 - protein, 426 aa, Oryza sativa
MNGGIGDALMQPQHVQVMSSSLPMVASTFVAEPAAAANKPRAAGLPPTPPQVFAAQRAAAAAGGDVCMEESAQGGGGGLPPRKAHRRSSSDVPFGYLAGQHQLLPPKVEAGWGHLGAGAGGAAAADDLFNAYLNLEGLDGLNSSDDRHDEGDSRGSSIKTNGADSSENESEECADDTRGGIRLWSADGGERREGVKRNAAGEPATAPLARHARSLSMDSLIGKFNFTAGTAAAAGNGVALGPNRFSLEFGSGEFTPSEMKKIMADEKLAEMALADPKRVKRVLANRQSAARSKERKMRYIAELEQKVQILQSEATNLSAQLTMMQRDSAGLATQNNELKFRLHAMEQQAQLRDALNEALTTEVQRLKLATAELGDSCSSSSLAQQIQLNAQNQMFQLQQQQATQIPFYQLQQSQQNGAAKNNESKE

SEQ ID NO: 7912 - protein, 342 aa, Zea mays
PPAVCMEAFAAQHQGDVCMEAVGVDTAAQQGPRPRTAHRRSRSDVPSGYYFGGEGHQLPPPKVEAGWGGHLHGGGGDDDLFNAYLNLEGLDGLNSSDDRRQYYDGDSRGSSVRTNGADSSENDSEECAAAGPPVAHHVRSLSMDSSLIGKLNFSAGAAAANGGVIPGPNRFSLEFGSGEFTPVEMNKIMADEKLAEMALADPKRAKRVLANRQSAARSKERKMRYIAELEQKVQILQTEATALSAHLTLLQRDSAGIATQNNELQFRLQAMAQQAQLRDALNEALTAEVQRLKLATAELGDSCSSNSLAQQMQIQLSAHDQTFELHQQQAMPIAFYQLRQAQ

SEQ ID NO: 7913 - protein, 299 aa, Glycine max
MASELELPPGFRFHPTDEELVLHYLCRKCASQPIAVPIIAEIDLYKYDPWDLPGLATYGEKEWYFFSPRDRKYPNGSRPNRAAGTGYWKATGADKPIGQPKPVGIKKALVFYAGKAPKGDKSNWIMHEYRLADVDRSVRKKNTLRLDDWVLCRIYNKKGTIEKLQPSSDVAHSRNIESSEIEDRKPEILKSGGGCLPPPVPVPAPPQATAKTDYMYFDPSDSIPKLHTDSSCSEQVVSPEFASEVQSEPKWNEWEKSLEFPFNYVDATLNNSFMAQFQGNNQMLSPLQDMFMYWPNKSF

SEQ ID NO: 7914 - protein, 299 aa, Lotus japonicus
MASELQLPPGFRFHPTDEELVLHYLCRKCASQPIAVPIIAEIDLYKYDPWDLPGLASYGEKEWYFFSPRDRKYPNGSRPNRAAGTGYWKATGADKPIGHPKPVGIKKALVFYAGKAPKGDKTNWIMHEYRLADVDRSIRKKNSLRLDDWVLCRIYNKKGSIERQPSGAVYSVKTESSELEKRKPEILTRAAGCLPPPHPPQAPAAGVTDYMYFDASDSVPKLHTDSSCSEQVVSPEFATEVQSEPKWNEWEKSLEFPYNYVDATLSNNNSNNNGFGSQFQSGNQLSPLQDMFLYMPKPF

SEQ ID NO: 7915 - protein, 291 aa, Cicer arietinum
MASELQLPPGFRFHPTDEELVMHYLCRKCTSQPISVPIIAEIDLYKYDPWDLPGMASYGEKEWYFFSPRDRKYPNGSRPNRAAGSGYWKATGADKPIGHPKPVGIKKALVFYAGKAPKGDKTNWIMHEYRLADVDRSIRRKNSLRLDDWVLCRIYNKKGTIEKQPNSGVINRKTDPSEIEDKKPEILTRGSGLPPHPPPQATAGMRDYMYFDTSDSIPKLHTDSSCSEHVVSPEFASEVQSEPKWNEWEKHLEFPYNYVDTTLNSVFGSQFQSNNQMSPLQDMFMYLPKTF

SEQ ID NO: 7916 - protein, 287 aa, Phaseolus coccineus
MASELQLPPGFRFHPTDEELVMHYLCRKCASQPIAVPIIAEIDLYKYDPWDLPGLASYGEKEWYFFSPRDRKYPNGSRPNRAAGSGYWKATGADKPIGQPKAVGIKKALVFYAGKAPKGDKSNWIMHEYRLADVDRSVRKKNSLRLDDWVLCRIYNKKGTIEKLQPSTDVVVSRKIESPEIEEKKPEILKGGGGLPPAMTDYMYFDPSDSIPKLHTDSSCSEQVVSPEFASEVQSEPKWNEWEKSLEFPYYMDTSLSNGFSQFSSNNNNNIQMSPLQDMFMYWPKPF

SEQ ID NO: 7917 - protein, 288 aa, Medicago truncatula
MASELQLPPGFRFHPTDEELVMHYLCRKCTSQPIAVPIIAEIDLYKYDPWDLPGMATYGEKEWYFFSPRDRKYPNGSRPNRAAGSGYWKATGADKPIGHPKPVGIKKALVFYAGKAPKGDKTNWIMHEYRLADVDRSIRKKNSLRLDDWVLCRIYNKKGTIEKQPSNSVVNRKTEHSEIEDRKPEIVTRGGGLPPHPPPQTTAGIRDYMYFDTSDSIPKLHTDSSCSEQVVSPEFASEVQSEPKWNEWDKNLEFPYNYIDATLNTGFGSQFQNTNPLQDMFMYLPKTF

SEQ ID NO: 7918 - protein, 301 aa, Arachis hypogaea
MASELQLPPGFRFHPTDEELVLHYLCRKCTSQPIAVPIIAEIDLYKYDPWDLPGMASYGEKEWYFFSPRDRKYPNGSRPNRAAGTGYWKATGADKPIGQPKPVGIKKALVFYSGKAPKGDKTNWIMHEYRLADVDRSVRKKNSLRLDDWVLCRIYNKKGSIEKQQPSSGVSTVVNQRAESSEVEDKKPDIVPRGGGGGVLPPHPPTAQASAGGVTTDYMYFDNSDSVPKLHTDSSCSEQVVSPEFASEVQSEPKWNEWDKNLESAYNYLDATLTNGFGFPFQGNNQMSPLQDMFMNLPKPF

SEQ ID NO: 7919 - protein, 545 aa, Glycine max
MALPHSISALATTLTLSSPTTKPQKVNPFPFFSNQKTRFLTKQTRPRSRRSLSLTPARVAAPPSTVEADQSYPETENNETEEEFNDESSYSKFTWRDHWYPVSLIEDLNPLLPTPFQLLGREIVLWYDKSISQWVAFDDKCPHRLAPLSEGRIDEDGKLQCSYHGWSFDGCGSCVKIPQAASEGPEARAIGSPKACATRFPTMVSQGLLFVWPDENGWEKAKASKPPMLPDDFDKPEFATVNIQRDLFYGYDTLMENVSDPSHIEFAHHKVTGRRDRAKPLPFKMDSRGSWGFSGANEGNPQISAKFVAPCYMMNKIQIDTKLPVVGDQKWVVWICSFNVPMAPGKTRSIVCSARNFFQFSVPGPAWWQVVPRWYEHWTSNKVYDGDMIVLQGQEKIFLSETKEGGDINKQYTNITFTPTQADRFVLAFRNWLRRHGNGQPEWFGNSSDQPLPSTVLSKRQMLDRFEQHTLKCSSCKAAYEGFQTWQKVLIGTTVVFCATSGIPSDVQLRVLLAGLAIVSAAITFALNQLQKNFEFVDYVHAEID

SEQ ID NO: 7920 - protein, 545 aa, Vigna unguiculata
MALPHSISALSTTLTLSSSVNKPTTNKVNSFPFLSNKGTQFFTKQTRPRSGRSPLLTPARVAAPPSTVETDQSFPETEKGETEEEFNEESSSSKFTWRDHWYPVSLIEDLNPLLPTPFQLLGREIVRTTSPLPKWVAFDDKCPHRLAPLSEGRIDEDGKLQCSYHGWSFDGCGSCVKIPQAASEGPEARAVGSPKACATRFPTLVSQGLLFVWPDENGWEKASASKPPMLPDEFEKPEFATVNIQRDLFYGYDTLMENVSDPSHIEFAHHKVTGRRDRAKPLPFKMDARGSWGFSGANEGNPKISAKFVAPCYYMNKIEIDTKLPVVGDQKWVVWICSFNVPMAPGKTRSIFSARNFFQFTVPGPAWWQVVPRWYEHWTSNKVYDGDMIVLQGQEKIFLSKTKEGDDINKQYTSITFTPTQADRFVLAFRNWLRRHGNGQPEWFSSIPDLPLPSTVLSKREMLDRLEQHTLKCSSCKEAYEGFQIWQKVLIGATVIFCATSGIPADVQFRVLLAGLAIVSAALAFTLNQLQKNFEFVDYVHAEIE

SEQ ID NO: 7921 - protein, 542 aa, Medicago truncatula
MALSPTLSPLATLSSSTPRNKPPKPFLFSSFTKKSQFLTNSTRPRNRNRRNLLVTVRSVAAPPTKTESYPEAEKNEIDEEFEDESSSSKFSWRDHWYPVSLIEDLDSSLPTPFQLLGREIVIWFDKANSQWVAFDDKCPHRLAPLSEGRIDESGNLQCSYHGWSFDGRGGCTVIPQASPEGPEARAVGSPRACATRFPTLVSQGLLFVWPDENGWEKANASKPPMLPDDFVKPEFATVNIQRDLFYGYDTLMENVSDPSHIDFAHHKVTGRRDRAKPLPFKMDSRGSWGFSGANEGNPRISSKFIAPCYYINKVEIDTKLPVVGDQKWVIWICSFNVPMAPGKTRSIVCSARNFFQLTVPGPAWWQVVPRWYEHWTSNKVYDGDMIVLQGQEKIFLAETENGGDINKQYTSLTFTPTQADRFVLAFRNWLRRHGNGQPEWFGKSSSQPLPSTVLSKRQMLDRFEQHTLKCSACKGAYEGFQTWQKILTGATVVFCATSGIPSDTQLRIILAALALVSAALAFSINQLKNNFVFVDYVHAEID

SEQ ID NO: 7922 - protein, 228 aa, Glycine max
MKQFLFLNLPDTEINCSQVDCNHSMAHSSYPYGDPILAYGPQAISHPQMVPQMLGLASTRVALPLDLAEDGPIYVNAKQYHGILRRRQSRAKLEAQNKLIKSRKPYLHESRHRHALNRVRGSGGRFLSTKQLAQSNAEFVTGAHSGSDPTNIYQKEHPLEVESHSSKDGDNASFITTYSDRPCLSGNNLNFRQQECMFLGNSANMSGAPQCSGGLTFGGAKQRTSVVR

SEQ ID NO: 7923 - protein, 395 aa, Lactuca sativa
  misc_feature (360)..(360): Xaa can be any naturally occurring amino acid
MKFNLLNVYTLFSLALVATHAVTPDVYWKSVLPNSPMPKTIQDLVHTAEWSEEMNTAVGVGKGGVAVHTGKPGKRTNVGVRKGGVTVNTGKGTNVGVGKGGVGVHTGKPGKRTDVGVGKGGVGVHTGKPGKRTNVGVGKGGVAVHTGHKGKPVYVGVGKGPNPFVYNYAASADQLKDNPNVAFFFLENDLHQGTEMKLHFTKDDQKATFLPRQVADSIPFSSNKLPQIYNEFSIKSDSVEAQDMKQTLSECENKGIEGEEKYCATSLESMVDFSTSKLGKNVKAISTEVNAKESTPLQKYTIEGAKKLAADKAVVCHKQNYAYAVFYCHKTVNTRAYSVSLVGADGTKAKAVAVCHTDTXKWNPKHLAFQVLKVKPGTVPVCHFLPEDHIVWVPY

SEQ ID NO: 7924 - protein, 395 aa, Lactuca sativa
MKFNLLNVYTLFSLALVASHAVTPDVYWKSVLPNSPMPKTIKDLVHTAEWSEEMNTAVGVGKGGVAVHTGKPGKRTNVGVRKGGVTVNTGKGTNVGVGKGGVGVHTGKPGKRTDVGVGKGGVGVHTGKPGKRTNVGVGKGGVAVHTGHKGKPVYVGVGKGPNPFVYNYAASADQLKDNPNVAFFFLENDLHQGTEMKLHFIKDDQKATFLPRQVADSIPFSSNKLPQIYNEFSIKSDSVEAQDMKQTLSECENKGIEGEEKYCATSLESMVDFSTSKLGKNVKAISTEVNAKESTPLQKYTIEGAKKLAADKAVVCHKQNYAYAVFYCHKTVNTRAYSVSLVGADGTKAKAVTVCHTDTSKWNPKHLAFQVLKVKPGSVPVCHFLPEDHVVWVPY

SEQ ID NO: 7925 - protein, 395 aa, Lactuca sativa
MKFNLLNVYTLFSLALVACHALTPDVYWKSVLPNSPMPKSIKDLVHTAEWSEEKNTAVVVGKGGVAVHTGKPGKRTDVGVRKGGVTVNTGKGTNVGVGKGGVGVHTGKPGKRTNVGVGKGGVGVHTGKPGKRTNVGVGKGGVAVHTGHKGKPVYVGVGKGPNPFVYNYAASADQLKDNPNVAFFFLENDLHQGTEMKLHFIKDDQKATFLPRQVADSIPFSSNKLPQIYNEFSVNPDSVEAQDMKQTLSECENKGIEGEEKYCATSLESMVDFSTSKLGKNVKAISTEVNAKESTPLQKYTIKGAKKLAADKAVVCHKQKYAYAVFYCHKTVSTRAYSVSLVGADGTKAKAVTVCHTDTSMWNPKHLAFQVLKVKPGSVPVCHFLPEDHVVWVPY

SEQ ID NO: 7926 - protein, 395 aa, Lactuca sativa
  misc_feature (16)..(16): Xaa can be any naturally occurring amino acid
MKFNLLNVYTLFSLAXVASHAVTPDVYWKSVLPNSPMPKTIKDLVHTAEWSEEKNTAVVVGKGGVAVHTEKPGKKTNVGVRKGGVTVNTGKGTNVGVGKGGVGVHTGKPGKRTDVGVGKGGVGVHTGKPGKRTNVGVAKGGVAVHTGHKGKPVYVGVGKGANPFVYNYAASADQLKDNPNVAFFFLENDLHQGTEMKLHFIKDDQKATFLPRQVADSIPFSSNKLPQIYNEFSIKSGSVEAQDMKQTLSECENKGIEGEERYCATSLESMVDFSTSKLGKNVKAISTEVNAKESTPLQKYTIEGAKKLAADKAVVCHKQNYAYAVFYCHKTVNTRAYSVSLVGADGTKAKAVAVCHTDTAKWNPKHLAFQVLKVKPGSVPVCHFLPEDHVVWVPY

SEQ ID NO: 7927 - protein, 377 aa, Cichorium intybus
MMFNILNVFTIFSLALVASHAVTPEVYWKSVLPNSPMPKAINDLLYPAEWSEEKNTAVGVGKGGVAVNTGKPGKRTNVGVQKGGVTVNTGKPGKGTNVGVGKGGVGVHTGKPGKRTDVGVGKGGVAVHTGKKGKPVYVGVNKGPNPFVYNYAASADQLKDNPNVAFFFLENDLHQGTEMKLHFTKDDQKATFLPRQVADSIPFSSNKLPKIYNEFSVKADSVEAEDMKQTLSECENKGIEGEEKYCATSLESMIDFSTTTLGKKVKAISTEVNKESTPLQKYKIEGAKKLAADKAVVCHKQNYAYAVFYCHKTVSTRAYAVSLIGMNGTKVNAVAVCHTDTAKWNPKHLAFQVLKVKPGSVPVCHFLPEDHVVWVPY

SEQ ID NO: 7928 - protein, 396 aa, Lactuca sativa
  misc_feature (243)..(243): Xaa can be any naturally occurring amino acid
MKFNHSQRFIHYFSLALVATHAVTPDVYWKSVLPNSPMPKTIHYLVHTAEWSEEMNTAVGVGKGGVAVHTGKPGKRTNVGVRKGGVTVNTGKGTNVGVGKGGVGVHTGKPGKRTDVGVGKGGVGVHTGKPGKRTNVGVGKGGVAVHTGHKGKPVYVGVGKGPSPFVYNYAASADQLKDNPNVAFFFLENNLHQGTEMKLHFIKDDQKATFLPRQVADSIPFSSNKLPQIYNEFSIKSDSVEAXDMKQTLSECENKGIEGEEKYCATSLESMVDFSTSKLGKNVKAISTEVNAKESTPLQKYTIEGAKKLAADKAVVCHKQNYAYAVFYCHKTVSTRAYSVSLVGADGTKAKAVTVCHTDTSMWNPKHLAFQVLKVKPGSVPVCHFLPEDHVVWVPY

SEQ ID NO: 7929 - protein, 317 aa, Solanum tuberosum
MSSLKVPASVPDPYEDAEQLKKAFKGWGTNEDLIIQILAHRNAAQRKLIRDSYAAAYGEDLLKDLDSELSSDFQRVVLLWTLSPAERDAYLVNEATKRLTASNWVIMETACTRSSDDLFKARQAYHARYKKSLEEDVAYHTSGDFRKLLVPLITAFRYEGDEVNMTLARKEANILHEKISDKAYNDEEIIRIISTRSKAQLSATFNHYNDHHGHEIIKDLEADDDDDEYLKLLRAAIECLKTPEKYFEKVLRLAIKKLGTDEWDLTRVVATRAEVDMERIKEEYHRRNSVTLDRAIAADTSGDYEKMLLALIGHGDA

SEQ ID NO: 7930 - protein, 317 aa, Solanum phureja
MSSLKVPASVPDPYEDAEQLKKAFKGWGTNEDLIIQILAHRNAAQRKLIRDSYAAAYGEDLLKDLDSELSSDFQRVVLLWTLSPAERDAYLVNEATKRLTASNWVIMETACTRSSDDLFKARQAYHARYKKSLEEDVAYHTSGDFRKLLIPLITAFRYEGDEVNMTLARKEANILHEKISDKAYNDEEIIRIISTRSKAQLSATFNHYNDHHGHEIIKDLEADDDDDEYLKLLRAAIECLKTPEKYFEKVLRLAIKKLGTDEWDLTRVVATRAEVDMERIKEEYHRRNSVTLDRAIAADTSGDYEKMLLALIGHGDA

SEQ ID NO: 7931 - protein, 317 aa, Solanum tuberosum
MSSLKVPASVPDPYEDAEQLKKAFKGWGTNEDLIIQILAHRNAAQRKLIRDSYAAAYGEDLLKDLDSELSSDFQRVVLLWTLSPAERDAYLVNEATKRLTASNWVIMETACTRSSDDLFKARQAYHARYKKSLEEDVAYHTSGDFRKLLVPLITAFRYEGVEVNMTLARKEANILHEKISDKAYNDEEIIRIISTRSKAQLSATFNHYNDHHGHEIIKDLEADDDDDEYLKLLRAAIECLKTPEKYFEKVLRLAIKKLGTDEWDLTRVVATRAEVDMERIKEEYHRRNSVTLDRAIAADTSGDYEKMLLALIGHGDA

SEQ ID NO: 7932 - protein, 316 aa, Solanum melongena
MSSLKVPGSVPDPYEDAEQLKKAFKGWGTNEKLIIQILAHRNAAQRKLIRDSYAAAYGEDLLKDLDSELSNDFQRVVLLWTLSPAERDAYLVNEATKRLTASNWVIMEIACTRSSDELFKARQAYHARYKKSLEEDVAYHTTGDFRKLLVPLVTAFRYEGEEVNMTLARKEANILHEKISDKAYNDDELIRIISTRSKAQLNATFNHYNDHHGHEIVKDLEADDDDEYLKLLRAAIECLKTPEKYFEKVVRLAIKRLGTDEWDLTRVVASRAEVDMERIKEEYHRRNSVTLDHAIAADTSGDYEKMLLALIGHGDI

SEQ ID NO: 7933 - protein, 316 aa, Capsicum annuum
MASLKVPASVPDPCEDAEQLKKAFKGWGTNEELIIQILAHRNAAQRKLIRDSYAAAYGEDLLKDLDSELTSDFQRIVLLWTLSPAERDAYLANEATKRLTASNWVIMEIACTRSSDELFKARQAYHTRYKKSFEEDVAYHTTGDFRKLLVPLITAFRYEGEEVNMTLARKEANILHEKVSGKAYNDEELIRIISTRSKTQLNATFNHYNDQHGHEIIKDLEADDDDEYLKLLRAAIECLKTPEKYFEKVLRVAIKGLGTDEWDLTRVVATRAEVDMERIKEEYNRRNSVTLDRAITGDTSGDYERMLLALIGHGDA

SEQ ID NO: 7934 - protein, 316 aa, Nicotiana tabacum
MASLKVPTSVPEPYEDAEQLKKAFAGWGTNEALIIQILAHRNAAQRKLIRETYAAAYGEDLLKDLDAELTSDFQRAVLLWTLSPAERDAYLVNEATKRLTSSNWVILEIACTRSSDDLFKARQAYHARYKKSLEEDVAYHTTGDFRKLLVPLLTAFRYEGEEANMTLARKEANILHEKISDKAYNDEELIRIISTRSKAQLNATFNHYLDQHGSEINKDLETDSDDEYLKLLSAAIECLKTPEKHFEKVLRLAIKGTGTDEWDLTRVVTTRAEVDMERIKEEYHKRNSVPLDRAIAGDTSGDYERMLLALIGHGDA

SEQ ID NO: 7935 - protein, 287 aa, Solanum tuberosum
EDLIIQILAHRNAAQRKLIRDSYAAAYGEDLLKDLDSELSSDFQRVVLLWTLSPAERDAYLVNEATKRLTASNWVIMETACTRSSDDLFKARQAYHARYKKSLEEDVAYHTSGDFRKLLVPLITAFRYEGDEVNMTLARKEANILHEKISDKAYNDEEIIRIISTRSKAQLSATFNHYNDHHGHEIIKDLEADDDDDEYLKLLRAAIECLKTPEKYFEKVLRLAIKKLGTDEWDLTRVVATRAEVDMERIKEEYHRRNSVTLDRAIAADTSGDYEKMLLALIGHGDA

SEQ ID NO: 7936 - protein, 316 aa, Populus trichocarpa
MASLKVPASVPPPYEDAEQLNKAFKGWGTNEGLIISILAHRNAAQRNLIRQVYAEAYGQDLLKDLDKELSSDFERVVLLWTLDLAERDAYLANEATKRFTSSNWVLMEIACTRSSHDLFKARQAYHARYKKSLEEDVAYHTTGDFRKLLVPLVSAFRYEGEEVNTMLAKSEAKILHEKISDKAYSDDEIIRILTTRSKAQLNATLNHYNNAFGNAINKNLKEDADNEFLKLLRATIKCLTYPEKYFEKLLRLAIKKIGTDEWALTRVVTTRAEVDMERIKEEYHRRNSVTLDHDIAGEASGDYERMLLALIGHGDA

SEQ ID NO: 7937 - protein, 316 aa, Populus trichocarpa
MASLKVPASVPPPYEDAEQLHKAFEGWGTNEGLIISILAHRNAAQRNLIRKVYAEAYGQDLLKDLDKELSSDFERAVLLWTLDPAERDAYLANEATKRFTSSNWVLMEIACTRSSHDLFKVRQAYHARYKKSLEEDVAYHTTGDFRKLLVPLVSAFRYEGEEVNTILAKSEAKILHEKISDKAYSDEEIIRILTTRSKAQLNATLNHYNNAFGNAINKNLKEEADNDFLKLLRATIKCLTYPEKYFEKLLRLSIKKLGTDERALTRVVTTRAEVDMERIKEEYHRRNSVTLERDIAGDTSGDYERMLLALIGHGDA

SEQ ID NO: 7938 - protein, 316 aa, Populus trichocarpa
MASLKVPASVPPPYEDAEQLNKAFKGWGTNEGLIMSILAHRNAAQRNLIRQVYAEAYGQDLLKDLDKELSSDFERVVLLWTLDLAERDAYLANEATKRFTSSNWVLMEIACTRSSHDLFKARQAYHARYKKSLEEDVAYHTTGDFRKLLVPLVSAFRYEGEEVNTMLAKSEAKILHEKISDKAYSDDEIIRILTTRSKAQLNATLNHYNNAFGNAINKNLKEDADNEFLKLLRATIKCLTYPEKYFEKLLRLAIKKIGTDEGALTRVVTTRAEVDMERIKEEYHRRNSVTLDHDIAGEASGDYERMLLALIGHGDA

SEQ ID NO: 7939 - protein, 325 aa, Solanum phureja
MASTISYTSLCSLLKLNQNNQKTPFSPSSSSSSLIKIKNQLCFSSNFCSHLGKASIFMVKASETEATQSEKEEDKYEEYEVEIVQPFGLKFTKGRDGGTYIDAIAPGGSADKTGKFTVGDRVIATSAVFGEEIWPAAEYGRTMYTIRQRIGPLLMKMQKRYGKVEEVGELTEKEIIRAERNAGFISDRVREIQVTNAQRKKEQKEQRERDLREGLKLSKNGKYEEALEKFESVLGSRPTGDEAAVASYNVACCYSKLNQLQAGLSALEDAMEAGFEDFKRIRTDPDLANLRTSEDFETLMKKFDESFINENAINAIKSLFGFNKK

SEQ ID NO: 7940 - protein, 322 aa, Solanum tuberosum
MASTISYTSLCSLLKLNQNNQKTPFSPSSSLIKIKNQLCFSSNFCSHLGKASIFMVKASETEATQSEKEEDKYEEYEVEIVQPFGLKFTKGRDGGTYIDAIAPGGSADKTGKFTVGDRVIATSAVFGEEIWPAAEYGRTMYTIRQRIGPLLMKMQKRYGKVEEVGELTEKEIIRAERNAGFISDRVREIQVTNARRKKEQKEQRERDLREGLKLSKNGKYEEALEKFESVLGSRPTGDEAAVASYNVACCYSKLNQIQAGLSALEDAMEAGFEDFKRIRTDPDLANLRTSEDFETLMKKFDESFINENAINAIKSLFGFNKK

SEQ ID NO: 7941 - protein, 333 aa, Solanum tuberosum
KNRLNQNQESMASTISYTSLCSLLKLNQNNQKTPFSPSSSSLIKIKNQLCFSSNFCSHLGKASIFMVKASETEATQSEKEEDKYEEYEVEIVQPFGLKFTKGRDGGTYIDAIAPGGSADKTGKFTVGDRVIATSAVFGEEIWPAAEYGRTMYTIRQRIGPLLMKMQKRYGKVEEVGELTEKEIIRAERNAGFISDRVREIQVTNARRKKEQKEQRERDLREGLKLSKNGKYEEALEKFESVLGSRPTGDEAAVASYNVACCYSKLNQIQAGLSALEDAMEAGFEDFKRIRTDPDLANLRTSEDFETLMKKFDESFINENAINAIKSLFGFNKK

SEQ ID NO: 7942 - protein, 211 aa, Nicotiana tabacum
  misc_feature (16)..(16): Xaa can be any naturally occurring amino acid
MFSVGDKVLATSAVFXEEIWPAAEYGRTMYTIRQRIGPLLMKMQKRYGKVEEAGELTEKEIIRAERNAGFISDRVREIQLTNARRKKEQKEQREKDLREGLQLSKNGKYEEALEKFESVLGSRPTGNEAAVASYNVACCYSKLNQLQAGLSALEDAMDAGFDDFKRIRTDPDLANLRTSEDFEPLLKKFDESFINENAINAIKSLFGFNKK

SEQ ID NO: 7943 - protein, 200 aa, Solanum tuberosum
MSFRQLSSLDSEKSHLMKTCNLLTQYFNGKADLKDLNLTISNNGEAKASATKDLLTNMEESSTKTTEQDQKLIDHVPKSAINKASSSKEIPNKEQKLAQLSIFYGGKVVVFDDFPAEKARAVMLLASKGISNNSCAIFQTTTTTQTNGANNFDLPIARRSSLYRFLEKRKDRDTARAPYQMHNPLQSSSRTREDHFDLNF

SEQ ID NO: 7944 - protein, 200 aa, Solanum phureja
MSNRPLSSLDSEKSHLMKTCNLLTQYFNGKADLKNLNLTISNNGEAKASATKDLLTNMEESSTKTTEQDQKLIDHVPKSAINKASSSKEIPNKEQKLAQLSIFYGGKVVVFDDFPAEKARAVMLLASKGISNNSCAIFQTTTTTQTNGANNFDLPIARRSSLYRFLEKRKDRDTARAPYQMHNPLQSSSRTREDHFDLNF

SEQ ID NO: 7945 - protein, 321 aa, Solanum tuberosum
MMMIGRSTPTVQIPPWDVTDDPTVDVYSPFSVSPDSAFDALTALQRYLPSNGNDVIFDSDGLDIPVDAFSCDNFRMYEFKVRKCARGRSHDWTECPYAHPGEKARRRDPRKYHYSGTSCPDFRKGQCKKGDACEYAHGVFECWLHPARYRTQPCKDGTHCRRRVCFFAHTPEQLRVLPQNSPRSFNESSDSFDGSPGRVGFESFSSSPPLESPPMTPRGLAESMRNMQIGMVRGMRSMQMGSPGFGSPRSPSMLRPGFMSVPTTPTRSGVSVFDHCEEEPAMERVESGRDLRARIYAKLSMENSLDDSGAPDVGWVSELLK

SEQ ID NO: 7946 - protein, 320 aa, Solanum tuberosum
MMIGRSTPTVQIPPWDVTDDPTVDVYSPFSVSPDSAFDALTALQRYLPSNGNDVIFDSDGLDIPVDAFSCDNFRMYEFKVRKCARGRSHDWTECPYAHPGEKARRRDPRKYHYSGTSCPDFRKGQCKKGDACEYAHGVFECWLHPARYRTQPCKDGTHCRRRVCFFAHTPEQLRVLPQNSPRSFNESSDSFDGSPGRVGFESFSSSPPLESPPMTPRGLAESMRNMQIGMVRGMRSMQMGSPGFGSPRSPSMLRPGFMSVPTTPTRSGVSVFDHCEEEPAMERVESGRDLRARIYAKLSMENSLDDSGAPDVGWVSELLK

SEQ ID NO: 7947 - protein, 323 aa, Solanum melongena
MMIGRSPPTVQIPPWNVMDDPTVDVYSPFSGTSPDSAALKALQRYLPSNANDAIFDSDGLDIPVDAFSCDNFRMYEFKVRKCARGRSHDWTECPYAHPGEKARRRDPRKYHYSGTSCPDFRKGQCKKGDACEYAHGVFECWLHPARYRTQPCKDGTHCRRRVCFFAHTPEQLRVLPQNSPRSHAESCDSFDGSPSRLGFESFSTSPPFDSPPMTPRGVNGLAESMRNMQIGMARGGMRAMQMGSPGFGSPRSPSILRPGFMSLPTTPTRSGLSVFDQNCEEEPAMERVESGRDLRARIYAKLSIENSLDSGAPDVGWVSELLK

SEQ ID NO: 7948 - protein, 349 aa, Solanum phureja
MMIGRSTPTVQIPPWDVTDDPTVDVYSPFSVSPDSAFDALTALQRYLPSNGNDVIFDSDGLDIPVDAFSCDNFRMYEFKVRKCARGRSHDWTECPYAHPGEKARRRDPRKYHYSGTSCPDFRKGQCKKGDACEYAHGVFECWLHPARYRTQPCKDGTHCRRRVCFFAHTPEQLRVLPQNSPRSFNESSDSFDGSPGRVGFESFSSSPPLESPPMTPRGLAESMRNMQIGMVRGMRSMQMGSPGFGSPRSPSILRPGFMSVPTTPTRSGVSVFDHCEEEPAMERVESGRDLRARIYAKLSMENSLDDSGAPDVGWVSELLNGIRVRVIGNGFTDLRPLTFVNIEDYCYWL

SEQ ID NO: 7949 - protein, 346 aa, Capsicum annuum
MMIGRSPHSHPTVQVPPWDVMDDQTVDVHSPFSVSPDSAFDALTALQRYLPSNVNDVMFDSDGLDIPVDAFSCDNFRMYEFKVRKCARGRSHDWTECPYAHPGEKARRRDPRKYHYSGTSCPEFRKGQCKKGDACEYAHGVFECWLHPARYRTQPCKDGTHCHRRVCFFAHTPEQLRVLPQNSPRSHAELLDSFDGSPSRLGFESFSSSPLYDSPPVTPRGSLSLNSVNGLAESMRNMQIGMVRGMSSTPTPTWGLQMGSPVFGSPRSPSVLRPGFMSLPTTPTRNPIGLGLAVFDQWEKSCEEEPAMERVESGRDLRAKIYAKLSMENSLDSGAPDVGWVSKLLK

SEQ ID NO: 7950 - protein, 351 aa, Nicotiana benthamiana
  misc_feature (291)..(291): Xaa can be any naturally occurring amino acid
  misc_feature (307)..(307): Xaa can be any naturally occurring amino acid
  misc_feature (312)..(312): Xaa can be any naturally occurring amino acid
MMMIGRSPHSHPTVQVPPWDVMDDPTVDVPSPFSVTHNYSTSPDSGFDALTALQRYLPSNGNDVLFDSDGLDIPVDAFSCDNFRMYEFKVRKCARGRSHDWTECPYAHPGEKARRRDPRKYHYSGTACPDFRKGLCKKGDACEYAHGVFECWLHPARYRTQPCKDGTHCRRRVCFFAHTLEQLRVLPQNSPRSHAAESCDSFDGSPSRLGFDSFSSSPPFDSPPMTPSGSLSLNSVTGLAESMCNMQIGMVRGMVSPTWGLQMGSPGFGSPRSPSTFRPGFMSLPTTPTRXPTRSGLAVFDQWEKTXEEEPXMERVESGRDLRARIYAKLSMENSLDSGAPDVGWVSELVK

SEQ ID NO: 7951 - protein, 303 aa, Unknown
  Sequence found in Organisms: Solanum tuberosum, Solanum phureja
MPTIAKHDGRQLETGLRITSQSTTQMQPWWQGYGDNTMPLASENAVAQGKSEGGNEEKETKALALESGSDGNNEQYKQHLKHFAPTTAAIMAEQQKELTGHSAMLASYPYPDMQYGGMMTYGAPVHPHLFEIHHARMPLPLDMEEEPVYVNAKQYHGILRRRQIRAKAELERKAIKARKPYLHESRHQHAMRRARGSGGRFLNTKKGNDMDCTPEETKKYGATIPTHSGNSSGSGSSDQGGKEGSTVQDMHKGHSHSFATGNGHGSSVYFAQSTGSEQGNGHYGRGSWNLLVNQASQGAASSN

SEQ ID NO: 7952 - protein, 302 aa, Nicotiana tabacum
  misc_feature (76)..(76): Xaa can be any naturally occurring amino acid
  misc_feature (245)..(245): Xaa can be any naturally occurring amino acid
  misc_feature (255)..(255): Xaa can be any naturally occurring amino acid
MPTIAKHDGRQLQTALRTTSQPAIQMQSWWQGYGDNTMPLASENTIAQGNAEGGNEEKETNAQATESGSKGNNMQXKQHLKHITSTTAAIMGEHQKELTGHSAMLTSYPYPDLQYGGMMTYGAPVHPHLFEIHHARMPLPLDMEEEPVYVNAKQYHGILRRRQIRAKAELEKKAIKARKPYLHESRHQHAMRRARGTGGRFLNTKKLNDMDCTTEEPKKYGATIPTHSGNSSGSGSSDQREKEGXTVQDMHKGQXSFSTGNGHGSSVYFSQYAGNEQQNGHYSHGSWSLLVSQASRGAAPNN

SEQ ID NO: 7953 - protein, 297 aa, Petunia hybrida
MPTIAKHDGRQLETGLRITSQSTTQMQPWWQGYGENTMPLASENTIAQGNADGGNQEKETKALAIESGSNGNNVPYQQNLKHIASTAATVMGEQQKEHAGHSTMLASYPYPDLQYGAMMTYAAPVHPHLFEIHHGRMPLPLDTEEEPVYVNAKQYHGILRRRQIRAKAELEKKAIKARKPYLHESRHQHAMRRARGTGGRFLNTKKLNDMDCTSEDPKKSGATIPTHSGNSSGSGSYDQQEKDMHKGHSHSFLTGNNHGSSVYLSQNTGNEQGNGHYGRVSWSLLVNQASRGAVSNN

SEQ ID NO: 7954 - protein, 311 aa, Solanum phureja
MHTTVFSKGNEGVVQNQSVATLCTAPWWSSGFMSQSVAFAEPFGQLKSASVEQQPKGNATEFTISSGDCKSSANGQKLSNVQAATSVRAANMDYRGHFDLGFGQSLISAKYPYGEQCIGLFSAYAPQLSGRIMLPLNLASDEGPIFVNAKQYHGILRRRKTRAKEMEKKALKPRKPYLHLSRHLHALRRPRGCGGRFLNTRNMNGTMKGGKNPDMFKTGDVQNFYPTGSQNSEVLQSDSSNLSSPKETSGSRFFDSSGVTNMYSSGNLDPLLFQNLRPPVQAIPDMMNTGHGIFMSGKWVGTADSCCNLKV

SEQ ID NO: 7955 - protein, 241 aa, Solanum phureja
MGRGRVELKRIENKINRQVTFAKRRNGLLKKAYELSVLCDAEVALIIFSNRGKLYEFCSSSSMLKTLERYQKCNYGAPEPNISTREALEISSQQEYLKLKGRYEALQRSQRNLLGEDLGPLNSKELESLERQLDMSLKQIRSTRTQLMLDQLTDHQRKEHALNEANRTLKQRLMEGSQLNLQWQPNAQDVGYGRQTTQNQGDGFFHPLDCEPTLQIGYQNDPITVGGAGPSVNNYMAGWLP

SEQ ID NO: 7956 - protein, 241 aa, Solanum melongena
MGRGRVELKRIENKINRQVTFAKRRNGLLKKAYELSVLCDAEVALIIFSNRGKLYEFCSSSSMLKTLERYQKCNYGAPETNISTREALEISSQQEYLKLKGRYEALQRSQRNLLGEDLGPLNSKELESLERQLDMALKQIRSTRTQLMLDQLTDLQRKEHALNEANRTLKQRLMEGSQLNLQWQPNAQDVGYGRQTTQTQGDGFFHPLECEPTLQIGFQNDQITVGGAGPSVNNYMAGWLP

SEQ ID NO: 7957 - protein, 241 aa, Nicotiana tabacum
MGRGRVELKRIENKINRQVTFAKRRNGLLKKAYELSVLCDAEVALIIFSNRGKLYEFCSSSSMLKTLERYQKCNYGAPETNISTREALEISSQQEYLKLKARYEALQRSQRNLLGEDLGPLNSKELESLERQLDMSLKQIRSTRTQLMLDQLTDLQRKEHALNEANRTLKQRLMEGSQLNLQWQQNAQDMGYGRQTTQTQGDGFFHPLECEPTLQIGYQNDPITVGGAGPSVNNYMAGWLP

SEQ ID NO: 7958 - protein, 241 aa, Capsicum annuum
MGRGRVELKRIENKINRQVTFAKRRNGLLKKAYELSVLCDAEVALIIFSNRGKLYEFCSSSSMLKTLERYQKCNYGAPETNISTREALEISSQQEYLKLKGRYEALQRSQRNLLGEDLGPLNGKDLESLERQLDMSLKQIRSTRTQLMLDQLTDLQRKEHALNEANRTLKQRLMEGSQLNLQWQPNAQDVDYGRQTTQTHGDGFFHPLECEPTLQIGYQNDPITVGGAGPSVNNYMAGWLP

SEQ ID NO: 7959 - protein, 241 aa, Petunia hybrida
MGRGRVELKRIENKINRQVTFAKRRNGLLKKAYELSVLCDAEVALIIFSNRGKLYEFCSSSSMLKTLERYQKCNYGAPETNISTREALEISSQQEYLKLKARYEALQRSQRNLLGEDLGPLNSKELESLERQLDMSLKQIRSTRTQLMLDQLQDLQRKEHALNEANRTLKQRLMEGSTLNLQWQQNAQDVGYGRQATQTQGDGFFHPLECEPTLQIGYQNDPITVGGAGPSVNNYMAGWLP

SEQ ID NO: 7960 - protein, 241 aa, Coffea canephora
MGRGRVELKRIENKINRQVTFAKRRNGLLKKAYELSVLCDAEVALIIFSNRGKLYEFCSSSSMLKTLERYQKCNYGAPEPNISTREALELSSQQEYLKLKARYEALQRSQRNLLGEDLGPLNSKELESLERQLDMSLKQIRSTRTQVMLDQLTDLQRKEHALNEANKTLKQRLMEGNQVNLQWNPNAQDVGYGRQPAHAQGDGFFHPLDCEPTLQIGYQNDPITVAAAGPSVNNYMAGWLP

SEQ ID NO: 7961 - protein, 240 aa, Unknown
  Sequence found in Organisms: Ipomoea nil, Ipomoea nil
MGRGRVELKRIENKINRQVTFAKRRNGLLKKAYELSVLCDAEVALIIFSNRGKLYEFCSSSSMLKTLERYQKCNYGAPETNISTRDALEISSQQEYLKLKARYEALQRSQRNLLGEDLGPLNSKELESLERQLDMSLKQIRSTRTQMMLDQLTDLQRKEHALNEANKSLKQRLMEGNQLNLHWNPNAQDMGYGRQTAHHSQGDVFFHPLECEPTLQIGYPTDPITVAGPSVNNYMPGWLP

SEQ ID NO: 7962 - protein, 242 aa, Vitis vinifera
MGRGRVELKRIENKINRQVTFAKRRNGLLKKAYELSVLCDAEVALIIFSNRGKLYEFCSSSSMLKTLERYQKCNYGAPETNVSTREALELSSQQEYLKLKARYEALQRSQRNLLGEDLGPLSTKELESLERQLDVSLKQIRSTRTQYMLDQLTDLQRKEHMLNEANKTLKQRLLEGTQVNQLQWNPNAQDVGYGRQQAQPQGDGFFHPLECEPTLQIGYQPDPITVAAAGPSVNNYMPGWLP

SEQ ID NO: 7963 - protein, 245 aa, Actinidia deliciosa
  misc_feature (5)..(5): Xaa can be any naturally occurring amino acid
  misc_feature (25)..(25): Xaa can be any naturally occurring amino acid
MGRGXVELKRIENKINRQVTFAKRXNGLLKKAYELSVLCDAEVALIVFSNRGKLHEFCSTSSMLKTLERYQKCNYGAPEPNVSAREALELSSQQEYLKLKGRYEALQRSQRNLLGEDLGPLNSKELESLERQLDMSLKQIRSTRTQYMLDQLTDLQRKEHALNEANKTLKQRLWGDSQVNSLQWHPNAQDHVDYSRQPAQPQGGEAFFHPLDCEPSLQIGYQQNDPITVGGAGPSLNNYMPGWLP

SEQ ID NO: 7964 - protein, 243 aa, Antirrhinum majus
MGRGRVELKRIENKINRQVTFAKRRNGLLKKAYELSVLCDAEVALIIFSNRGKLYEFCSNSGTMLKTLERYQKCNYGAPEANVSTREALELSSQQEYLKLKARYEALQRSQRNLLGEDLGPLNSKELESLERQLDMSLKQIRSTRTQAMLDTLTDLQRKEHALNEANRSLKHRLMEGSQISLQWNPNAHDMGYGRQAAAQPQGDGFFHPLECEPTLQMGFQSEITVGAAGPSVNNYNMTGWLP

SEQ ID NO: 7965 - protein, 241 aa, Ricinus communis
MGRGRVELKRIENKINRQVTFAKRRNGLLKKAYELSVLCDAEVALIIFSNRGKLYEFCSSSSMLKTLERYQKCNYGAPEPNVSAREALELSSQQEYLKLKARYEALQRSQRNLLGEDLGPLSSKDLESLERQLDMSLKQIRSTRTQYMLDQLTDLQRKEHMLNEANKTLKQRLVEGYQVNAMQLNPSAEDVGFGRQAAQPQGDGFFHPLDCEPTLQIGYHPDQIVVTAGPSVNNYMSGWLP

SEQ ID NO: 7966 - protein, 240 aa, Prunus persica
MGRGRVELKRIENKINRQVTFAKRRNGLLKKAYELSVLCEAEVALIIFSNRGKLYEFCSSSSMLKTLERYQKCNYGAPETNVSAREALELSSQQEYLKLKARYEALQRNQRNLLGEDLGPLSSKELESLERQLDMSLKQIRSTRTQCMLDQLTDLQRKEHMLNEANKTLKQRLFEGYHVNSLQMNPNADEYGRQQTQAHGDGFFHPLDCEPTLQIGYQNDPISVVTAGPSVSNYMAGWLP

SEQ ID NO: 7967 - protein, 242 aa, Cucumis sativus
MGRGRVELKRIENKINRQVTFAKRRNGLLKKAYELSVLCDAEVALIIFSNRGKLYEFCSSSSMLKTLERYQKCNYGAPEPNVSTREALELSSQQEYLKLKARYEALQRSQRNLLGEDLGPLSSKELESLERQLDMSLKQIRSTRTQYMLDQLTDLQRKEHLLNEANKTLKQRLVEGYQVNALQLNQSADDMMYGRQQAQPPGDAFFHPLDCEPTLQIGYQPDPITVVTAGPSMNNFLPGWLP

SEQ ID NO: 7968 - protein, 243 aa, Carica papaya
MGRGRVELKRIENKINRQVTFAKRRNGLLKKAYELSVLCDAEVALIIFSNRGKLYEFCSSSSMLKTLERYQKCNYGAPETNVSTREALELSSQQEYLKLKARYEALQRSQKNLLGEDLGPLSSKELESLERQLDMSLKQIRSTRTQYMLDQLTDLQRREHMLNEANKTLKQRLVEGYQVSSLQLNPNAEDVGYGRQAAPVPQPDPFFHPLDCEPTLQIGYQPDPISVVTAGPSVNNYMPGWLP

SEQ ID NO: 7969 - protein, 247 aa, Theobroma cacao
MGRGRVELKRIENKINRQVTFAKRRNGLLKKAYELSVLCDAEVALIIFSNRGKLYEFCSSSSMIKTLERYQKCNYGAPETNVSTREALELSSQQEYLKLKARYEALQRSQRNLLGEDLGPLSSKELESLERQLDSSLKQIRSTRTQYMLDQLTDLQRKEHLLNEANKTLKQRAGALQLVEGYQVNSLQLNPNAEDVGYGRQPAQPQGDGFFHPLECEPTLQIGYQPDPISVVNAGPSVNNYMTGWLP

SEQ ID NO: 7970 - protein, 242 aa, Antirrhinum majus
MGRGRVELKRIENKINRQVTFAKRRNGLLKKAYELSVLCDAEVALIIFSNRGKLYEFCSSTSMLNTLERYQKCNYGPPETNVSTREALELSSQQEYLKLKARYEALQRSQRNLLGEDLGPLNSKELESLERQLDMSLKQIRSTRTQAMLDTLTDLQRKEHALNEANRSLKHRLMDGSQISLQWNPNAEDHVGYGRQPSQPSADGFYHPLECEPTLHIGFQSDQITVAGAGPSVNNYISGWLP

SEQ ID NO: 7971 - protein, 245 aa, Antirrhinum majus
MGRGRVELKRIENKINRQVTFAKRRNGLLKKAYELSVLCDAEVALIIFSNRGKLYEFCSSSSSMLTTLERYQKCNYGAPDHANISTREAMELSSQQEYLKLKARYEALQRSQRNLLGEELGPLNSKELESLERQLDMSLKQIRSTRTQAMLDTLTDLQRKEHALNEANRNLKHRLMEGSQIGLQWNLNAQDMGYGRQPTQPQGDGFFHPLECEPTLQMGFHSDQISVAAAAGPSVNNNYMSGWLP

SEQ ID NO: 7972 - protein, 242 aa, Fragaria vesca
MGRGRVELKRIENKINRQVTFAKRRNGLLKKAYELSVLCDAEVALIIFSNRGKLYEFCSSSSMLKTLERYQKCNYGAPETNVSTREALELSSQQEYLKLKARYEALQRNQRNLLGEDLGPLSSKELESLERQLDMSLKQIRSTRTQCMLDQLTDLQRKEHLLNEANRTLKQRLFEGYHHQLQLNANAEEVAYGRQEAHQPQGDGFFQALECEPTLQIGYHQNDPIQVVTAGPSVNYMGGWLP

SEQ ID NO: 7973 - protein, 247 aa, Triphysaria pusilla
MGRGRVELKRIENKINRQVTFAKRRNGLLKKAYELSVLCDAEVALIIFSNRGKLYEFCSSPSMLKTLERYQKCNYGAPEPNISAREALELSSQQEYLKLKARYEALQRTQRNLLGEDLGPLNSKELESLERQLDMSLKQIRSTRTQTMLDTLTELQSKEHALNEANKNLKQRLIEGSQISLQWNPNGQEHHHHHNLGLGYGQRQPQPDGFFHPLDCEPTLQIGYQNDPITVGGAGPSVNNYMSGWLP

SEQ ID NO: 7974 - protein, 243 aa, Manihot esculenta
MGRGRVELKRIENKINRQVTFAKRRNGLLKKAYELSVLCDAEVALIIFSNRGKLYEFCSSSSMLKTLERYQKCNYGAPETNVSAREALELSSQQEYLKLKARYEALQRSQRNLLGEDLGPLSSKELESLERQLDMSLKQIRSTRTQYMLDQLTDLQRKEQMLNEANKTLKQRLVEGYQINTMQLNPSAEEVEAFGRQAPQHHGDVFFHPLECEPTLQIGYQPDPITVVTAGPSVNNYMPGWLP

SEQ ID NO: 7975 - protein, 243 aa, Gossypium hirsutum
MGRGRVELKRIENKINRQVTFAKRRNGLLKKAYELSVLCDAEVALIIFSNRGKLYEFCSSSSMMKTLERYQKCSHGAPETNVSTREALELSSQQEYLKLKARYEALQRSQRNLLGEDLGPLSSKELESLERQLDSSLKLIRSTRTQYMLDQLTDLQRKEHLLNEANKNLKQRLMEGYQVHSLQLNPNADDVGYGRQPTHQPQGDVFFHPLDCEPTLQIGYQPDTISAVTGCPSVNNYMTGWLP

SEQ ID NO: 7976 - protein, 239 aa, Malus domestica
MGRGRVELKRIENKINRQVTFAKRRNGLLKKAYELSVLCDAEVALIIFSNRGKLYEFCSSSSTLKTLERYQKCNYGAPETNISTREALELSSQQEYLKLKARFEALQRNQRNLLGEDLGPLSSKDLESLERQLDMSLKQIRSTRTQCMLDQLTDLQRKEHMLNEANKTLKERLFEGYHALQLNANADEYGRQQAQAAQGDVFFHPLDCEPTLQIGYQNDPISVVTAGPSVSNYMGGWLP

SEQ ID NO: 7977 - protein, 243 aa, Tropaeolum majus
MGRGRVELKRIENKINRQVTFAKRRNGLLKKAYELSVLCDAEVALIIFSNRGKLYEFCSSSSMLRTLERYQKCNYGAPEPNVSTREAMQEFSSQQEYLKLKARYEALQRSQRNLMGEDLGPLSSKELESLERQLDMSLKQIRSTRTQFMLDQLTDLQRKEHMLNEANKTLKHRLMEGYQLSSLQLNPNPEDVCYGRQAQPLTDHHFFPHVDCEPTLQIGYQHDPMTVLNAGPSVSNYMAGWLP

SEQ ID NO: 7978 - protein, 242 aa, Cucumis melo
  misc_feature (63)..(63): Xaa can be any naturally occurring amino acid
  misc_feature (107)..(107): Xaa can be any naturally occurring amino acid
  misc_feature (118)..(118): Xaa can be any naturally occurring amino acid
  misc_feature (132)..(132): Xaa can be any naturally occurring amino acid
MGRGRVELKRIENKINRQVTFAKRRNGLLKKAYELSVLCDAEVALIIFSNRGKLYEFCSSSSXLKTLERYQKCNYGAPEPNVSTREALELSSQQEYLKLKARYEALXRSQRNLLGEDXGPLSSKELENLERXLDMSLKQIRSTRTQYMLDQLTDLQRKEHLLNEANKTLKQRLVEGYQVNALQLNQSADDMMYGRQQAQPPGDAFFHPLDCEPTLQIGYQPDPITVVTAGPSMNKFLPGWLP

SEQ ID NO: 7979 - protein, 246 aa, Gossypium hirsutum
MGRGRVELKRIENKINRQVTFAKRRNGLLKKAYELSVLCDAEVALIIFSNRGKLYEFCSSSSMIKTLERYQKCNYGAPEPNVSSREAALELSSRQEYLKLKARYDALQRSQRNLLGEDLGPLSSKELESLEKQLDSSLKLIRSTRTQYMLDQLNDLQRKEHLLNEANKTLKQRLVEGYQVNSLQLNPNATEDVGYGRQQVHHQPHGDAFFHPLDCEPTLQIGYQHDPMSVVTAGPSVNNYMTGWLP

SEQ ID NO: 7980 - protein, 244 aa, Citrus sinensis
MGRGRVELKRIENKINRQVTFAKRRNGLLKKAYELSVLCDAEVALIIFSNRGKLYEFCSSSSMLKTLERYQKCNYGAPEPNVSAREALELSSQQEYLKLKARYEALQRSQRNLLGEELGPLNSKELESLERQLDMSLKQIRSTRTQYMLDTLTELQHKEQLLSEANKTLKQRLMEGYQVNTLQLNPSAEDCGYGLKPAQPQGDTFFHALECEPTLQIGYQPADPISVVTAGPSLNNYMQGWLPC

SEQ ID NO: 7981 - protein, 243 aa, Lotus japonicus
MGRGRVELKRIENKINRQVTFAKRRNGLLKKAYELSVLCDAEVALIIFSNRGKLYEFCSSSSMLKTLERYQKCNYGAPEANVSTREALELSSQQEYLKLKARYEALQRSQRNLMGEDLGPLNSKELESLERQLDSSLKQIRSTRTQFMLDQLSDLQRKEHMLSEANRSLRQRQLEGYQLNSLQLNPGVEDMGYGRHPAQTHGDAFYHPIECEPTLQIGYQPDPVSVVTAGPSMNNNYMAGWLP

SEQ ID NO: 7982 - protein, 244 aa, Tropaeolum majus
MGRGRVELKRIENKINRQVTFAKRRNGLLKKAYELSVLCDAEVALIIFSNRGKLYEFCSTSSMLKTLERYQKCNYGAPEPNVSTREAMQELSSQQEYLKLKARYESLQRSQRNLLGEDLGPLNSKELESLEKQLDMSLKQIRSTRTQSMLDQLSDLQRKEHMLNEANKTLKNRLMEGYQMSSLQLSQGGEEVGYGRQTTQPHHHHTFFHPLDCEPTLQMGYQHDPITVVNTGASVSNFMPGWLP

SEQ ID NO: 7983 - protein, 245 aa, Cichorium intybus
MGRGRVELKRIENKINRQVTFAKRRNGLLKKAYELSVLCDAEVALIIFSNRGKLYEFCSSSSMLKTLERYQKCNYGAPESNVSAREALELSSQQEYLKLKTRYEALQRSQRNLLGEDLGPLNCKELEQLEKQLDTSLKHIRSARTQLMLDTLSDLQKKEHALNEANRTLKQRLMEGNQVNSLQWYPHAQQEVCYDRQPAPQHQNDEAFFHPLDCGPTLQIGYQTDPLTAAAGPSMSNYMQGWLPC

SEQ ID NO: 7984 - protein, 241 aa, Medicago truncatula
MGRGRVELKRIENKINRQVTFAKRRNGLLKKAYELSVLCDAEVALIIFSNRGKLYEFCSSSSMLKTLERYQKCNYGAPETNVSAREALELSSQQEYLKLKARYEALQRSQRNLMGEDLGPLSSKELESLERQLDSSLKQIRSTRTQFMLDQLSDLQRKEHMLSEANRSLRQRLEGYQLNQLQMNACVEEMGYGRHPSQTQGDGLYQQLECEPTLQIGYQPDPGSVCTAGPSMSNYMGGWLP

SEQ ID NO: 7985 - protein, 242 aa, Populus trichocarpa
MGRGRVELKRIENKINRQVTFAKRRNGLLKKAYELSVLCDAEVALIIFSNRGKLYEFCSSSSMLKTLERYQKCNYGAPEPNVSAREALELSSQQEYLKLKARYEALQRTQRNLLGEELGPLSSKELESLERQLDMSLKQIRSTRTQYMLDQLNDLQHKEHMLTAANKSLKERLMEGYQLNSLQLNPSAEDVEYARQQAQPQGDGFFHALECEPTLQIGYQPENITMVTAGPSMTTYMPGWLA

SEQ ID NO: 7986 - protein, 245 aa, Mimulus guttatus
MGRGRVELKRIENKINRQVTFAKRRNGLLKKAYELSVLCDAEVALIIFSNRGKLYEFCSSSSSMLKTLERYQKCNYGAPETNVSAREALELSSQQEYLKLKARYEALQHSQRNLLGEDLGPLNSKELESLERQLDMSLKQIRSTRTQAMLDTLTDLQRKEHALNEANRSLKHRLMEGSQISLEWNHNNNVDHDMGYGREAPPQPHQPDGFFHPLDCGLQIGGYQADQITGAGPSVNNYITSWLQQ

SEQ ID NO: 7987 - protein, 250 aa, Lactuca sativa
MGRGRVELKRIENKINRQVTFAKRRNGLLKKAYELSVLCDAEVALIIFSNRGKLYEFCSSSSSMLKTLERYQKCNYGAPESNVSAREALELSSQQEYLKLKTRYEALQRSQRNLLGEDLGPLNCKELESLEKQLDTSLKHIRSARTQLMLDTLSDLQKKEHALNEANRTLKQRLIEGNQVNSLHWYPHAQQEVCYERQPQPQHQNDEAFFHPLDCGPTLQIGNGYQTDSLTAGAGAGPSMNNYMQGWLPC

SEQ ID NO: 7988 - protein, 245 aa, Taraxacum officinale
MGRGRVELKRIENKINRQVTFAKRRNGLLKKAYELSVLCDAEVALIIFSNRGKLYEFCSSSSSMLKTLERYQKCNYGAPESNVSAREALELSSQQEYLKLKTRYEALQRSQRNLLGEDLGPLNCKELESLEKQLDTSLKHIRSARTQLMLDTLSDLQKKEQALNEANRTLKQRLIEGDQVNSLHWYPHAQQEVCYERQPQHQNDEAFFHPLDCGPTLQIGYQTDSMTASGAGPSMNNYMQGWLPC

SEQ ID NO: 7989 - protein, 243 aa, Populus trichocarpa
MGRGRVELKRIENKINRQVTFAKRRNGLLKKAYELSVLCDAEIALIIFSNRGKLYEFCSSSSMLKTLERYQKCNYGAPEPNVSAREALELSSQQEYLKLKARYEALQRTQRNLLGEDLGPLSSKELESLERQLDMSLKQIRSTRTQYMLDQLNDLQHKEHMLTAANKSLRERLMEGYEVNSLQLNLSAEDVGFSRQQAQPQGYGFFHPLECEPTLQIGYQPDSAITVVTSGPSMTAYMPGWLP

SEQ ID NO: 7990 - protein, 242 aa, Glycine max
MGRGRVELKRIENKINRQVTFAKRRNGLLKKAYELSVLCDAEVALIIFSNRGKLYEFCSSSSMLKTLERYQKCNYGAPEANVSTREALELSSQQEYLKLKARYEALQRSQRNLMGEDLGPLSSKELESLERQLDSSLKQIRSTRTQFMLDQLSDLQRKEHLLSEANRSLRQRQLEGYQINPLQLNPGVEEMGYGRHPAQTHGEALFQQMECEPTLQIGYQPDPVSVVTAGPSMSNYMAGWLP

SEQ ID NO: 7991 - protein, 242 aa, Glycine max
MGRGRVELKRIENKINRQVTFAKRRNGLLKKAYELSVLCDAEVALIIFSNRGKLYEFCSSSSMLKTLERYQKCNYGAPEANVSTREALELSSQQEYLKLKARYESLQRSQRNLMGEDLGPLSSKELESLERQLDSSLKQIRSTRTQFMLDQLSDLQRKEHLLSEANRSLRQRQLEGYQINPLQLNPGVEEMGYGRNPAQTHGEALFQQMECEPTLQIGYQPDPVSVVTAGPSMSNYMAGWLP

SEQ ID NO: 7992 - protein, 245 aa, Juglans hindsii x Juglans regia
MGRGRVELKRIENKINRQVTFAKRRNGLLKKAYELSVLCDAEVALIIFSNRGKLYEFSSSSSMLKTLEKYQKCNYGVPDHQTNVSAREALELSSQQEYLKLKARYESLQRTQRHLLGEDLGPLSIKELESLERQLDMSLKQIRSTRTQHMLDQLTELQHKEHMLNEANKTLKQRLVEGYHINSLQLNPNDNDMGYGRHPADQTQGDDFFHPLCEPTLQIGYQHDPLPVVTAGPSMNNYMPSGWLP

SEQ ID NO: 7993 - protein, 243 aa, Arachis hypogaea
MGRGRVELKRIENKINRQVTFAKRRNGLLKKAYELSVLCDAEVALIIFSNRGKLYEFCSSSSMLKTLERYQKCNYGAPETNVSTREALELSSQQEYLKLKARYEALQRSQRNLMGEDLGPLSSKELESLERQLDSSLKLIRSTRTQFMLDQLSELQRKEHLLSEANRALRQRQLEGYQINPMQLNPGGVDDMGYARHPPQPQPDPLFQQLDCEPTLQIGYQPDPVSVVTAGPSMGNYMGGWLP

SEQ ID NO: 7994 - protein, 246 aa, Helianthus annuus
MGRGRVELKRIENKINRQVTFAKRRNGLLKKAYELSVLCDAEVALIIFSSRGKLFEFCSSSSMLKTLERYQKCNYEAPESNHTAREALELSSQQEYMKLKAKYEALQRSQRNLLGEDLGPLNCKELESLERQLDTSLKHIRSARTQLMLDTLTDLQKKEHALNEANTTLKQRLIEGNQINSLHWFQHAEQQVCYDRQPAPPQQSEETFFHPLDCGPTLHIGYQMDPLTTTEAGPSMNNYMQGWLPC

SEQ ID NO: 7995 - protein, 133 aa, Solanum tuberosum
MVELQFPAGFRFHPTDEELVMHYLCRKCASQPIAVPIIAEIDLYKYNPWDLPDLALYGEKEWYFFSPRDRKYPNGSRPNRAAGNGYWKATGADKPIGRPKSMGIKKALVFYAGKAPKGEKNKLDYARISTCSC

SEQ ID NO: 7996 - protein, 291 aa, Solanum phureja
MVELQFPAGFRFHPTDEELVMHYLCRKCASQPIAVPIIAEIDLYKYNPWDLPDLALYGEKEWYFFSPRDRKYPNGSRPNRAAGNGYWKATGADKPIGRPKSMGIKKALVFYAGKAPKGEKTNWIMHEYRLAHVDRSARNKNNSLRLDDWVLCRIYNKKGTTEKNQLNIRKMNVEMSPAVSEGDVKPEIMPYSVSTKPSSTSYHVYNDFTYFDSSDSLPKLHTDSSCSEHVPSPEFTCEKEVQSEPKVKLNEWEKTALDFPFNYTDATTSELQSCYEMSPLQDIFMYLQKPF

SEQ ID NO: 7997 - protein, 291 aa, Solanum tuberosum
MVELQFPAGFRFHPTDEELVMHYLCRKCASQPIAVPIIAEIDLYKYNPWDLPDLALYGEKEWYFFSPRDRKYPNGSRPNRAAGNGYWKATGADKPIGRPKSMGIKKALVFYAGKAPKGEKTNWIMHEYRLAHVDRSARNKNNSLRLDDWVLCRIYNKKGTIEKNQLNIRKMNVEMSPAVSEGDVKPEIMPYSVSTKPSSTSYHVYNDFTYFDSSDSLPKLHTDSSCSEHVPSPEFTCEKEVQSEPKVKLNEWEKTALDFPFNYTDATTSELQSCYEMSPLQDIFMYLPKPF

SEQ ID NO: 7998 - protein, 302 aa, Solanum tuberosum
MVDLQFPAGFRFHPTDEELVMHYLCPKCASQPIDVPIIAEIDLYKYNPWDLPDLALYGEKEWYFFSPRDRKYPNGSRPNRAAGNGYWKATGADKPIGRPKSMGIKKALVFYAGKAPKGEKTNWIMHEYRLAHVDRSARNKNNSLRLDDWVLCRIYNKKGTIEKNQLNIRKMNVEMSPAVSEGDVKPEIMPYSVSTKPSSTSYHVYNDFTYFDSSDSLPKLHTDSSCSEHVPSPEFTCEKEVQSEPNVKLNEWEKTALDFPFNYTDATTSELQSCYEMSPLQDIFMYPAKAVLSGGPPIFNFF

SEQ ID NO: 7999 - protein, 290 aa, Capsicum annuum
MGAVELRLPAGFRFHPTDEELVTHYLCRKCASQPIAVPIIAEIDLYKYNPWDLPDLALYGEKEWYFFSPRDRKYPNGSRPNRAAGNGYWKATGADKAIGRPKPMGIKKALVFYAGKAPKGEKTNWIMHEYRLAHVDRSARNKNNSLRLDDWVLCRIYNKKSTIEKSQLNSRKMNVAMSPVDIKPKIMAFPVSTRPSVTSQQVNNDFIYFDSSDSLPKLHTDSSCSEHVLSPEFTCEREVQSEPKVSEWEKNALDFPFNYSDDATTTMGELESCYEMSPLQDIFMYLQKPF

SEQ ID NO: 8000 - protein, 611 aa, Solanum tuberosum
DSYGVTTGFGATSHRRTKNGGALQKELIRFLNAGVFGNGTESSHTLPHSATRAAMLVRINTLLQGYSGIRFEILEAITKLINNNITPCLPLRGTITASGDLVPLSYIAGLLTGRPNSKAVGPNGEKLNAEEAFRVAGVTGGFFELQPKEGLALVNGTAVGSGMASMVLFDSNILAVMSEVLSAIFAEVMNGKPEFTDYLTHKLKHHPGQIEAAAIMEHILDGSSYVKEAQKLHEMDPLQKPKQDRYALRTSPQWLGPQIEVIRAATKMIEREINSVNDNPLIDVSRNKALHGGNFQGTPIGVSMDNTRLALASIGKLMFAQFSELVNDYYNNGLPSNLTAGRNPSLDYGFKGAEIAMASYCSELQFLANPVTNHVQSAEQHNQDVNSLGLISARKTAEAVDILKLMSSTYLVALCQAIDLRHLEENLKNAVKNTVSQVAKKTLTMGANGELHPARFCEKELLQVVEREYLFTYADDPCSCTYPLMQKLRQVLVDHAMKNGESETNVNSSIFQKIVAFEDELKAVLPKEVESARAVLESGNPVIPNRITECRSYPLYRFVRKEVGTELLTGEKVRSPGEEIDKVFTAFCNGQIIDPLLECLKSWNGAPLPIC

SEQ ID NO: 8001 - protein, 413 aa, Solanum phureja
MARLATDGAQFDARQFDSKMNDLLAAEGKDFFTSYDEVYDSFDAMGLQENLLRGIYAYGFEKPSAIQQRGIVPFCKGLDVIQQAQSGTGKTATFCSGILQQLDYGLIQCQSLVLAPTRELAQQIEKVMRALGDYLGVKVHACVGGTSVREDQRILAAGVHVVVGTPGRVFDMLRRQSLRPDCLRMFVLDEADEMLSRGFKDQIYDIFQMLPTKVQVGVFSATMPPEALDITRKFMNKPVRILVKRDELTLEGIKQFYVNVDKEEWKLETLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTTDDERMLFDIQKFYNVVIEELPSNVADLL

SEQ ID NO: 8002 - protein, 413 aa, Nicotiana tabacum
MARLAPDGAQFDARQYDSKMNDLLAADGKDFFTSYDEVYDSFDAMGLQENLLRGIYAYGFEKPSAIQQRGIVPFCKGLDVIQQAQSGTGKTATFCSGILQQLDYGLVQCQALVLAPTRELAQQIEKVMRALGDYLGVKVHACVGGTSVREDQRILAAGVHVIVGTPGRVFDMLRRQSLRPDYLRMFVLDEADEMLSRGFKDQIYDIFQMLPTKVQVGVFSATMPPEALDITRKFMNKPVRILVKRDELTLEGIKQFYVNVDKEEWKLETLCDLYETLAITQSVIFVNTRRKVDWLTDKMRTRDHTVSATHGDMDQNTRDIIMREFRSGSSRVLITTDLLARGIDVQQVSLVINYDLPTQPENYLHRIGRSGRFGRKGVAINFVTTDDERMLFDIQKFYNVIIEELPSNVADLL

SEQ ID NO: 8003 - protein, 413 aa, Cucumis sativus
MAGLAPEGSQFDARQYDSKMNELLSADGQDFFTSYDEVYDSFDSMGLQENLLRGIYAYGFEKPSAIQQRGIVPFCKGLDVIQQAQSGTGKTATFCSGILQQLDYGLVQCQALVLAPTRELAQQIEKVMRALGDYLGVKVHACVGGTSVREDQRILQAGVHVVVGTPGRVFDMLRRQSLRPDYIRMFVLDEADEMLSRGFKDQIYDIFQLLPSKIQVGVFSATMPPEALEITRKFMNKPVRILVKRDELTLEGIKQFYVNVDKEDWKLETLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTTEDERMLFDIQKFYNVVIEELPANVADLL

SEQ ID NO: 8004 - protein, 413 aa, Citrus sinensis
MAGLAPEGSQFDARQYDTKMNELLSTDGQDFFTSYDEVYDSFDAMGLQENLLRGIYAYGFEKPSAIQQRGIVPFCKGLDVIQQAQSGTGKTATFCSGILQQLDYGLVQCQALVLAPTRELAQQIEKVMRALGDYLGVKVHACVGGTSVREDQRILQAGVHVVVGTPGRVFDMLRRQSLRPDYIKMFVLDEADEMLSRGFKDQIYDIFQLLPAKVQVGVFSATMPPEALEITRKFMNKPVRILVKRDELTLEGIKQFYVNVEKEEWKLETLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTRDDERMLFDIQKFYNVVIEELPSNVADLL

SEQ ID NO: 8005 - protein, 413 aa, Manihot esculenta
MAGLAPEGSQFDAKQYDAKMNELLSTDGQEFFTSYDEVYDSFDAMGLQENLLRGIYAYGFEKPSAIQQRGIVPFCKGLDVIQQAQSGTGKTATFCSGILQQLDYGLVQCQALVLAPTRELAQQIEKVMRALGDYLGVKVHACVGGTSVREDQRILQAGVHVVVGTPGRVFDMLRRQSLRPDYIKMFVLDEADEMLSRGFKDQIYDIFQLLPAKVQVGVFSATMPPEALEITRKFMNKPVRILVKRDELTLEGIKQFYVNVEKEEWKLETLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRGGRFGRKGVAINFVTRDDERMLFDIQKFYNVVIEELPSNVADLL

SEQ ID NO: 8006 - protein, 413 aa, Liriodendron tulipifera
MAGSAPEGSQFDGRQFDTKMNELLAADGQDFFTSYDEVYESFDSMGLQENLLRGIYAYGFEKPSAIQQRGIVPFCKGLDVIQQAQSGTGKTATFCSGILQQLDYGLVECQALVLAPTRELAQQIEKVMRALGDYLGVKVHACVGGTSVREDQRILSSGVHVVVGTPGRVFDMLRRQSLRPDCIKMFVLDEADEMLSRGFKDQIYDIFQLLPSKVQVGVFSATMPPEALEITRKFMNKPVRILVKRDELTLEGIKQFYVNVEKEEWKLETLCDLYETLAITQSVIFVNTRRKVDWLTEKMRSRDHTVSATHGDMDQNTRDIIMREFRSGSSRVLITTDLLARGIDVQQVSLVINYDLPTQPENYLHRIGRSGRFGRKGVAINFVTLDDERMLFDIQKFYNVVIEELPSNVADLL

SEQ ID NO: 8007 - protein, 413 aa, Populus trichocarpa
MAGLAPEGSQFDSKQYDAKMNDLLANDGQDFFTSYDEVYDTFDSMGLQENLLRGIYAYGFEKPSAIQQRGIVPFCKGLDVIQQAQSGTGKTATFCSGILQQLDYGLVQCQALVLAPTRELAQQIEKVMRALGDYLGVKVHACVGGTSVREDQRILQAGVHVVVGTPGRVFDMLRRQSLRPDYIKMFVLDEADEMLSRGFKDQIYDIFQLLPSKVQVGVFSATMPPEALEITRKFMNKPVRILVKRDELTLEGIKQFHVNVDKEEWKLETLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTRDDDRMLFDIQKFYNVVIEELPSNVADLL

SEQ ID NO: 8008 - protein, 413 aa, Euphorbia esula
  misc_feature (30)..(30): Xaa can be any naturally occurring amino acid
MAGLAPEGSQFDARQYDAKMSELLSSDGQXFFTSYDEVYESFDAMGLQENLLRGIYAYGFEKPSAIQQRGIVPFCKGLDVIQQAQSGTGKTATFCSGILQQLDYGLVQCQALVLAPTRELAQQIEKVMRALGDYLGVKVHACVGGTSVREDQRILQAGVHVVVGTPGRVFDMLRRQSLRPDYIKMFVLDEADEMLSRGFKDQIYDIFQLLPTKVQVGVFSATMPPEALEITRKFMNKPVRILVKRDELTLEGIKQFYVNVEKEEWKLETLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRGGRFGRKGVAINFVTRDDERMLFDIQKFYNVVIEELPSNVADLL

SEQ ID NO: 8009 - protein, 413 aa, Cucumis sativus
MAGLAPEGTQFDSRQYDAKMNEILSAEGQEFFTSYDEVYESFDSMGLQENLLRGIYAYGFEKPSAIQQRGIVPFCKGLDVIQQAQSGTGKTATFCSGILQQLDYGLVQCQALVLAPTRELAQQIEKVMRALGDYLGVKVHACVGGTSVREDQRILQAGVHVVVGTPGRVFDMLRRQSLRPDCIKMFVLDEADEMLSRGFKDQIYDIFQLLPSKIQVGVFSATMPPEALEITRKFMNKPVRILVKRDELTLEGIKQFYVNVDKEDWKLETLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTNDDERMLFDIQKFYNVVIEELPANVADLL

SEQ ID NO: 8010 - protein, 413 aa, Ricinus communis
MAGLAPEGSQFDAKQYDAKMSELLSTEGQEFFTTYDEVYDSFDAMGLQENLLRGIYAYGFEKPSAIQQRGIVPFCKGLDVIQQAQSGTGKTATFCSGILQQLDYGLVQCQALVLAPTRELAQQIEKVMRALGDYLGVKVHACVGGTSVREDQRILQAGVHVVVGTPGRVFDMLRRQSLRPDYIKMFVLDEADEMLSRGFKDQIYDIFQLLPAKVQVGVFSATMPPEALEITRKFMNKPVRILVKRDELTLEGIKQFYVNVEKEEWKLETLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRGGRFGRKGVAINFVTRDDERMLFDIQKFYNVVIEELPSNVADLL

SEQ ID NO: 8011 - protein, 413 aa, Vitis vinifera
MAGQAPEGSQFDARQFDSKMNDLLSADGEDFFTSYDEVYDTFDSMGLVENLLRGIYAYGFEKPSAIQQRGIVPFCKGLDVIQQAQSGTGKTATFCSGILQQLDYSLVQCQALVLAPTRELAQQIEKVMRALGDYLGVRVHACVGGTSVREDQRILQTGVHVVVGTPGRVFDMLRRQSLRPDYIKMFVLDEADEMLSRGFKDQIYDIFQLLPSKVQVGVFSATMPPEALEITRKFMNKPVRILVKRDELTLEGIKQFHVNVDKEEWKLETLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTRDDERMLFDIQRFYNVVIEELPSNVADLL

SEQ ID NO: 8012 - protein, 413 aa, Fragaria vesca
MAGLAPEGAQFDAKQYDSKMNEILSSEGQEFFTSYDEVHDSFDAMGLQENLLRGIYAYGFEKPSAIQQRGIVPFCKGLDVIQQAQSGTGKTATFCSGILQQLDYGLVQCQALVLAPTRELAQQIEKVMRALGDYLGVKVHACVGGTSVREDQRILQAGVHVVVGTPGRVFDMLRRQSLRADYIKMFVLDEADEMLSRGFKDQIYDIFQLLPSKVQVGVFSATMPPEALEITRKFMNKPVRILVKRDELTLEGIKQFYVNVDKEEWKLETLCDLYETLAITQSVIFVNTRRKVDWLTDKMRSRDHTVSATHGDMDQNQRDIIMREFRSGSSRVLITTDLLARGIDVQQVSLVINYDLPTQPENYLHRIGRSGRFGRKGVAINFVTRDDDRMLFDIQRFYNVVIEELPSNVADLL

SEQ ID NO: 8013 - protein, 413 aa, Gossypium hirsutum
MAGLAPEGSQFDARQYDQKMTELLQTDGDDFFTSYDEVYDSFDAMGLQENLLRGIYAYGFEKPSAIQQRGIVPFCKGLDVIQQAQSGTGKTATFCSGILQQLDYAVVQCQALVLAPTRELAQQIEKVMRALGDYLGVKVHACVGGTSVREDQRILQSGVHVVVGTPGRVFDMLRRQSLRPDYIKMFVLDEADEMLSRGFKDQIYDIFQLLPAKIQVGVFSATMPPEALEITRKFMNKPVRILVKRDELTLEGIKQFYVNVEKEEWKLETLCDLYETLAITQSVIFVNTRRKVDWLTDKMRSRDHTVSATHGDMDQNTRDVIMREFRSGSSRVLITTDLLARGIDVQQVSLVINYDLPTQPENYLHRIGRSGRFGRKGVAINFVTTDDERMLFDIQKFYNVVIEELPSNVADLL

SEQ ID NO: 8014 - protein, 413 aa, Gossypium hirsutum
MAGVAPEGSQFDARQFDQKMSDLLQTDGDDVFTSYDEVYDSFDAMGLQENLLRGIYAYGFEKPSAIQQRGIVPFCKGLDVIQQAQSGTGKTATFCSGILQQLDYGIVQCQALVLAPTRELAQQIEKVMRALGDYLGVKVHACVGGTSVREDQRILQSGVHVVVGTPGRVFDMLRRQSLRPDYIKMFVLDEADEMLSRGFKDQIYDIFQLLPGKIQVGVFSATMPPEALEITRKFMNKPVRILVKRDELTLEGIKQFYVNVEKEEWKLETLCDLYETLAITQSVIFVNTRRKVDWLTDKMRSRDHTVSATHGDMDQNTRDVIMREFRSGSSRVLITTDLLARGIDVQQVSLVINYDLPTQPENYLHRIGRSGRFGRKGVAINFVTVDDERMLFDIQKFYNVVIEELPSNVADLL

SEQ ID NO: 8015 - protein, 413 aa, Vitis vinifera
MAGLAPEGSQFDARQYDSKMNELLGTDGQDFFTSYDEVYESFDAMGLQENLLRGIYAYGFEKPSAIQQRGIVPFIKGLDVIQQAQSGTGKTATFCSGILQQLDYGLVECQALVLAPTRELAQQIEKVMRALGDYLGVKVHACVGGTSVREDQRILSSGVHVVVGTPGRVFDMLRRQSLRPDYIKMFVLDEADEMLSRGFKDQIYDIFQLLPSKIQVGVFSATMPPEALEITRKFMNKPVRILVKRDELTLEGIKQFYVNVDKEEWKLETLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTKDDERMLFDIQRFYNVVVEELPSNVADLL

SEQ ID NO: 8016 - protein, 413 aa, Liriodendron tulipifera
MAGMAPEGSQFDARSFDAKMNELLTADGQDFFKSYDEVYESFDAMGLQENLLRGIYAYGFEKPSAIQQRGIVPFCKGLDVIQQAQSGTGKTATFCSGILQQLDYGLVECQALVLAPTRELAQQIEKVMRALGDYLGVKVHACVGGTSVREDQRILSSGVHVVVGTPGRVFDMLRRQSLRPDYIKMFVLDEADEMLSRGFKDQIYDIFQLLPSKVQVGVFSATMPPEALEITRKFMNNPVRILVKRDELTLEGIKQFYVNVEKEEWKLETLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTRDDERMLFDIQKFYNVVIEELPSNVADLL

SEQ ID NO: 8017 - protein, 413 aa, Juglans hindsii x Juglans regia
  misc_feature (2)..(4): Xaa can be any naturally occurring amino acid
  misc_feature (21)..(21): Xaa can be any naturally occurring amino acid
  misc_feature (257)..(257): Xaa can be any naturally occurring amino acid
MXXXAPEGSQFDARQFDAKMXELLGADGQDFFTSYDEVYESFDVMGLQENLLRGIYAYGFEKPSAIQQRGIVPFCKGLDVIQQAQSGTGKTATFCSGILQQLDYGLVECQALVLAPTRELAQQIEKVMRALGDYLGVKVHACVGGTSVREDQRILSAGVHVVVGTPGRVFDMLRRQSLRPDYIRMFVLDEADEMLSRGFKDQIYDIFQLLPPKIQVGVFSATMPPEALEITRKFMNKPVRILVKRDELTLEGIKQFXVNVDKEEWKLETLCDLYETLAITQSVIFVNTRRKVDWLTDKMRGRDHTVSATHGDMDQNTRDIIMREFRSGSSRVLITTDLLARGIDVQQVSLVINYDLPTQPENYLHRIGRSGRFGRKGVAINFVTTDDERMLFDIQKFYNVVIEELPANVADLL

SEQ ID NO: 8018 - protein, 412 aa, Cleome spinosa
MAGLAPEGSQFDARQFDQKLNDLLDGGDEFFTSYDEVCESFDAMGLQENLLRGIYAYGFEKPSAIQQRGIVPFCKGLDVIQQAQSGTGKTATFCSGILQQLDYSLVQCQALVLAPTRELAQQIEKVMRALGDYLGVKVHACVGGTSVREDQRILQAGVHVVVGTPGRVFDMLRRQSLRPDYIKMFVLDEADEMLSRGFKDQIYDIFQLLPPKIQVGVFSATMPPEALEITRKFMNKPVRILVKRDELTLEGIKQFYVNVEKEEWKLETLCDLYETLAITQSVIFVNTRRKVDWLTDKMRSRDHTVSATHGDMDQNTRDIIMREFRSGSSRVLITTDLLARGIDVQQVSLVINFDLPTQPENYLHRIGRSGRFGRKGVAINFVTRDDERMLFDIQKFYNVVVEELPSNVADLL

SEQ ID NO: 8019 - protein, 413 aa, Eschscholzia californica
MAGLAPEGSQFDAKQYDSKMNDLLQADGQDFFTSYDEVFESFDAMGLQENLLRGIYAYGFEKPSAIQQRGIVPFCQGLDVIQQAQSGTGKTATFCSGILQQLDYGLLDCQALVLAPTRELAQQIEKVMRALGDYLGVKVHACVGGTSVREDQRILSSGVHVVVGTPGRVFDMLRRQSLRPDNIKMFVLDEADEMLSRGFKDQIYDIFQLLPSKVQVGVFSATMPPEALEITRKFMDKPVRILVKRDELTLEGIKQFYVNVEKEEWKLETLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTKDDERMLFDIQRFYNVVVEELPSNVADLL

SEQ ID NO: 8020 - protein, 413 aa, Tropaeolum majus
MAGLAQEGSQFDARQFDAKMTELLSTDGQDFFTSYDEVYDSFDAMGLQENLLRGIYAYGFEKPSAIQQRGIVPFCKGLDVIQQAQSGTGKTATFCSGILQQLDYGLVQCQALVLAPTRELAQQIEKVMRALGDYLGVKVHACVGGTSVREDQRILQSGVHVVVGTPGRVFDMLRRQSLRSDCIKMFVLDEADEMLSRGFKDQIYDIFQLLTAKVQVGVFSATMPPEALEITRKFMNKPVRILVKRDELTLEGIKQFYVNVDKEEWKLETLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVSINFVTTEDDRMLADIQKFYNVIIEELPSNVADLL

SEQ ID NO: 8021 - protein, 413 aa, Tropaeolum majus
MAGSAPEGSQFDTNHYDSKMTELLSTDGQDFFTSYDEVYDSFDAMGLQENLLRGIYAYGFEKPSAIQQRGIVPFCKGLDVIQQAQSGTGKTATFCSGILQQLDYSLVQCQALVLAPTRELAQQIEKVMRALGDYLGVKVHACVGGTSVREDQRILQAGVHVVVGTPGRVFDMLRRQSLRPDCIKMFVLDEADEMLSRGFKDQIYDIFQLLPGKVQVGVFSATMPPEALEITRKFMNKPVRILVKRDELTLEGIKQFHVNVDKEEWKLETLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTKEDERMLFDIQKFYNVIIEELPSNVADLL

SEQ ID NO: 8022 - protein, 413 aa, Tropaeolum majus
MAGLAPEGSQFDARHYDAKMTELLSTDGQDFFTSYDEVYDSFDVMGLQENLLRGIYAYGFEKPSAIQQRGIVPFCKGLDVIQQAQSGTGKTATFCSGILQQLDYSLVQCQALVLAPTRELAQQIEKVMRALGDYLGVKVHACVGGTSVREDQRILQAGVHVVVGTPGRVFDMLRRQSLRPDYIKMFVLDEADEMLSRGFKDQIYDIFQLLPGKVQVGVFSATMPPEALEITRKFMNKPVRILVKRDELTLEGIKQFHVNVDKEEWKLETLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTKDDDRMLFDIQKFYNVIIEELPSNVADLL

SEQ ID NO: 8023 - protein, 412 aa, Citrus sinensis
MAGLAEGSQFDARQFDARMNDLLGSDGQDFFTSYDEVYDTFDAMGLQENLLRGIYAYGFEKPSAIQQRGIVPFCKGLDVIQQAQSGTGKTATFCSGILQQLDYGLVECQALVLAPTRELAQQIEKVMRALGDYLGVKVHACVGGTSVREDQRILSSGVHVVVGTPGRVFDMLRRQSLRPDNIRIFVLDEADEMLSRGFKDQIYDIFQLLPPKIQVGVFSATMPPEALEITRKFMNKPVRILVKRDELTLEGIKQFHVNVEKEEWKLETLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTRDDERMLFDIQKFYNVVIEELPANVADLL

SEQ ID NO: 8024 - protein, 413 aa, Elaeis guineensis
MAGAAPEGSQFDARQYDAKMTELLSTDGQDFFTSYDEVYDSFDAMGLQENLLRGIYAYGFEKPSAIQQRGIVPFCKGLDVIQQAQSGTGKTATFCSGILQQLDYGLVECQALVLAPTRELAQQIEKVMRALGDYLGVKVHACVGGTSVREDQRILSSGVHVVVGTPGRVFDMLRRQSLRPDYIRMFVLDEADEMLSRGFKDQIYDIFQLLPSKIQVGVFSATMPPEALEITRKFMNKPVRILVKRDELTLEGIKQFYVNVEREEWKLETLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTRDDERMLFDIQRFYNVVIEELPSNVADLL

SEQ ID NO: 8025 - protein, 413 aa, Helianthus annuus
MAGVAPEGSQFDARQFDSKMNDLLSADGQDFFTSYDEVYDSFDAMGLQENLLRGIYAYGFEKPSAIQQRGIVPFTKGLDVIQQAQSGTGKTATFCSGILQQLDYNVVECQALVLAPTRELAQQIEKVMRALGDYLGVKVHACVGGTSVREDQRILSAGVHVVVGTPGRVFDMLRRQSLRSDNIKMFVLDEADEMLSRGFKDQIYDIFQLLPSKVQVGVFSATMPPEALEITRKFMNKPVRILVKRDELTLEGIKQFYVNVEKEEWKLETLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTLDDEKMLGDIQKFYNVVVEELPSNVADLI

SEQ ID NO: 8026 - protein, 413 aa, Mimulus guttatus
MAGLAPEGSQFDTRQFDSRMNELLQVEGEEFFTSYDEVYDSFDAMGLQENLLRGIYAYGFEKPSAIQQRGIVPFCKGLDVIQQAQSGTGKTATFCSGILQQLDYGLTQCQALVLAPTRELAQQIEKVMRALGDYLGVKVHACVGGTSVREDQRILSAGVHVVVGTPGRVFDMLRRQSLRADSIKMFVLDEADEMLSRGFKDQIYDIFQLLPSKVQVGVFSATMPPEALEITRKFMNKPVRILVKRDELTLEGIKQFYVNVEKEEWKLETLCDLYETLAITQSVIFVNTRRKVDWLTDKMRGRDHTVSATHGDMDQNTRDIIMREFRSGSSRVLITTDLLARGIDVQQVSLVINYDLPTQPENYLHRIGRSGRFGRKGVAINFLVREDEKMLQDIQKFYNVVIEELPSNVADLL

SEQ ID NO: 8027 - protein, 413 aa, Unknown
  Sequence found in Organisms: Solanum lycopersicum, Solanum tuberosum, Solanum phureja
MAGLAPEGSQFDARQFDAKMTELLGTEQQEFFTSYDEVHDSFDAMGLQENLLRGIYAYGFEKPSAIQQRGIVPFCKGLDVIQQAQSGTGKTATFCSGILQQLDYSLVECQALVLAPTRELAQQIEKVMRALGDYLGVKVHACVGGTSVREDQRILQSGVHVVVGTPGRVFDMLRRQSLRPDHIKMFVLDEADEMLSRGFKDQIYDIFQLLPPKIQVGVFSATMPPEALEITRKFMNKPVRILVKRDELTLEGIKQFYVNVDKEEWKLETLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTKDDERMLFDIQKFYNVVVEELPANVADLL

SEQ ID NO: 8028 - protein, 413 aa, Malus domestica
MAGVAPEGSQFDAKQYDTKMSELLSTDGQDFFTSYDEVFESFDAMGLQENLLRGIYAYGFEKPSAIQQRGIVPFCKGLDVIQQAQSGTGKTATFCSGILQQLDYGVVQCQALVLAPTRELAQQIEKVMRALGDYLGVKVHACVGGTSVREDQRILQAGVHVVVGTPGRVFDMLRRQSLRPDYIKMFVLDEADEMLSRGFKDQIYDIFQLLPSKVQVGVFSATMPPEALEITRKFMNKPVRILVKRDELTLEGIKQFYVNVDKEEWKLETLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTKDDERMLYDIQRFYNVVIEELPSNVADLL

SEQ ID NO: 8029 - protein, 413 aa, Malus domestica
MAGVAPEGSQFDAKQYDTKMSELLSTDGQDFFTSYDEVFESFDAMGLQENLLRGIYAYGFEKPSAIQQRGIVPFCKGLDVIQQAQSGTGKTATFCSGILQQLDYGVVQCQALVLAPTRELAQQIEKVMRALGDYLGVKVHACVGGTSVREDQRILQAGVHVVVGTPGRVFDMLRRQSLRPDYIKMFVLDEADEMLSRGFKDQIYDIFQLLPSKVQVGVFSATMPPEALEITRKFMNKPVRILVKRDELTLEGIKQFYVNVDKEEWKLETLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTRDDERMLYDIQRFYNVVIEELPSNVADLL

SEQ ID NO: 8030 - protein, 412 aa, Aquilegia formosa
MAGLAPEGSQFNAQQYDSRMELVNADGQDFFTSYDEVHESFDAMGLQENLLRGIYAYGFEKPSAIQQRGIVPFCKGLDVIQQAQSGTGKTATFCSGILQQLDYSLVECQALVLAPTRELAQQIEKVMRALGDYLGVKVHACVGGTSVREDQRILSGGVHVVVGTPGRVFDMLRRQSLRPDCIKMFVLDEADEMLSRGFKDQIYDIFQLLPSKVQVGVFSATMPPEALEITRKFMNKPVRILVKRDELTLEGIKQFYVNVDKEEWKLETLCDLYETLAITQSVIFVNTRRKVDWLTDKMRGRDHTVSATHGDMDQNTRDIIMREFRSGSSRVLITTDLLARGIDVQQVSLVINYDLPTQPENYLHRIGRSGRFGRKGVAINFVTRDDERMLFDIQKFYNVVIEELPSNVADLL

SEQ ID NO: 8031 - protein, 413 aa, Persea americana
MAGVAPEGSQFDARQFDAKMNELLTTDAQDFFTSYDEVFESFDSMGLQENLLRGIYAYGFEKPSAIQQRGIVPFCKGLDVIQQAQSGTGKTATFCSGILQQLDYGLVECQALVLAPTRELAQQIEKVMRALGDYLGVKVHACVGGTSVREDQRILSSGVHVVVGTPGRVFDMLRRQSLRPDYIKMFVLDEADEMLSRGFKDQIYDIFQLLPSKIQVGVFSATMPPEALEITRKFMNKPVRILVKRDELTLEGIKQFYVNVEKEEWKLETLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTLDDERMLFDIQKFYNVVIEELPSNVADLL

SEQ ID NO: 8032 - protein, 413 aa, Theobroma cacao
MAGLAPEGSQFDARQYDQKMTELLQTDGDEFFTSYDEVYDSFDSMGLQENLLRGIYAYGFEKPSAIQQRGIVPFCKGLDVIQQAQSGTGKTATFCSGILQQLDYGVVQCQALVLAPTRELAQQIEKVMRALGDYLGVKVHACVGGTSVREDQRILQSGVHVVVGTPGRVFDMLRRQSLRPDYIKMFVLDEADEMLSRGFKDQIYDIFQQLPAKIQVGVFSATMPPEALEITRKFMNKPVRILVKRDELTLEGIKQFYVNVEKEEWKLETLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTRDDERMLFDIQKFYNVVVEELPSNVADLL

SEQ ID NO: 8033 - protein, 413 aa, Gossypium hirsutum
MAGLAPEGSQFDARQYDQKMTELLQTDGDDFFTSYDEVYDSFDAMGLQENLLRGIYAYGFEKPSAIQQRGIVPFCKGLDVIQQAQSGTGKTATFCSGILQQLDYAMVQCQALVLAPTRELAQQIEKVMRALGDYLGVKVHACVGGTSVREDQRILQSGVHVVVGTPGRVFDMLRRQSLRPDYIKMFVLDEADEMLSRGFKDQIYDIFQLLPAKIQVGVFSATMPPEALEITRKFMNKPVRILVKRDELTLEGIKQFYVNVEKEEWKLETLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTNDDERMLYDIQKFYNVIIEELPSNVADLL

SEQ ID NO: 8034 - protein, 413 aa, Nicotiana benthamiana
MAGAAPEGSQFDARQYDSKMTELLNAEGQDFFTSYDEVYDSFDAMGLKENLLRGIYAYGFEKPSAIQQRGIVPFCKGLDVIQQAQSGTGKTATFCSGILQQLDYELLDCQALVLAPTRELAQQIEKVMRALGDYLGVKVHACVGGTSVREDQRILSSGVHVVVGTPGRVFDMLRRQSLRPDHIKMFVLDEADEMLSRGFKDQIYDIFQLLPPKIQVGVFSATMPPEALEITRKFMNKPVRILVKRDELTLEGIKQFYVNVDKEEWKLETLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVSINFVTNDDERMLSDIQRFYNVVIEELPANVADLL

SEQ ID NO: 8035 - protein, 413 aa, Populus trichocarpa
MAGLAPEGSQFDARQFDSKMNELLTTDGQDFFTSYDEVYDTFDAMGLKENLLRGIYAYGFEKPSAIQQRGIVPFCKGLDVIQQAQSGTGKTATFCSGILQQLDYDVVECQALVLAPTRELAQQIEKVMRALGDYLGVKVHACVGGTSVREDQRILSAGVHVVVGTPGRVFDMLRRQSLRPDYIKMFVLDEADEMLSRGFKDQIYDIFQLLPPKIQVGVFSATMPPEALEITRKFMNKPVRILVKRDELTLEGIKQFYVNVDKEEWKLETLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTKDDERMLSDIQRFYNVTVEELPSNVADLL

SEQ ID NO: 8036 - protein, 413 aa, Nicotiana tabacum
MAGAAPEGSQFDARQYDSKMTELLNAEGQDFFTSYDEVYDSFDAMGLKENLLRGIYAYGFEKPSAIQQRGIVPFCKGLDVIQQAQSGTGKTATFCSGILQQLDYELLDCQALVLAPTRELAQQIEKVMRALGDYLGVKVHACVGGTSVREDQRILSSGVHVVVGTPGRVFDMLRRQSLRPDHIKMFVLDEADEMLSRGFKDQIYDIFQLLPPKIQVGVFSATMPPEALEITRKFMNKPVRILVKRDELTLEGIKQFYVNVDKEEWKLETLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVSINFVTSDDERMLSDIQRFYNVVIEELPANVADLL

SEQ ID NO: 8037 - protein, 413 aa, Nicotiana tabacum
MAGAAPEGSQFDARQFDTKMNELLSADGQDFFTSYDEVYDSFDAMGLQENLLRGIYAYGFEKPSAIQQRGIVPFCKGLDVIQQAQSGTGKTATFCSGILQQLAYELLECQALVLAPTRELAQQIEKVMRALGDYLGVKVHACVGGTSVREDQRILSSGVHVVVGTPGRVFDMLRRQSLRPDHIKMFVLDEADEMLSRGFKDQIYDIFQLLPPKIQVGVFSATMPPEALEITRKFMNKPVRILVKRDELTLEGIKQFYVNVDKEEWKLETLCDLYETLAITQSVIFVNTRRKVDWLTDKMRSRDHTVSATHGDMDQNTRDIIMREFRSGSSRVLITTDLLARGIDVQQVSLVINFDLPTQPENYLHRIGRSGRFGRKGVAINFVTKDDERMLSDIQRFYNVVIEELPANVADLL

SEQ ID NO: 8038 - protein, 413 aa, Solanum lycopersicum
MAGSAPEGSQFDARQFDAKMTELLGTEQQDFFTSYDEVYDSFDAMGLQENLLRGIYAYGFEKPSAIQQRGIVPFCKGLDVIQQAQSGTGKTATFCSGVLQQLDYSLVECQALVLAPTRELAQQIEKVMRALGDYLGVKVHACVGGTSVREDQRILQSGVHVVVGTPGRVFDMLRRQSLRPDHIKMFVLDEADEMLSRGFKDQIYDIFQLLPPKIQVGVFSATMPPEALEITRKFMNKPVRILVKRDELTLEGIKQFYVNVDKEEWKLETLCDLYETLAITQSVIFVNTRRKVDWLTDKMRGRDHTVSATHGDMDQNTRDIIMREFRSGSSRVLITTDLLARGIDVQQVSLVINYDLPTQPENYLHRIGRSGRFGRKGVAINFVTKDDERMLFDIQKFYNVVIEELPANVADLL

SEQ ID NO: 8039 - protein, 414 aa, Solanum phureja
MAGSAPEGSQFDVRQFDSKMNELLSADDGQDFFTSYDEIYDSFDAMGLQENLLRGIYAYGFEKPSAIQQRGIVPFCKGLDVIQQAQSGTGKTATFCSGILQQLNYELLECQALVLAPTRELAQQIEKVMRALGDYLGVKVHACVGGTSVREDQRILSSGVHVVVGTPGRVFDMLRRQSLRPDHIKMFVLDEADEMLSRGFKDQIYDIFQLLPPKIQVGVFSATMPPEALEITRKFMNKPVRILVKRDELTLEGIKQFYVNVDKEEWKLETLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTKDDERMLSDIQRFYNVVIEELPANVADLL

SEQ ID NO: 8040 - protein, 412 aa, Malus domestica
MAAAPEGSQFDTRQYDTKMSELLATDGQEFFTSYDEVYDSFDAMGLQENLLRGIYAYGFEKPSAIQQRGIVPFCKGLDVIQQAQSGTGKTATFCSGILQQLDYSLTECQALVLAPTRELAQQIEKVMRALGDYLGVRVHACVGGTSVREDQRILSNGVHVVVGTPGRVFDMLRRQSLRPDSIKMFVLDEADEMLSRGFKDQIYDIFQLLPSKIQVGVFSATMPPEALEITRKFMNKPVRILVKRDELTLEGIKQFYVNVDKEEWKLETLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTKDDERMLFDIQKFYNVVVEELPSNVADLL

SEQ ID NO: 8041 - protein, 413 aa, Cichorium intybus
MAGAAPEGSQFNAQQFDSKMNELLSTDGQDFFTSYDEVYDSFDAMGLQENLLRGIYAYGFEKPSAIQQRGIVPFCKGLDVIQQAQSGTGKTATFCSGILQQLDYNTVECQALVLAPTRELAQQIEKVMRALGDYLGVKVHACVGGTSVREDQRILSAGVHVVVGTPGRVFDMLRRQSLRADYIKMFVLDEADEMLSRGFKDQIYDIFQLLPSKVQVGVFSATMPPEALEITRKFMNKPVRILVKRDELTLEGIKQFYVNVEKEEWKLETLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTLDDERMLADIQKFYNVVVEELPSNVADLI

SEQ ID NO: 8042 - protein, 413 aa, Trifolium pratense
  misc_feature (250)..(250): Xaa can be any naturally occurring amino acid
MAGVAPEGSQFDAKQFDSKMNELLTTDAQDFFTSYDEVYDSFDAMGLQENLLRGIYAYGFEKPSAIQQRGIVPFCKGLDVIQQAQSGTGKTATFCSGILQQLDYSLTECQALVLAPTRELAQQIEKVMRALGDYLGVKVHACVGGTSVREDQRILSSGVHVVVGTPGRVFDMLRRQSLRPDVIKMFVLDEADEMLSRGFKDQIYDIFQLLPSKIQVGVFSATMPPEALEITRKFMNKPVRILVKRDELTXEGIKQFYVNVDKEEWKLDTLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTTDDERMLSDIQKFYNVIIEELPSNVAELL

SEQ ID NO: 8043 - protein, 413 aa, Vitis vinifera
MAGVAPEGSQFDTRNYDAKMTELLSTDGQDFFTSYDEVYDSFDSMGLQENLLRGIYAYGFEKPSAIQQRGIVPFCKGLDVIQQAQSGTGKTATFCSGILQQLDYGLVECQALVLAPTRELAQQIEKVMRALGDYLGVKVHACVGGTSVREDQRILSSGVHVVVGTPGRVFDMLRRQSLRPDYIKMFVLDEADEMLSRGFKDQIYDIFQLLPSKVQVGVFSATMPPEALEITRKFMNKPVRILVKRDELTLEGIKQFYVNVDKEEWKLETLCDLYETLAITQSVIFVNTRRKVDWLTDKMRSRDHTVSATHGDMDQNTRDIIMREFRSGSSRVLITTDLLARGIDVQQVSLVINFDLPTQPENYLHRIGRSGRFGRKGVAINFVTRDDERMLFDIQRFYNVVIEELPSNVADLL

SEQ ID NO: 8044 - protein, 413 aa, Lactuca sativa
MAGAAPEGSQFNAQQFDSKMNELLSTDGQDFFTSYDEVYDSFDAMGLQENLLRGIYAYGFEKPSAIQQRGIVPFCKGLDVIQQAQSGTGKTATFCSGILQQLDYNVVECQALVLAPTRELAQQIEKVMRALGDYLGVKVHACVGGTSVREDQRILSAGVHVVVGTPGRVFDMLRRQSLRADYIKMFVLDEADEMLSRGFKDQIYDIFQLLPSKVQVGVFSATMPPEALEITRKFMNKPVRILVKRDELTLEGIKQFYVNVEKEEWKLETLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTLDDERMLADIQKFYNVVVEELPSNVADLI

SEQ ID NO: 8045 - protein, 411 aa, Quercus alba
MAAPEGSQFDARQFDAKMDELLSADAQDFFTSYDEVYESFDAMGLQENLLRGIYAYGFEKPSAIQQRGIVPFCKGLDVIQQAQSGTGKTATFCSGVLQQLDYSLTECQALVLAPTRELAQQIEKVMRALGDYLGVRVHACVGGTSVREDQRILSSGVHVVVGTPGRVFDMLRRQSLRPDYIKMFVLDEADEMLSRGFKDQIYDIFQLLPSKIQVGVFSATMPPEALEITRKFMNKPVRILVKRDELTLEGIKQFYVNVDKEEWKLETLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTKDDERMLFDIQKFYNVVVEELPSNVADLL

SEQ ID NO: 8046 - protein, 413 aa, Elaeis guineensis
MAGVAPEGSQFDARQYDSKMNELLTQDGQEFFTTYDEVYDSFDSMGLQENLLRGIYAYGFEKPSAIQQRGIVPFCKGLDVIQQAQSGTGKTATFCSGILQQLDYGLVECQALVLAPTRELAQQIEKVMRALGDYLGVKVHACVGGTSVREDQRILSSGVHVVVGTPGRVFDMLRRQSLRPDYIRMFVLDEADEMLSRGFKDQIYDIFQLLPSKIQVGVFSATMPPEALEITRKFMNKPVRILVKRDELTLEGIKQFYVNVEKEDWKLETLCDLYETLAITQSVIFVNTRRKVDWLTDKMRSRDHTVSATHGDMDQNARDIIMREFRSGSSRVLITTDLLARGIDVQQVSLVINYDLPTQPENYLHRIGRSGRFGRKGVAINFVTRDDERMLFDIQRFYNVVIEELPSNVADLL

SEQ ID NO: 8047 - protein, 413 aa, Arachis hypogaea
MAGAAPEGTQFDARQFDAKMNDLLTADGQDFFTSYDEVYDSFDAMGLQENLLRGIYAYGFEKPSAIQQRGIVPFCKGLDVIQQAQSGTGKTATFCSGILQQLDYSLTECQALVLAPTRELAQQIEKVMRALGDYLGVKVHACVGGTSVREDQRILASGVHVVVGTPGRVFDMLRRQSLQPDHIKMFVLDEADEMLSRGFKDQIYDIFQLLPSKIQVGVFSATMPPEALEITRKFMNKPVRILVKRDELTLEGIKQFYVNCEREEWKLDTLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTKDDERMLFDIQKFYNVQIEELPANVAELL

SEQ ID NO: 8048 - protein, 413 aa, Solanum tuberosum
MAGSAPEGSQFDARQFDAKMTELLGTEQQEFFTSYDEVYDSFDAMGLQENLLRGIYAYGFEKPSAIQQRGIVPFCKGLDVIQQAQSGTGKTATFCSGVLQQLDYSLVECQALVLAPTRELAQQIEKVMRALGDYLGVKVHACVGGTSVREDQRILQSGVHVVVGTPGRVFDMLRRQSLRPDHIKMFVLDEADEMLSRGFKDQIYDIFQLLPPKIQVGVFSATMPPEALEITRKFMNKPVRILVKRDELTLEGIKQFYVNVDKEEWKLETLCDLYETLAITQSVIFVNTRRKVDWLTDKMRGRDHTVSATHGDMDQNTRDIIMREFRSGSSRVLITTDLLARGIDVQQVSLVINYDLPTQPENYLHRIGRSGRFGRKGVAINFVTKDDERMLFDIQKFYNVVIEELPANVADLL

SEQ ID NO: 8049 - protein, 411 aa, Prunus persica
MAAPEGSQFDTRQYDSKMTELLATDGQEFFTSYDEVYDSFDSMGLQENLLRGIYAYGFEKPSAIQQRGIVPFCKGLDVIQQAQSGTGKTATFCSGILQQLDYGLTECQALVLAPTRELAQQIEKVMRALGDYLGVRVHACVGGTSVREDQRILSNGVHVVVGTPGRVFDMLRRQSLRPDNIKMFVLDEADEMLSRGFKDQIYDIFQLLPSKIQVGVFSATMPPEALEITRKFMNKPVRILVKRDELTLEGIKQFYVNVDKEEWKLETLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTKDDERMLFDIQKFYNVLVEELPSNVADLL

SEQ ID NO: 8050 - protein, 413 aa, Glycine max
MAGLAPEGTQFDGRQYDAKMSELLSTDGQEFFTSYDEVYDSFDAMGLQENLLRGIYAYGFERPSAIQQRGIVPFCKGLDVIQQAQSGTGKTATFCSGILQQLDYGLVQCQALVLAPTRELAQQIEKVMRALGDYLGVKVHACVGGTSVREDQRILQAGVHTVVGTPGRVFDMLRRQSLRPDCIKMFVLDEADEMLSRGFKDQIYDIFQLLPSKIQVGVFSATMPPEALEITRKFMNKPVRILVKRDELTLEGIKQFYVNVDKEEWKLETLCDLYETLAITQSVIFVNTRRKVDWLTDKMRSNDHTVSATHGDMDQNTRDIIMREFRSGSSRVLITTDLLARGIDVQQVSLVINYDLPTQPENYLHRIGRSGRFGRKGVAINFVTTDDSRMLSDIQKFYNVTVEELPSNVADLL

SEQ ID NO: 8051 - protein, 413 aa, Glycine max
MAGLAPEGSQFDARQYDSKMNELLSADGQEFFTSYDEVYDSFDAMGLQENLLRGIYAYGFERPSAIQQRGIVPFCKGLDVIQQAQSGTGKTATFCSGILQQLDYGLVQCQALVLAPTRELAQQIEKVMRALGDYLGVKVHACVGGTSVREDQRILQAGVHTVVGTPGRVFDMLRRQSLRPDHIKMFVLDEADEMLSRGFKDQIYDIFQLLPGQIQVGVFSATMPPEALEITRKFMNKPVRILVKRDELTLEGIKQFYVNVDKEDWKLETLCDLYETLAITQSVIFVNTRRKVDWLTDKMRSNDHTVSATHGDMDQNTRDIIMREFRSGSSRVLITTDLLARGIDVQQVSLVINYDLPTQPENYLHRIGRSGRFGRKGVAINFVTLDDARMLSDIQKFYNVTVEELPSNVADLL

SEQ ID NO: 8052 - protein, 413 aa, Nicotiana tabacum
MAGLAPEGSQFDARQYDAKMTELLGTEQEEFFTSYDEVYDSFDAMGLQENLLRGIYAYGFEKPSAIQQRGIVPFCKGLDVIQQAQSGTGKTATFCSGVLQQLDYSLVECQALVLAPTRELAQQIEKVMRALGDYLGVKVHACVGGTSVREDQRILQSGVHVVVGTPGRVFDMLRRQSLRPDHIKMFVLDEADEMLSRGFKDQIYDIFQLLPPKIQVGVFSATMPPEALEITRKFMNKPVRILVKRDELTLEGIKQFYVNVDKEEWKLETLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTKDDERMLSDIQKFYNVVIEELPANVADLL

SEQ ID NO: 8053 - protein, 413 aa, Solanum phureja
MAGSAPEGSQFDARQFDAKMTELLGTEQQEFFTSYDEVYDSFDAMGLQENLLRGIYAYGFEKPSAIQQRGIVPFCKGLDVIQQAQSGTGKTATFCSGVLQQLDYSLVECQALVLAPTRELAQQIEKVMRALGDYLGVKVHACVGGTSVREDQRILQSGVHVVVGTPGRVFDMLRRQSLRPDHIKMFVLDEADEMLSRGFKDQIYDIFQLLPPKIQVGVFSATMPPEALEITRKFMNKPVRILVKRDELTLEGIKQFYVNVDKEEWKLETLCDLYETLAITQSVIFVNTRRKVDWLTDKMRGRDHTVSATHGDMDQNTRDIIMREFRSGSSRVLITTDLLARGIDVQQVSLVINYDLPTQPENYLHRIGRSGRFGRKGVAINFVTKDDERMLFDIQKFYNVVVEELPANVADLL

SEQ ID NO: 8054 - protein, 412 aa, Malus domestica
MAAAPEGSQFDTRQYDTKMSEILATDGQEFFTSYDEVYDSFDAMGLQENLLRGIYAYGFEKPSAIQQRGIVPFCKGLDVIQQAQSGTGKTATFCSGILQQLDYSLTECQALVLAPTRELAQQIEKVMRALGDYLGVRVHACVGGTSVREDQRILSNGVHVVVGTPGRVFDMLRRQSLRPDSIKMFVLDEADEMLSRGFKDQIYDIFQLLPSKIQVGVFSATMPPEALEITRKFMNKPVRILVKRDELTLEGIKQFYVNVDKEEWKLETLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTKDDERMLFDIQKFYNVVVEELPSNVADLL

SEQ ID NO: 8055 - protein, 412 aa, Artemisia annua
MAAAPESSQFDTRQFDSKMNELLSTDGQDFFTSYDEVYDSFDAMGLQENLLRGIYAYGFEKPSAIQQRGIVPFTKGLDVIQQAQSGTGKTATFCSGILQQLDYSVVECQALVLAPTRELAQQIEKVMRALGDYLGVKVHACVGGTSVREDQRILSAGVHVVVGTPGRVFDMLRRQSLRSDYIKMFVLDEADEMLSRGFKDQIYDIFQLLPSKVQVGVFSATMPPEALEITRKFMNKPVRILVKRDELTLEGIKQFYVNVEKEEWKLETLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTLDDERMLADIQKFYNVVVEELPSNVADLI

SEQ ID NO: 8056 - protein, 413 aa, Manihot esculenta
MAGLAPEGSQFDAKHYDAKMNELLTTEGEEFFTSYDEVYDSFDSMGLQENLLRGIYAYGFEKPSAIQQRGIVPFCKGLDVIQQAQSGTGKTATFCSGILQQLDYGLVECQALVLAPTRELAQQIEKVMRALGDYLGVKVHACVGGTSVREDQRILSSGVHVVVGTPGRVFDMLRRQSLRPDYIRMFVLDEADEMLSRGFKDQIYDIFQLLPSKIQVGVFSATMPPEALEITRKFMNKPVRILVKRDELTLEGIKQFHVNVEKEEWKLETLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRGGRFGRKGVAINFVTKDDDRMLFDIQRFYNVVIEELPSNVADLL

SEQ ID NO: 8057 - protein, 411 aa, Castanea mollissima
MAAPEGSQFDARQFDAKMDELLSADAQDFFTSYDEVYESFDAMGLQENLLRGIYAYGFEKPSAIQQRGIVPFCKGLDVIQQAQSGTGKTATFCSGVLQQLDYSVTECQALVLAPTRELAQQIEKVMRALGDYLGVRVHACVGGTSVREDQRILSSGVHVVVGTPGRVFDMLRRQSLRPDYIKMFVLDEADEMLSRGFKDQIYDIFQLLPSKIQVGVFSATMPPEALEITRKFMNKPVRILVKRDELTLEGIKQFYVNVDKEEWKLETLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTKDDERMLFDIQKFYNVVVEELPSNVADLL

SEQ ID NO: 8058 - protein, 413 aa, Castanea mollissima
MAGVAPEGSQFDARQYDAKMSELLGTDGQEFFTSYDEVFESFDAMGLQENLLRGIYAYGFEKPSAIQQRGIVPFCKGLDVIQQAQSGTGKTATFCSGILQQLDYGLVECQALVLAPTRELAQQIEKVMRALGDYLGVKVHACVGGTSVREDQRILSAGVHVVVGTPGRVFDMLRRQSLRPDYIKMFVLDEADEMLSRGFKDQIYDIFQLLPPKIQVGVFSATMPPEALEITRKFMNKPVRILVKRDELTLEGIKQFHVNVEKEEWKLETLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTKDDERMLFDIQKFYNVVIEELPANVADLL

SEQ ID NO: 8059 - protein, 412 aa, Gossypium hirsutum
MAAAAPEGSQFDARQYDAKMDELEAVGQDFFTSYDEVYDTFDVMGLQENLLRGIYAYGFEKPSAIQQRGIVPFCKGLDVIQQAQSGTGKTATFCSGILQQLDYSLVQCQALVLAPTRELAQQIEKVMRALGDYLGVKVHACVGGTSVREDQRILSSGVHVVVGTPGRVFDMLRRQSLRPDHIKMFVLDEADEMLSRGFKDQIYDIFQLLPPKIQVGVFSATMPPEALEITRKFMNKPVRILVKRDELTLEGIKQFYVNVEKEEWKLETLCDLYETLAITQSVIFVNTRRKVDWLTDKMRSRDHTVSATHGDMDQNARDIIMREFRSGSSRVLITTDLLARGIDVQQVSLVINYDLPTQPENYLHRIGRSGRFGRKGVAINFVTTDDERMLYDIQRFYNVVIEELPSNVADLI

SEQ ID NO: 8060 - protein, 413 aa, Lactuca sativa
MAGAAPEGSQFNAQQFDSKMNELLSTDGQDFFTSYDEVYDSFDAMGLQENLLRGIYAYGFEKPSAIQQRGIVPFCKGLDVIQQAQSGTGKTATFCSGILQQLDYNVVECQALVLAPTRELAQQIEKVMRALGDYLGVKVHACVGGTSVREDQRILSAGVHVVVGTPGRVFDMLRRQSLRADYIKMFVLDEADEMLSRGFKDQIYDIFQLLPSKVQVGVFSATMPPEALEITRKFMNKPVRILVKRDELTLEGIKQFYVNVEKEEWKLETLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTLDDERMLGDIQKFYNVVGEELPSNGADLI

SEQ ID NO: 8061 - protein, 413 aa, Lotus japonicus
MAGVAPEGSQFDARQYDAKMSDLLSSDGQDFFTSYDEVYDSFDAMGLQENLLRGIYAYGFERPSAIQQRGIVPFCKGLDVIQQAQSGTGKTATFCSGILQQLDYGLVQCQALVLAPTRELAQQIEKVMRALGDYLGVKVHACVGGTSVREDQRILQAGVHTVVGTPGRVFDMLRRQSLRPDSIKMFVLDEADEMLSRGFKDQIYDIFQLLPGKIQVGVFSATMPPEALEITRKFMNKPVRILVKRDELTLEGIKQFYVNVEKEEWKLETLCDLYETLAITQSVIFVNTRRKVDWLTDKMRSNDHTVSATHGDMDQNTRDIIMREFRSGSSRVLITTDLLARGIDVQQVSLVINYDLPTQPENYLHRIGRSGRFGRKGVAINFVTLDDSRMLSDIQKFYNVTVEELPSNVADLL

SEQ ID NO: 8062 - protein, 413 aa, Medicago truncatula
MAGVAPEGSQFDAKQFDSKMNELLTTDAQDFFTSYDEVYDSFDAMGLQENLLRGIYAYGFEKPSAIQQRGIVPFIKGLDVIQQAQSGTGKTATFCSGILQQLDYSVTECQALVLAPTRELAQQIEKVMRALGDYLGVKVHACVGGTSVREDQRILSSGVHVVVGTPGRVFDMLRRQSLRPDYIKMFVLDEADEMLSRGFKDQIYDIFQLLPSKIQVGVFSATMPPEALEITRKFMNKPVRILVKRDELTLEGIKQFYVNVDKEEWKLDTLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTTDDERMLSDIQKFYNVLIEELPSNVAELL

SEQ ID NO: 8063 - protein, 413 aa, Cucumis melo
  misc_feature (181)..(181): Xaa can be any naturally occurring amino acid
  misc_feature (278)..(278): Xaa can be any naturally occurring amino acid
MAGLAPEGTQFDSRQYDAKMNEILSAEGQEFFTSYDEVYESFDSMGLQENLLRGIYAYGFEKPSAIQQRGIVPFCKGLDVIQQAQSGTGKTATFCSGILQQLDYGLVQCQALVLAPTRELAQQIEKVMRALGDYLGVKVHACVGGTSVREDQRILQAGVHVVVGTPGRVFDMLRRQSLRPXCIKMFVLDEADEMLSRGFKDQIYDIFQLLPSKIQVGVFSATVPPEALEITRKFMNKPVRILVKRDELTLEGIKQFYVNVDREDWKLETLCDLYETLXITQSVIFVNTRRKVDWLTDNMRSRDHTVSATHGDMDQNTRDIIMREFRSGSSRVLITTDLLARGIDVQQVSLVINYDLPTQPENYLHRIGRSGRFGRKGVAINFVTNDDERMLFDIQKFYNVVIEELPANVADLL

SEQ ID NO: 8064 - protein, 413 aa, Quercus alba
MAALTPEGSQFDARQYDAKMSELLGTDGQEFFTSYDEVFESFDAMGLQENLLRGIYAYGFEKPSAIQQRGIVPFCKGLDVIQQAQSGTGKTATFCSGILQQLDYGLVECQALVLAPTRELAQQIEKVMRALGDYLGVKVHACVGGTSVREDQRILSAGVHVVVGTPGRVFDMLRRQSLRPDYIKMFVLDEADEMLSRGFKDQIYDIFQLLPPKIQVGVFSATMPPEALEITRKFMNKPVRILVKRDELTLEGIKQFHVNVEKEEWKLETLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTKDDERMLFDIQKFYNVVIEELPANVADLL

SEQ ID NO: 8065 - protein, 413 aa, Carica papaya
MAGLAPEGSQFDARQYDAKMNDLLSADGQDFFTSYDEVYDTFDSMGLQENLLRGIYAYGFEKPSAIQQRGIVPFCKGLDVIQQAQSGTGKTATFCSGVLQQLDYGLVECQALVLAPTRELAQQIEKVMRALGDYLGVRVHACVGGTSVREDQRILSSGVHVVVGTPGRVFDMLRRQSLRPDYIKMFVLDEADEMLSRGFKDQIYDIFQLLPAKVQVGVFSATMPPEALEITRKFMNKPVRILVKRDELTLEGIRQFYVNVEKEEWKLETLCDLYETLAITQSVIFVNTRRKVDWLTDKMRARDHTVSATHGDMDQNTRDIIMREFRSGSSRVLITTDLLARGIDVQQVSLVINYDLPTQPENYLHRIGRSGRFGRKGAAINFVTLDDERMLADIQKFYNVVIEELPSNIADLL

SEQ ID NO: 8066 - protein, 413 aa, Capsicum annuum
MAGLAPEGSQFDTRQFDAKMTELLGTEQQEFFTSYDEVYESFDAMGLQENLLRGIYAYGFEKPSAIQQRGIVPFCKGLDVIQQAQSGTGKTATFCSGILQQLDYSLVESQALVLAPTRELAQQIEKVMRALGDYLGVKVHACVGGTSVREDQRILQSGVHVVVGTPGRVFDMLRRQSLRPDHIKMFVLDEADEMLSRGFKDQIYDIFQLLPPKIQVGVFSATMPPEALEITRKFMNKPVRILVKRDELTLEGIKQFYVNVEKEEWKLETLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTKDDERMLFDIQKFYNVVIEELPANVADLL

SEQ ID NO: 8067 - protein, 413 aa, Populus trichocarpa
MASSAPEGSQFDARQFDSKMNELLTAEGQDFFTSYDEVHETFDAMNLKENLLRGIYAYGFEKPSAIQQRGIVPFCKGLDVIQQAQSGTGKTATFCSGILQQLDYDIVECQALVLAPTRELAQQIEKVMRALGDYLGVKVHACVGGTSVREDQRILSAGVHVVVGTPGRVFDMLRRQSLRPDYIKMFVLDEADEMLSRGFKDQIYDIFQLLPPKIQVGVFSATMPPEALEITRKFMNKPVRILVKRDELTLEGIKQFYVNVDKEEWKLETLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTRDDERMLSDIQRFYNVTVEELPSNVADLL

SEQ ID NO: 8068 - protein, 413 aa, Prunus persica
MAGVAPEGSQFDAKQYDTKMSELLSTDGQEFFTSYDEVYESFDSMGLQENLLRGIYAYGFEKPSAIQQRGIVPFCKGLDVIQQAQSGTGKTATFCSGILQQLDYAVVQCQALVLAPTRELAQQIEKVMRALGDYLGVKVHACVGGTSVREDQRILQAGVHVVVGTPGRVFDMLRRQSLRPDYIKMFVLDEADEMLSRGFKDQIYDIFQLLPSKVQVGVFSATMPPEALEITRKFMNKPVRILVKRDELTLEGIKQFYVNVDKEEWKLETLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTRDDERMLYDIQRFYNVVIEELPSNVADLL

SEQ ID NO: 8069 - protein, 413 aa, Glycine max
MAGLAPEGTQFDGRQYDAKMSELLSTDGQEFFTSYDEVYDSFDAMGLQENLLRGIYAYGFERPSAIQQRGIVPFCKGLDVIQQAQSGTGKTATFCSGILQQLDYGLVQCQALVLAPTRELAQQIEKVMRALGDYLGVKVHACVGGTSVREDQRILQAGVHTVVGTPGRVFDMLRRQSLRPDCIKMFVLDEADEMLSRGFKDQIYDIFQLLPSKIQVGVFSATMPPEALEITRKFMNKPVRILVKRDELTLEGIKQFYVNVDKEEWKLETLCDLYETLAITQSVIFVNTRRKVDWLTDKMRSNDHTVSATHGDMDQNTRDIIMREFRSGSSRVLITTDLLARGIDVQQVSLVINYDLPTQPENYLHRIGRSGRFGRKGVSINFVTTDDARMLSDIQKFYNVTVEELPSNVADLL

SEQ ID NO: 8070 - protein, 413 aa, Helianthus annuus
MAGAAPEGSQFDTRHFDSKMNELLSTDGQDFFTSYDEVYDSFDAMGLQENLLRGIYAYGFEKPSAIQQRGIVPFTKGLDVIQQAQSGTGKTATFCSGILQQLDYNVVECQALVLAPTRELAQQIEKVMRALGDYLGVKVHACVGGTSVREDQRILSAGVHVVVGTPGRVFDMLRRQSLRSDYIKMFVLDEADEMLSRGFKDQIYDIFQLLPSKVQVGVFSATMPPEALEITRKFMNKPVRILVKRDELTLEGIKQFYVNVEKEEWKLETLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTLDDERMLADIQKFYNVVVEELPSNVADLI

SEQ ID NO: 8071 - protein, 413 aa, Helianthus annuus
MAGAAPEGSQFDTRHFDSKMNELLSTDGQDFFTSYDEVYDSFDAMGLQENLLRGIYAYGFEKPSAIQQRGIVPFTKGLDVIQQAQSGTGKTATFCSGILQQLDYNVVECQALVLAPTRELAQQIEKVMRALGDYLGVKVHACVGGTSVREDQRILSAGVHVVVGTPGRVFDMLRRQSLRADYIKMFVLDEADEMLSRGFKDQIYDIFQLLPSKVQVGVFSATMPPEALEITRKFMNKPVRILVKRDELTLEGIKQFYVNVEKEEWKLETLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTLDDERMLADIQKFYNVVVEELPSNVADLI

SEQ ID NO: 8072 - protein, 413 aa, Nicotiana tabacum
MAGLAPEGSQFDARQYDAKMTELLGTEQQEFFTSYDEVYESFDAMGLQENLLRGIYAYGFEKPSAIQQRGIVPFCKGLDVIQQAQSGTGKTATFCSGILQQLDYSLVECQALVLAPTRELAQQIEKVMRALGDYLGVKVHACVGGTSVREDQRILQSGVHVVVGTPGRVFDMLRRQSLRPDNIKMFVLDEADEMLSRGFKDQIYDIFQLLPPKIQVGVFSATMPPEALEITRKFMNKPVRILVKRDELTLEGIKQFYVNVDKEEWKLETLCDLYETLAITQSVIFVNTRRKVDWLTDKMRGRDHTVSATHGDMDQNTRDIIMREFRSGSSRVLITTDLLARGIDVQQVSLVINYDLPTQPENYLHRIGRSGRFGRKGVSINFVTKDDERMLFDIQKFYNVVIEELPANVADLL

SEQ ID NO: 8073 - protein, 413 aa, Populus trichocarpa
MAGLAPEGSQYDAKQYDAKMNDLLANDGQDFFTMYEEVFETFDSMGLQENLLRGIYAYGFEKPSAIQQRGIVPFCKGLDVIQQAQSGTGKTATFCSGILQQLDYGLVQCQALVLAPTRELAQQIEKVMRALGDYLGVKVHACVGGTSVREDQRILQAGVHVVVGTPGRVFDMLRRQSLRQDYIKMFVLDEADEMLSRGFKDQIYDIFQLLPSKVQVGVFSATMPPEALEITRKFMNKPVRILVKRDELTLEGIKQFYVNVDKEEWKLETLCDLYETLAITQSVIFVNTRRKVDWLTDKMRGRDHTVSATHGDMDQNTRDIIMREFRSGSSRVLITTDLLARGIDVQQVSLVINYDLPTQPENYLHRIGRSGRFGRKGVAINFVTSDDDRMLFDIQKFYNVVVEELPSNVADLL

SEQ ID NO: 8074 - protein, 414 aa, Coffea canephora
MAGLAPEGSQFDARQYDAKMTELLGTDGGQEFFTSYDEVYDSFDSMGLQENLLRGIYAYGFEKPSAIQQRGIVPFCKGLDVIQQAQSGTGKTATFCSGILQQLDYSVVECQALVLAPTRELAQQIEKVMRALGDYLGVKVHACVGGTSVREDQRILSSGVHVVVGTPGRVFDMLRRQSLRPDYIKMFVLDEADEMLSRGFKDQIYDIFQLLPPKIQVGVFSATMPPEALEITRKFMNKPVRILVKRDELTLEGIKQFYVNVEKEEWKLETLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTRDDERMLFDIQKFYNVVIEELPANVADLL

SEQ ID NO: 8075 - protein, 412 aa, Cleome gynandra
MAGLAPEGSQFDARQFDQKLNDLLETGDEFFTSYDEVYESFDSMGLQENLLRGIYAYGFEKPSAIQQRGIVPFCKGLDVIQQAQSGTGKTATFCSGILQQLDYSLVQCQALVLAPTRELAQQIEKVMRALGDYLGVKVHACVGGTSVREDQRILQAGVHVVVGTPGRVFDMLRRQSLRPDYIKMFVLDEADEMLSRGFKDQIYDIFQLLPPKIQVGVFSATMPPEALEITRKFMNKPVRILVKRDELTLEGIKQFYVNIEKEEWKLDTLCDLYETLAITQSVIFVNTRRKVDWLTDQMRGRDHTVSATHGDMDQNTRDIIMREFRSGSSRVLITTDLLARGIDVQQVSLVINYDLPTQPENYLHRIGRSGRFGRKGVAINFVTRDDERMLFDIQKFYNVVVEELPSNIADLL

SEQ ID NO: 8076 - protein, 412 aa, Theobroma cacao
MAAAAPEGSQFDARQYDAKMNELEADGQEFFTTYDEVYDTFDSMGLQENLLRGIYAYGFEKPSAIQQRGIVPFCKGLDVIQQAQSGTGKTATFCSGILQQLDYSLVQCQALVLAPTRELAQQIEKVMRALGDYLGVKVHACVGGTSVREDQRILSTGVHVVVGTPGRVFDMLRRQSLRPDHIKMFVLDEADEMLSRGFKDQIYDIFQLLPPKIQVGVFSATMPPEALEITRKFMNKPVRILVKRDELTLEGIKQFYVNVEKEEWKLETLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTRDDERMLFDIQKFYNVVVEELPSNVADLI

SEQ ID NO: 8077 - protein, 413 aa, Ricinus communis
MAGLAPEGSQFDAKHFDSKMNELLTADGEDFFTTYDEVYESFDSMGLQENLLRGIYAYGFEKPSAIQQRGIVPFCKGLDVIQQAQSGTGKTATFCSGILQQLDYALVECQALVLAPTRELAQQIEKVMRALGDYLGVKVHACVGGTSVREDQRILSSGVHVVVGTPGRVFDMLRRQSLRPDYIKMFVLDEADEMLSRGFKDQIYDIFQLLPSKIQVGVFSATMPPEALEITRKFMNKPVKILVKRDELTLEGIKQFHVNVEKEEWKLETLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRGGRFGRKGVAINFVTRDDERMLFDIQKFYNVVVEELPSNVADLL

SEQ ID NO: 8078 - protein, 413 aa, Cichorium intybus
MAGIAPEGSQFDARQFDSKMSELLSADGQDFFTSYDEVYDSFDAMGLQENLLRGIYAYGFEKPSAIQQRGIVPFTKGLDVIQQAQSGTGKTATFCSGILQQLDYNVVECQALVLAPTRELAQQIEKVMRALGDYLGVKVHACVGGTSVREDQRILSAGVHVVVGTPGRVFDMLRRQSLRADYIKMFVLDEADEMLSRGFKDQIYDIFQLLPSKVQVGVFSATMPPEALEITRKFMNKPVRILVKRDELTLEGIKQFYVNVEKEDWKLETLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTLEDEKMLADIQKFYNVVVEELPSNVADLI

SEQ ID NO: 8079 - protein, 413 aa, Vigna unguiculata
MAGLAPEGTQFDGRQYDAKMTELLSTDGQEFFTSYDEVYDSFDAMGLQENLLRGIYAYGFERPSAIQQRGIVPFCKGLDVIQQAQSGTGKTATFCSGILQQLDYGLVQCQALVLAPTRELAQQIEKVMRALGDYLGVKVHACVGGTSVREDQRILQAGVHTVVGTPGRVFDMLRRQSLRPDYIKMFVLDEADEMLSRGFKDQIYDIFQLLPSKIQVGVFSATMPPEALEITRKFMNKPVRILVKRDELTLEGIKQFYVNVDKEEWKLETLCDLYETLAITQSVIFVNTRRKVDWLTDKMRSNDHTVSATHGDMDQNTRDIIMREFRSGSSRVLITTDLLARGIDVQQVSLVINYDLPTQPENYLHRIGRSGRFGRKGVAINFVTADDSRMLSDIQKFYNVTVEELPSNVADLL

SEQ ID NO: 8080 - protein, 413 aa, Actinidia deliciosa
MAGLTPEGSQFDTRQYDTKMSELLSTDGQDFFTSYDEVYESFDSMGLQENLLRGIYAYGFEKPSAIQQRGIVPFCKGLDVIQQAQSGTGKTATFCSGILQQLDYSLVQCQALVLAPTRELAQQIEKVMRALGDYLGVKVHACVGGTSVREDQRILQSGVHVVVGTPGRVFDMLRRQSLRPDYIKMFVLDEADEMLSRGFKDQIYDIFQLLPSKVQVGVFSATMPPEALEITRKFMNKPVRILVKRDELTLEGIKQFYVNVEKEEWKLETLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTKEDERMLFDIQRFYNVVVEELPSNVADLL

SEQ ID NO: 8081 - protein, 413 aa, Medicago truncatula
MAGLAPEGSQFDANHYDSKMNELLATDGQEFFTSYDEVYDSFDAMGLQENLLRGIYAYGFERPSAIQQRGIVPFCKGLDVIQQAQSGTGKTATFCSGILQQLDYGLVQCQALVLAPTRELAQQIEKVMRALGDFLGVKVHACVGGTSVREDQRILQAGVHTVVGTPGRVFDMLRRQSLRSECIKMFVLDEADEMLSRGFKDQIYDIFQQLPGKIQVGVFSATMPPEALEITRKFMNKPVRILVKRDELTLEGIKQFYVNVDKEEWKLETLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVSINFVTGEDARMLADIQKFYNVTIEELPSNVADLL

SEQ ID NO: 8082 - protein, 413 aa, Petunia hybrida
MAGLAPEGSQFDAKQYDAKMTELLGTETTEFFTSYDEVYESFDAMGLQENLLRGIYAYGFEKPSAIQQRGIVPFCKGLDVIQQAQSGTGKTATFCSGILQQLDYSLVECQALVLAPTRELAQQIEKVMRALGDYLGVKVHACVGGTSVREDQRILQSGVHVVVGTPGRVFDMLRRQSLRPDHIKMFVLDEADEMLSRGFKDQIYDIFQLLPPKIQVGVFSATMPPEALEITRKFMNKPVRILVKRDELTLEGIKQFYVNVEKEEWKLETLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTKDDERMLFDIQRFYNVVIEELPANVADLL

SEQ ID NO: 8083 - protein, 413 aa, Populus trichocarpa
MASSAPEGSQFDARQFDSRMNELLTAEGQDFFTSYDEVHETFDAMNLKENLLRGIYAYGFEKPSAIQQRGIVPFCKGLDVIQQAQSGTGKTATFCSGILQQLDYDIVECQALVLAPTRELAQQIEKVMRALGDYLGVKVHACVGGTSVREDQRILSAGVHVVVGTPGRVFDMLRRQSLRPDYIKMFVLDEADEMLSRGFKDQIYDIFQLLPPKIQVGVFSATMPPEALEITRKFMNKPVRILVKRDELTLEGIKQFYVNVDKEEWKLETLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTRDDERMLSDIQRFYNVTVEELPSNVADLL

SEQ ID NO: 8084 - protein, 413 aa, Glycine max
MAGLAPEGSQFDARQYDTKMNELLTSDGQDFFTSYDEVYDSFDAMGLQENLLRGIYAYGFEKPSAIQQRGIVPFCKGLDVIQQAQSGTGKTATFCSGILQQLDYSVTECQALVLAPTRELAQQIEKVMRALGDYLGVKVHACVGGTSVREDQRILSSGVHVVVGTPGRVFDMLRRQSLRPDYIKMFVLDEADEMLSRGFKDQIYDIFQLLPSKIQVGVFSATMPPEALEITRKFMNKPVRILVKRDELTLEGIKQFHVNVEKEEWKLDTLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTRDDEKMLFDIQKFYNVIIEELPSNVAELL

SEQ ID NO: 8085 - protein, 413 aa, Glycine max
MAGLAPEGSQFDARQYDSKMSDLLSSDGQDFFTSYDEVYDSFDAMGLQENLLRGIYAYGFEKPSAIQQRGIVPFCKGLDVIQQAQSGTGKTATFCSGILQQLDYSLTQCQALVLAPTRELAQQIEKVMRALGDYQGVKVHACVGGTSVREDQRILSSGVHVVVGTPGRVFDMLRRQSLQPDHIKMFVLDEADEMLSRGFKDQIYDIFQLLPSKIQVGVFSATMPPEALEITRKFMNKPVRILVKRDELTLEGIKQFYVNVEKEEWKLDTLCDLYETLAITQSVIFVNTRRKVDWLTDKMRSRDHTVSATHGDMDQNTRDIIMREFRSGSSRVLITTDLLARGIDVQQVSLVINFDLPTQPENYLHRIGRSGRFGRKGVAINFVTKDDEKMLFDIQKFYNVQVEELPSNVAELL

SEQ ID NO: 8086 - protein, 413 aa, Glycine max
MAGIAPEGSQFDARQYDTKMNELLTSDGQDFFTSYDEVYDSFDAMGLQENLLRGIYAYGFEKPSAIQQRGIVPFCKGLDVIQQAQSGTGKTATFCSGILQQLDYSVTECQALVLAPTRELAQQIEKVMRALGDYLGVKVHACVGGTSVREDQRILSSGVHVVVGTPGRVFDMLRRQSLRPDYIKMFVLDEADEMLSRGFKDQIYDIFQLLPSKIQVGVFSATMPPEALEITRKFMNKPVRILVKRDELTLEGIKQFHVNVEKEEWKLDTLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTKDDEKMLFDIQKFYNVVIEELPSNVAELL

SEQ ID NO: 8087 - protein, 413 aa, Fragaria vesca
MAGAAPEGSQFDTRQYDAKMTELLGSDGQDFFTSYDEVHDSFDVMGLQENLLRGIYAYGFEKPSAIQQRGIVPFCKGLDVIQQAQSGTGKTATFCSGILQQLDYAMLDCQALVLAPTRELAQQIEKVMRALGDYLGVKVHACVGGTSVREDQRVLSSGVHVVVGTPGRVFDMLRRQSLRPDCIRMFVLDEADEMLSRGFKDQIYDIFQLLPPKIQVGVFSATMPPEALDITRKFMNKPVRILVKRDELTLEGIKQFHVNVDKEEWKLETLCDLYETLAITQSVIFVNTRRKVDWLTDKMRSRDHTVSATHGDMEQNTRDIIMREFRSGSSRVLITTDLLARGIDVQQVSLVINYDLPTQPENYLHRIGRSGRFGRKGVAINFVTKDDERMLFDIQKFYNVVIEELPANVADLL

SEQ ID NO: 8088 - protein, 413 aa, Manihot esculenta
MAGLAPEGSQFDAKHYDAKMNELLTTEGEDFFTSYDEVYDSFDSMGLQENLLRGIYAYGFEKPSAIQQRGIVPFCNGLDVIQQAQSGTGKTATFCSGILQQLDYGLVECQALVLAPTRELAQQIEKVMRALGDYLGVKVHACVGGTVVRESQRILSSGVHVVVGTPGRVFDMLQRQSLRPDCIKMFVLDEADEMLSRGFKDQIYDIFQLLPSKIQVGVFSATMPPEALEITRKFMNKPVRILVKRDELTLEGIKQFHVNVEKEEWKLETLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRGGRFGRKGVAINFVTRDDERMLFDIQRFYNVVIEELPSNVADLL

SEQ ID NO: 8089 - protein, 413 aa, Pisum sativum
MAGVAPEGSQFDAKQFDTKMNELLTTEGQDFYTFYEEVYDSFDAMGLQENLLRGIYAYGFEKPSAIQQRGIVPFCKGLDVIQQAQSGTGKTATFCSGILQQLDYSVTECQALVLAPTRELAQQIEKVMRALGDYLGVKVHACVGGTSVREDQRILSSGVHVVVGTPGRVFDMLRRQSLRPDYIKMFVLDEADEMLSRGFKDQIYDIFQLLPSKIQVGVFSATMPPEALEITRKFMNKPVRILVKRDELTLEGIKQFYVNVDKEEWKLDTLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTKDDERMLGDIQKFYNVLIEELPSNVAELL

SEQ ID NO: 8090 - protein, 409 aa, Artemisia annua
APESSQFDTRQFDSKMNELLSTDGQDFFTSYDEVYDSFDAMGLQENLLRGIYAYGFEKPSAIQQRGIVPFTKGLDVIQQAQSGTGKTATFCSGILQQLDYSVVECQALVLAPTRELAQQIEKVMRALGDYLGVKVHACVGGTSVREDQRILSAGVHVVVGTPGRVFDMLRRQSLRSDYIKMFVLDEADEMLSRGFKDQIYDIFQLLPSKVQVGVFSATMPPEALEITRKFMNKPVRILVKRDELTLEGIKQFYVNVEKEEWKLETLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTLDDERMLADIQKFYNVVVEELPSNVADLI

SEQ ID NO: 8091 - protein, 413 aa, Artemisia annua
MAGVAPEGSQFDARQYDSKMSDLLSADGQDFFTSYDESYDTFDSMGLQENLLRGIYAYGFEKPSAIQQRGIVPFTKGLDVIQQAQSGTGKTATFCSGILQQLDYNVVECQALVLAPTRELAQQIEKVMRALGDYLGVKVHACVGGTSVREDQRILSAGVHVVVGTPGRVFDMLRRQSLRSDYIKMFVLDEADEMLSRGFKDQIYDIFQLLPSKVQVGVFSATMPPEALEITRKFMNKPVRILVKRDELTLEGIKQFYVNVEKEEWKLETLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTLDDEKMLGDIQKFYNVVVEELPSNVADLI

SEQ ID NO: 8092 - protein, 413 aa, Phaseolus coccineus
MAGLAPEGSNFDTRHFDSKMSDLLSSDGQDFFTSYDEVFESFDAMGLQENLLRGIYAYGFEKPSAIQQRGIVPFCKGLDVIQQAQSGTGKTATFCSGILQQLDYSLTQCQALVLAPTRELAQQIEKVMRALGDYLGVKVHACVGGTSVREDQRILSSGVHVVVGTPGRVFDMLRRQSLQPDNIKMFVLDEADEMLSRGFKDQIYDIFQLLPSKIQVGVFSATMPPEALEITRKFMNKPVRILVKRDELTLEGIKQFYVNVDKEEWKLDTLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTKDDDKMLFDIQKFYNVVVEELPSNVAELL

SEQ ID NO: 8093 - protein, 413 aa, Zingiber officinale
MAGQAPEGSQFDARQYDTKMNELLNADGQDFFTSYDEVYESFDDMGLQENLLRGIYAYGFEKPSAIQQRGIVPFCKGLDVIQQAQSGTGKTATFCSGILQQLDYGLVQCQALVLAPTRELAQQIEKVMRALGDYLGVKVHACVGGTSVREDQRILSSGVHVVVGTPGRVFDMLRRQSLRPDYIKMFVLDEADEMLSRGFKDQIYDIFQLLPSKIQVGVFSATMPPEALEITRKFMNKPVRILVKRDELTLEGIKQFYVNIEQEDWKLDTLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVVRDDERMLYDIQKFYNVVIEELPSNVADLI

SEQ ID NO: 8094 - protein, 413 aa, Prunus persica
MAAVAPEGSQFDARQYDAKMSELLGADGQEFFTSYDEVHESFDAMGLQENLLRGIYAYGFEKPSAIQQRGIVPFCKGLDVIQQAQSGTGKTATFCSGILQQLDYALPDCQALVLAPTRELAQQIEKVMRALGDYLGVKVHACVGGTSVREDQRILSSGVHVVVGTPGRVFDMLRRQSLRPDYIKMFVLDEADEMLSRGFKDQIYDIFQLLPSKIQVGVFSATMPPEALDITRKFMNKPVRILVKRDELTLEGIKQFHVNVDKEEWKLETLCDLYETLAITHSVIFVNTRRKVDWLTDKMRSRDHTVSATHGDMDQNTRDIIMREFRSGSSRVLITTDLLARGIDVQQVSLVINFDLPTQPENYLHRIGRSGRFGRKGVAINFVTKDDDRMLFDIQKFYNVVIEELPANVADLL

SEQ ID NO: 8095 - protein, 413 aa, Glycine max
MAGLAPEGSQFDARQYDSKMSDLLSSDGQDFFTSYDEVYDSFDAMGLQENLLRGIYAYGFEKPSAIQQRGIVPFCKGLDVIQQAQSGTGKTATFCSGILQQLDYSLTQCQALVLAPTRELAQQIEKVMRALGDYLGVKVHACVGGTSVREDQRILSSGVHVVVGTPGRVFDMLRRQSLLPDHIKMFVLDEADEMLSRGFKDQIYDIFQLLPSKIQVGVFSATMPPEALEITRKFMNKPVRILVKRDELTLEGIKQFYVNVEREDWKLDTLCDLYETLAITQSVIFVNTRRKVDWLTDKMRSRDHTVSATHGDMDQNTRDIIMREFRSGSSRVLITTDLLARGIDVQQVSLVINFDLPTQPENYLHRIGRSGRFGRKGVAINFVTKDDEKMLFDIQKFYNVQVEELPSNVAELL

SEQ ID NO: 8096 - protein, 413 aa, Glycine max
MAGLAPEGSQFDARQYDAKMNELLGTDGQDFFTSYDEVCESFDAMGLQENLLRGIYAYGFEKPSAIQQRGIVPFCKGLDVIQQAQSGTGKTATFCSGVLQQLDYSLVECQALVLAPTRELAQQIEKVMRALGDYLGVKVHACVGGTSVREDQRILSSGVHVVVGTPGRVFDMLRRQSLRSDNIRMFVLDEADEMLSRGFKDQIYDIFQLLPPKIQVGVFSATMPPEALEITRKFMNKPVRILVKRDELTLEGIKQFFVNVDKEDWKLETLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTGDDERMLFDIQKFYNVQIEELPANVADLI

SEQ ID NO: 8097 - protein, 410 aa, Solanum lycopersicum
MAAEGSQFDARQFDAKMTELLGTEQQEFFTSYDEVHDSFDAMGLQENLLRGIYAYGFEKPSAIQQRGIVPFCKGLDVIQQAQSGTGKTATFCSGILQQLDYSLVECQALVLAPTRELAQQIEKVMRALGDYLGVKVHACVGGTSVREDQRILQSGVHVVVGTPGRVFDMLRRQSLRPDHIKMFVLDEADEMLSRGFKDQIYDIFQLLPPKIQVGVFSATMPPEALEITRKFMNKPVRILVKRDELTLEGIKQFYVNVDKEEWKLETLCDLYETLAITQSVIFVNTRRKVDWLTDKMRGRDHTVSATHGDMDQNTRDIIMREFRSGSSRVLITTDLLARGIDVQQVSLVINYDLPTQPENYLHRIGRSGRFGRKGVAINFVTKDDERMLFDIQKFYNVVIEELPANVADLL

SEQ ID NO: 8098 - protein, 412 aa, Jatropha curcas
MAGLAPEGSQFDAKQYDAKMNELLSSDGQDFFTTYDEVYDSFDAMGLQENLLRGIYAYGFEKPSAIQQRGIVPFCKGLDVIQQAQSGTGKTATFCSGILQQLDYATVQCQALVLAPTRELAQQIEKVMRALGDYLGVRFCLRGGTSVREDQRILQAGVHVVVGTPGRVFDMLRRQSLRPDYIKMFVLDEADEMLSRGFKDQIYDIFQLLPAKVQVGVFSATMPPEALEITRKFMNKPVRILVKRDELTLEGIKQFYVNVEKEEWKLETLCDLYETLAITQSVIFVNTRRKVDWLTDKMRGRDHTVSATHGDMDQNTRDIIMREFRSGSSRVLITTDLLARGIDVQQVSLVINYDLPTQPENYLHRIGRGGRFGRKGVAINFVTRDDERMLFDIQKFYNVVIEELPSNVADLL

SEQ ID NO: 8099 - protein, 413 aa, Vigna unguiculata
MAGLAPEGSQFDANKYDSKMSDLLSSDGQDFFTSYDEVYESFDAMGLQENLLRGIYAYGFEKPSAIQQRGIVPFCKGLDVIQQAQSGTGKTATFCSGILEQLDYSLTQCQALVLAPTRELAQQIEKVMRALGDYLGVKVHACVGGTSVREDQRILSSGVHVVVGTPGRVFDMLRRQSLQPDHIKMFVLDEADEMLSRGFKDQIYDIFQLLPSKIQVGVFSATMPPEALEITRKFMNKPVRILVKRDELTLEGIKQFYVNVEKEEWKLDTLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTKDDDKMLFDIQKFYNVVVEELPSNVAELL

SEQ ID NO: 8100 - protein, 413 aa, Vigna unguiculata
MAGLAPEGTQFDTRHYDTKMNELLSADGEEFFTSYDEVYDSFDAMGLQENLLRGIYAYGFERPSAIQQRGIVPFCKGLDVIQQAQSGTGKTATFCSGILQQLDYGLVQCQALVLAPTRELAQQIEKVMRALGDYLGVKVHACVGGTSVREDQRILQAGVHTVVGTPGRVFDMLRRQSLRPDHIKMFVLDEADEMLSRGFKDQIYDIFQLLPGQIQVGVFSATMPPEALEITRKFMNRPVRILVKRDELTLEGIKQFYVNVDKEEWKLETLCDLYETLAITQSVIFVNTRRKVDWLTDKMRSNDHTVSATHGDMDQNTRDIIMREFRSGSSRVLITTDLLARGIDVQQVSLVINYDLPTQPENYLHRIGRSGRFGRKGVAINFVTLEDARMLSDIQKFYNVTVEELPSNVADLL

SEQ ID NO: 8101 - protein, 413 aa, Lotus japonicus
MAGLAPEGSQFDAKHYDTKMSELLTTEGQDFFTSYDEVYESFDAMGLQENLLRGIYAYGFEKPSAIQQRGIVPFCKGLDVIQQAQSGTGKTATFCSGILQQLDYSLTECQALVLAPTRELAQQIEKVMRALGDYLGVKVHACVGGTSVREDQRILSSGVHVVVGTPGRVFDMLRRQSLRPDNIKMFVLDEADEMLSRGFKDQIYDIFQLLPSKIQVGVFSATMPPEALEITRKFMNKPVRILVKRDELTLEGIKQFYVNVEREEWKLDTLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTKDDERMLFDIQKFYNVVVEELPSNIAELL

SEQ ID NO: 8102 - protein, 413 aa, Quercus alba
MAGAAPEGSQFDARQFDAKMNELLSTDGQEFFTSYDEVYESFDSMRLHENLLRGIYAYGFEKPSAIQQRGIVPFCKGLDVIQQAQSGTGKTATFCSGILQQLDYELVQCQALVLAPTRELAQQIEKVMRALGDYLNVKVHACVGGTSVREDQRILQAGVHVVVGTPGRVFDMLRRQSLRPDYIKMFVLDEADEMLSRGFKDQIYDIFQLLPAKVQVGVFSATMPPEALEITRKFMNKPVRILVKRDELTLEGIKQFYVNVEKEEWKLETLCDLYETLAITQSVIFVNTRRKVDWLTDKMRGRDHTVSATHGDMDQNTRDIIMREFRSGSSRVLITTDLLARGIDVQQVSLVINFDLPTQPENYLHRIGRSGRFGRKGVAINFVTKDDERMLFDIQKFYNVQVEELPSNIADLL

SEQ ID NO: 8103 - protein, 410 aa, Solanum tuberosum
MAAEGSQFDARQFDAKMTELLGTEQQEFFTSYDEVHDSFDAMGLQENLLRGIYAYGFEKPSAIQQRGIVPFCKGLDVIQQAQSGTGKTATFCSGILQQLDYSLVECQALVLAPTRELAQQIEKVMRALGDYLGVKVHACVGGTSVREDQRILQSGVHVVVGTPGRVFDMLRRQSLRPDHIKMFVLDEADEMLSRGFKDQIYDIFQLLPPKIQVGVFSATMPPEALEITRKFMNKPVRILVKRDELTLEGIKQFYVNVDKEEWKLETLCDLYETLAITQSVIFVNTRRKVDWLTDKMRGRDHTVSATHGDMDQNTRDIIMREFRSGSSRVLITTDLLARGIDVQQVSLVINYDLPTQPENYLHRIGRSGRFGRKGVAINFVTKDDERMLFDIQKFYNVVVEELPANVADLL

SEQ ID NO: 8104 - protein, 413 aa, Nicotiana tabacum
MAGLAPEGSQFDARQYDAKMTELLGTEQEEFFTSYDEVYDSFDAMGLQENLLRGIYAYGFEKPSAIQQRGIVPFCKGLDVIQQAQSGTGKTATFCSGVLQQLDYSLVECQALVLAPTRELAQQIEKVMRALGDYLGVKVHACVGGTSVREDQRILQSGVHVVVGTPGRVFDMLRRQSLRPDHIKMFVLDEADEMLSRGFKDQIYDIFQLLPPKIQVGVFSATMPPEALEITRKFMNKPVRILVKRDDVTLEGIKQFYVNVDKEEWKLETLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVIKDDERMLSDIQRFYNVVIEELPANVADLL

SEQ ID NO: 8105 - protein, 412 aa, Brassica napus
MAGSAPEGTQFDARQFDQKLNEVLEGQDEFFTSYDESHDSFDAMGLQENLLRGIYAYGFEKPSAIQQRGIVPFCKGLDVIQQAQSGTGKTATFCSGVLQQLDYSLVQCQALVLAPTRELAQQIEKVMRALGDYLGVKVHACVGGTSVREDQRILQAGVHVVVGTPGRVFDMLKRQSLRADYIKMFVLDEADEMLSRGFKDQIYDIFQLLPPKIQVGVFSATMPPEALEITRKFMSKPVRILVKRDELTLEGIKQFYVNVEKEEWKLETLCDLYETLAITQSVIFVNTRRKVDWLTDKMRGRDHTVSATHGDMDQNTRDIIMREFRSGSSRVLITTDLLARGIDVQQVSLVINYDLPTQPENYLHRIGRSGRFGRKGVAINFVTKDDERMLFDIQKFYNVVVEELPSNVADLL

SEQ ID NO: 8106 - protein, 412 aa, Arabidopsis lyrata
MAGSAAEGTQFDTRQFDQKLNEVLEGQDEFFTSYDEVHESFDAMGLQENLLRGIYAYGFEKPSAIQQRGIVPFCKGLDVIQQAQSGTGKTATFCSGVLQQLDYTLVQCQALVLAPTRELAQQIEKVMRALGDYQGVKVHACVGGTSVREDQRILQAGVHVVVGTPGRVFDMLRRQSLRPDCIKMFVLDEADEMLSRGFKDQIYDIFQLLPPKIQVGVFSATMPPEALEITRKFMSKPVRILVKRDELTLEGIKQFYVNVEKEEWKLETLCDLYETLAITQSVIFVNTRRKVDWLTDKMRSRDHTVSATHGDMDQNTRDIIMREFRSGSSRVLITTDLLARGIDVQQVSLVINFDLPTQPENYLHRIGRSGRFGRKGVAINFITRDDERMLFDIQKFYNVVVEELPSNVADLL

SEQ ID NO: 8107 - protein, 412 aa, Arabidopsis lyrata
MAGSAPEGTQFDARQFDQKLNEVLEGQDEFFTSYDEVHESFDAMGLQENLLRGIYAYGFEKPSAIQQRGIVPFCKGLDVIQQAQSGTGKTATFCSGVLQQLDFSLVQCQALVLAPTRELAQQIEKVMRALGDYLGVKVHACVGGTSVREDQRILQAGVHVVVGTPGRVFDMLKRQSLRADNIKMFVLDEADEMLSRGFKDQIYDIFQLLPPKIQVGVFSATMPPEALEITRKFMSKPVRILVKRDELTLEGIKQFYVNVEKEEWKLETLCDLYETLAITQSVIFVNTRRKVDWLTDKMRSRDHTVSATHGDMDQNTRDIIMREFRSGSSRVLITTDLLARGIDVQQVSLVINFDLPTQPENYLHRIGRSGRFGRKGVAINFVTHDDERMLFDIQKFYNVVVEELPSNVADLL

SEQ ID NO: 8108 - protein, 413 aa, Mimulus guttatus
MADKVPEGSNFDARQFDAKMDEILGAEGEEFFTSYDEVYDSFDAMGLQENLLRGIYAYGFEKPSAIQQRGIVPFCKGLDVIQQAQSGTGKTATFCSGVLQQLDYTLVECQALVLAPTRELAQQIEKVMRALGDYLGVKVHACVGGTSVREDQRILSSGVHVVVGTPGRVFDMLRRQSLRSDYIKMFVLDEADEMLSRGFKDQIYDIFQLLPPKIQVGVFSATMPPEALEITRKFMAKPVRILVKRDELTLEGIKQFYVNVDKEDWKLETLCDLYETLAITQSVIFVNTRRKVDWLTDKMRGRDHTVSATHGDMDQNTRDIIMREFRSGSSRVLITTDLLARGIDVQQVSLVINYDLPTQPENYLHRIGRSGRFGRKGVAINFVTKDDERMLFDIQKFYNVVVEELPANVADLL

SEQ ID NO: 8109 - protein, 414 aa, Avena sativa
MAGMAPEGSQFDAKNYDSKMQELLSQGETEDFFTSYDEVHESFDDMGLQENLLRGIYAYGFEKPSAIQQRGIVPFCKGLDVIQQAQSGTGKTATFCSGILQQLDYGLVECQALVLAPTRELAQQIEKVMRALGDYLGVKVHACVGGTSVREDQRILASGVHVVVGTPGRVFDMLRRQSLRPDNIKMFVLDEADEMLSRGFKDQIYDIFQLLPGKIQVGVFSATMPPEALEITRKFMNKPVRILVKRDELTLEGIKQFYVNVEKEEWKLDTLCDLYETLAITQSVIFVNTRRKVDWLTDKMRGRDHTVSATHGDMDQNTRDIIMREFRSGSSRVLITTDLLARGIDVQQVSLVINYDLPTQPENYLHRIGRSGRFGRKGVAINFVTREDERMLFDIQKFYNVVIEELPANVADLL

SEQ ID NO: 8110 - protein, 412 aa, Arabidopsis thaliana
MAGSAPEGTQFDARQFDQKLNEVLEGQDEFFTSYDDVHESFDAMGLQENLLRGIYAYGFEKPSAIQQRGIVPFCKGLDVIQQAQSGTGKTATFCSGVLQQLDFSLIQCQALVLAPTRELAQQIEKVMRALGDYLGVKVHACVGGTSVREDQRILQAGVHVVVGTPGRVFDMLKRQSLRADNIKMFVLDEADEMLSRGFKDQIYDIFQLLPPKIQVGVFSATMPPEALEITRKFMSKPVRILVKRDELTLEGIKQFYVNVEKEEWKLETLCDLYETLAITQSVIFVNTRRKVDWLTDKMRSRDHTVSATHGDMDQNTRDIIMREFRSGSSRVLITTDLLARGIDVQQVSLVINFDLPTQPENYLHRIGRSGRFGRKGVAINFVTRDDERMLFDIQKFYNVVVEELPSNVADLL

SEQ ID NO: 8111 - protein, 412 aa, Brassica napus
MAGSAPEGTQFDARQFDQKLNEVLEGQDEFFTSYDESHDSFDAMGLQENLLRGIYAYGFEKPSAIQQRGIVPFCKGLDVIQQAQSGTGKTATFCSGVLQQLDYSLVQCQALVLAPTRELAQQIEKVMRALGDYLGVKVHACVGGTSVREDQRILQAGVHVVVGTPGRVFDMLKRQSLRADHIKMFVLDEADEMLSRGFKDQIYDIFQLLPPKIQVGVFSATMPPEALEITRKFMSKPVRILVKRDELTLEGIKQFYVNVEKEDWKLETLCDLYETLAITQSVIFVNTRRKVDWLTDKMRGRDHTVSATHGDMDQNTRDIIMREFRSGSSRVLITTDLLARGIDVQQVSLVINYDLPTQPENYLHRIGRSGRFGRKGVAINFVTKDDERMLFDIQKFYNVVVEELPSNVADLL

SEQ ID NO: 8112 - protein, 414 aa, Cenchrus ciliaris
MAGMAPEGSQFDAKHYDSKMQELLSTGETEEFFTSYDEVFESFDDMGLQENLLRGIYAYGFEKPSAIQQRGIVPFCKGLDVIQQAQSGTGKTATFCSGILQQLDYGLVECQALVLAPTRELAQQIEKVMRALGDYLGVKVHACVGGTSVREDQRILASGVHVVVGTPGRVFDMLRRQSLRPDHIKMFVLDEADEMLSRGFKDQIYDIFQLLPAKIQVGVFSATMPPEALEITRKFMNKPVRILVKRDELTLEGIKQFYVNVEKEDWKLDTLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTRDDERMLFDIQKFYNVVIEELPANVADLL

SEQ ID NO: 8113 - protein, 414 aa, Castanea mollissima
MAGAAPEGSQFDARQFDAKMNELLSTDGQEEFFTSYDEVYESFDSMKLHENLLRGIYAYGFEKPSAIQQRGIVPFCKGLDVIQQAQSGTGKTATFCSGILQQLDYELVQCQALVLAPTRELAQQIEKVMRALGDYLNVKVHACVGGTSVREDQRILQAGVHVVVGTPGRVFDMLRRQSLRPDYIKMFVLDEADEMLSRGFKDQIYDIFQLLPAKVQVGVFSATMPPEALEITRKFMNKPVRILVKRDELTLEGIKQFYVNVEKEEWKLETLCDLYETLAITQSVIFVNTRRKVDWLTDKMRGRDHTVSATHGDMDQNTRDIIMREFRSGSSRVLITTDLLARGIDVQQVSLVINFDLPTQPENYLHRIGRSGRFGRKGVAINFVTKDDERMLFDIQKFYNVQVEELPSNIADLL

SEQ ID NO: 8114 - protein, 414 aa, Actinidia deliciosa
MAGLAPEGSQFDTRQYDTKMTELLGTTDGEEFFTSYDEVYESFDAMGLQENLLRGIYAYGFEKPSAIQQRGIVPFCKGLDVIQQAQSGTGKTATFCSGVLQQLDYSLVECQALVLAPTRELAQQIEKVMRALGDYLGVKVHACVGGTSVREDQRILSSGVHVVVGTPGRVFDMLRRQSLRPDYIKMFVLDEADEMLSRGFKDQIYDIFQLLPPKIQVGVFSATMPPEALEITRKFMNKPVRILVKRDELTLEGIKQFYVNVDKEEWKLETLCDLYETLAITQSVIFINTRRKVDWLTDKMRSRDHTVSATHGDMDQNTRDIIMREFRSGSSRVLITTDLLARGIDVQQVSLVINFDLPTQPENYLHRIGRSGRFGRKGVAINFVTKDDERMLFDIQKFYNVVVEELPANVADLL

SEQ ID NO: 8115 - protein, 414 aa, Zea mays
MAGMAPEGSQFDAKHYDSKMQELLSTGETEEFFTSYDEVFESFDDMGLQENLLRGIYAYGFEKPSAIQQRGIVPFCKGLDVIQQAQSGTGKTATFCSGILQQLDYGLVECQALVLAPTRELAQQIEKVMRALGDYLGVKVHACVGGTSVREDQRILASGVHVVVGTPGRVFDMLRRQSLRPDNIKMFVLDEADEMLSRGFKDQIYDIFQLLPSKIQVGVFSATMPPEALEITRKFMNKPVRILVKRDELTLEGIKQFYVNVDKEDWKLDTLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTRDDERMLFDIQKFYNVLIEELPANVADLL

SEQ ID NO: 8116 - protein, 413 aa, Medicago truncatula
MAGLAPEGSQFDTKQFDTKMNELLSTEGQEFFTSYDEVHETFDAMGLLENLLRGIYAYGFEKPSAIQQRGIVPFIKGLDVIQQAQSGTGKTATFCSGILQQLDYGLVQCQALVLAPTRELAQQIEKVMRALGDYLGVKVHACVGGTSVREDQRILQTGVHVVVGTPGRVFDMLRRQSLRSDCIKMFVLDEADEMLSRGFKDQIYDIFQLLPPKIQVGVFSATMPPEALEITRKFMNKPVRILVKRDELTLEGIKQFYVNVDKEEWKLETLCDLYETLAITQSVIFVNTRRKVDWLTDKMRGRDHTVSATHGDMDQNTRDIIMREFRSGSSRVLITTDLLARGIDVQQVSLVINYDLPTQPENYLHRIGRSGRFGRKGVAINFVTLEDARMLADIQKFYNVIVEELPSNVADLL

SEQ ID NO: 8117 - protein, 410 aa, Capsicum annuum
MAAEGSQFDARQFDAKMTELLGTEQQEFFTSYDEVHESFDAMGLQENLLRGIYAYGFEKPSAIQQRGIVPFCKGLDVIQQAQSGTGKTATFCSGILQQLDYSLVECQALVLAPTRELAQQIEKVMRALGDYLGVKVHACVGGTSVREDQRILQSGVHVVVGTPGRVFDMLRRQSLRPDHIKMFVLDEADEMLSRGFKDQIYDIFQLLPPKIQVGVFSATMPPEALEITRKFMNKPVRILVKRDELTLEGIKQFYVNVDKEEWKLETLCDLYETLAITQSVIFVNTRRKVDWLTDKMRGRDHTVSATHGDMDQNTRDIIMREFRSGSSRVLITTDLLARGIDVQQVSLVINYDLPTQPENYLHRIGRSGRFGRKGVAINFVTKDDERMLFDIQRFYNVVIEELPANVADLL

SEQ ID NO: 8118 - protein, 414 aa, Sorghum bicolor
MAGMAPEGSQFDAKHYDSKMQELLSTGETEEFFTSYDEVFESFDDMGLQENLLRGIYAYGFEKPSAIQQRGIVPFCKGLDVIQQAQSGTGKTATFCSGILQQLDYGLVECQALVLAPTRELAQQIEKVMRALGDYLGVKVHACVGGTSVREDQRILASGVHVVVGTPGRVFDMLRRQSLRPDNIKMFVLDEADEMLSRGFKDQIYDIFQLLPAKIQVGVFSATMPPEALEITRKFMNKPVRILVKRDELTLEGIKQFYVNVEKEDWKLDTLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTRDDERMLFDIQKFYNVVIEELPANVADLL

SEQ ID NO: 8119 - protein, 414 aa, Saccharum officinarum
MAGMAPEGSQFDAKHFDSKMQELLSTGETEEFFTSYDEVFESFDDMGLQENLLRGIYAYGFEKPSAIQQRGIVPFCKGLDVIQQAQSGTGKTATFCSGILQQLDYGLVECQALVLAPTRELAQQIEKVMRALGDYLGVKVHACVGGTSVREDQRILASGVHVVVGTPGRVFDMLRRQSLRPDNIKMFVLDEADEMLSRGFKDQIYDIFQLLPAKIQVGVFSATMPPEALEITRKFMNKPVRILVKRDELTLEGIKQFYVNVEKEDWKLDTLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTRDDERMLFDIQRFYNVVIEELPANVADLL

SEQ ID NO: 8120 - protein, 410 aa, Panicum virgatum
MAGLAPEGSQFDAKQYDNKMQELLTEDFFTSYDEVCESFDNMGLQENLLRGIYAYGFEKPSAIQQRGIVPFCKGLDVIQQAQSGTGKTATFCSGILQQLDYGLVECQALVLAPTRELAQQIEKVMRALGDYLGVKVHACVGGTSVREDQRILASGVHVVVGTPGRVFDMLRRQSLRPDNIKMFVLDEADEMLSRGFKDQIYDIFQLLPSKIQVGVFSATMPPEALEITRKFMNKPVRILVKRDELTLEGIKQFYVNVEKEDWKLDTLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTRDDERMLFDIQRFYNVTIEELPANVADLL

SEQ ID NO: 8121 - protein, 414 aa, Avena sativa
MAGMAPEGSQFDAKHYDSKMSELLNQGDTEDFFTSYDEVHESFDDMGLQENLLRGIYAYGFEKPSAIQQRGIVPFCKGLDVIQQAQSGTGKTATFCSGILQQLDYGLVECQALVLAPTRELAQQIEKVMRALGDYLGVKVHACVGGTSVREDQRILASGVHVVVGTPGRVFDMLRRQSLRPDQIKMFVLDEADEMLSRGFKDQIYDIFQLLPGKIQVGVFSATMPPEALEITRKFMNKPVRILVKRDELTLEGIKQFYVNVEKEEWKLDTLCDLYETLAITQSVIFVNTRRKVDWLTDKMRGRDHTVSATHGDMDQNTRDIIMREFRSGSSRVLITTDLLARGIDVQQVSLVINYDLPTQPENYLHRIGRSGRFGRKGVAINFVTREDERMLFDIQKFYNVVIEELPANVADLL

SEQ ID NO: 8122 - protein, 412 aa, Brassica oleracea
MAGSAPEGTQFDARQFDQKLNEVLEGQDEFFTSYDEVHDSFDVMGLQENLLRGIYAYGFEKPSAIQQRGIVPFCKGLDVIQQAQSGTGKTATFCSGVLQQLDFAIVQCQALVLAPTRELAQQIEKVMRALGDYLGVKVHACVGGTSVREDQRILQAGVHVVVGTPGRVFDMLKRQSLRADNIKMFVLDEADEMLSRGFKDQIYDIFQLLPPKIQVGVFSATMPPEALEITRKFMSKPVRILVKRDELTLEGIKQFYVNVEKEEWKLETLCDLYETLAITQSVIFVNTRRKVDWLTDKMRGRDHTVSATHGDMDQNTRDIIMREFRSGSSRVLITTDLLARGIDVQQVSLVINYDLPTQPENYLHRIGRSGRFGRKGVAINFVTKDDERMLFDIQKFYNVVVEELPSNVADLL

SEQ ID NO: 8123 - protein, 412 aa, Unknown
  Sequence found in Organisms: Brassica napus, Brassica oleracea, Brassica rapa
MAGSAPEGTQFDTRQFDQRLNEVLEGQDEFFTSYDEVHESFDAMGLQENLLRGIYAYGFEKPSAIQQRGIVPFCKGLDVIQQAQSGTGKTATFCSGVLQQLDFSLVQCQALVLAPTRELAQQIEKVMRALGDYLGVKVHACVGGTSVREDQRILQAGVHVVVGTPGRVFDMLRRQSLRSDSIKMFVLDEADEMLSRGFKDQIYDIFQLLPPKIQVGVFSATMPPEALEITRKFMSKPVRILVKRDELTLEGIKQFYVNVEKEEWKLETLCDLYETLAITQSVIFVNTRRKVDWLTDKMRSRDHTVSATHGDMDQNTRDIIMREFRSGSSRVLITTDLLARGIDVQQVSLVINFDLPTQPENYLHRIGRSGRFGRKGVAINFVTKDDERMLFDIQKFYNVVVEELPSNVADLL

SEQ ID NO: 8124 - protein, 414 aa, Unknown
  Sequence found in Organisms: Hordeum vulgare, Triticum aestivum
MAGMAPEGSQFDAKNYDSKMQELLSQGETEEFFTSYDEVHESFDDMGLQENLLRGIYAYGFEKPSAIQQRGIVPFCKGLDVIQQAQSGTGKTATFCSGILQQLDYGLVECQALVLAPTRELAQQIEKVMRALGDYLGVKVHACVGGTSVREDQRILASGVHVVVGTPGRVFDMLRRQSLRPDNIKMFVLDEADEMLSRGFKDQIYDIFQLLPGKIQVGVFSATMPPEALEITRKFMNKPVRILVKRDELTLEGIKQFYVNVEKEEWKLDTLCDLYETLAITQSVIFVNTRRKVDWLTDKMRGRDHTVSATHGDMDQNTRDIIMREFRSGSSRVLITTDLLARGIDVQQVSLVINYDLPTQPENYLHRIGRSGRFGRKGVAINFVTREDERMLFDIQKFYNVVIEELPANVADLL

SEQ ID NO: 8125 - protein, 413 aa, Phaseolus coccineus
MAGLAPEGSQFDGRHYDSKMNELLTTDAQDFFTSYDEVFESFDAMGLQENLLRGIYAYGFEKPSAIQQRGIVPFCKGLDVIQQAQSGTGKTATFCSGILQQLDYNVTECQALVLAPTRELAQQIEKVMRALGDYLGVKVHACVGGTSVREDQRILSSGVHVVVGTPGRVFDMLRRQSLRPDYIKMFVLDEADEMLSRGFKDQIYDIFQLLPSKIQVGVFSATMPPEALEITRKFMNKPVRILVKRDELTLEGIKQFYVNVEKEEWKLDTLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTKDDDKMLFDIQKFYNVVVEELPSNVAELL

SEQ ID NO: 8126 - protein, 414 aa, Brachypodium distachyon
MAGMAPEGSQFDAKNYDSKMQELLSQGETEEFFTSYDEVHESFDDMGLQENLLRGIYAYGFEKPSAIQQRGIVPFCKGLDVIQQAQSGTGKTATFCSGILQQLDYGLVECQALVLAPTRELAQQIEKVMRALGDYLGVKVHACVGGTSVREDQRILASGVHVVVGTPGRVFDMLRRQSLRPDHIKMFVLDEADEMLSRGFKDQIYDIFQLLPGKIQVGVFSATMPPEALEITRKFMNKPVRILVKRDELTLEGIKQFYVNVEKEEWKLDTLCDLYETLAITQSVIFVNTRRKVDWLTDKMRGRDHTVSATHGDMDQNTRDIIMREFRSGSSRVLITTDLLARGIDVQQVSLVINYDLPTQPENYLHRIGRSGRFGRKGVAINFVTREDERMLFDIQKFYNVVIEELPANVADLL

SEQ ID NO: 8127 - protein, 412 aa, Brassica napus
MAGSAPEGTQFDARQFDQKLNEVLEGQDEFFTSYDEVHDSFDAMGLQENLLRGIYAYGFEKPSAIQQRGIVPFCQGLDVIQQAQSGTGKTATFCSGVLQQLDFTLVQCQALVLAPTRELAQQIEKVMRALGDYLGVKVHACVGGTSVREDQRILQAGVHVVVGTPGRVFDMLKRQSLRADSIKMFVLDEADEMLSRGFKDQIYDIFQLLPPKIQVGVFSATMPPEALEITRKFMSKPVRILVKRDELTLEGIKQFYVNVEKEDWKLETLCDLYETLAITQSVIFVNTRRKVDWLTDKMRGRDHTVSATHGDMDQNTRDIIMREFRSGSSRVLITTDLLARGIDVQQVSLVINYDLPTQPENYLHRIGRSGRFGRKGVAINFVTKDDERMLFDIQKFYNVVVEELPSNVADLL

SEQ ID NO: 8128 - protein, 413 aa, Vigna unguiculata
MAGVAPEVSQFDGRHYDNKMNELLTSDGQDFFTSYDEVFESFDAMGLQENLLRGIYAYGFEKPSAIQQRGIVPFCKGLDVIQQAQSGTGKTATFCSGILQQLDYNVTECQALVLAPTRELAQQIEKVMRALGDYLGVKVHACVGGTSVREDQRILSSGVHVVVGTPGRVFDMLRRQSLRPDYIKMFVLDEADEMLSRGFKDQIYDIFQLLPTKIQVGVFSATMPPEALEITRKFMNKPVRILVKRDELTLEGIKQFYVNVDKEEWKLDTLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTKDDEKMLYDIQKFYNVVVEELPSNVAELL

SEQ ID NO: 8129 - protein, 414 aa, Actinidia deliciosa
MAGLAPEGSQFDARQYDNKMIELLGADGGEEFFTSYDEVHESFDAMGLQENLLRGIYAYGFEKPSAIQQRGIVPFCKGLDVIQQAQSGTGKTATFCSGILQQLDYGKVECQALVLAPTRELAQQIEKVMRALGDYLGVKVHACVGGTSVREDQRILSSGVHVVVGTPGRVFDMLRRQSLRPDYIKMFVLDEADEMLSRGFKDQIYDIFQLLPPNIQVGVFSATMPPEALEITRKFMNKPVRILVKRDELTLEGIKQFYVNVDKEEWKLETLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTKEDERMLSDIQRFYNVIVEELPANVADLL

SEQ ID NO: 8130 - protein, 413 aa, Lotus japonicus
MAGLAPEGSQFDAKQYDSKMTELLATDGQEFFTSYDEVYDTFDSMGLHENLLRGIYAYGFERPSAIQQRGIVPFCKGLDVIQQAQSGTGKTATFCSGILQQLNYELVQCQALVLAPTRELAQQIEKVMRALGDYLGVKVHACVGGTSVREDQRILQAGVHTVVGTPGRVFDMLRRQSLRPDSIKMFVLDEADEMLSRGFKDQIYDIFQLLPGKIQVGVFSATMPPEALEITRKFMNKPVRILVKRDELTLEGIKQFYVNVEKEEWKLETLCDLYETLAITQSVIFVNTRRKVDWLTDKMRSNDHTVSATHGDMDQNTRDIIMREFRSGSSRVLITTDLLARGIDVQQVSLVINYDLPTQPENYLHRIGRSGRFGRKGVAINFVTLDDSRMLSDIQKFYNVTVEELPSNVADLL

SEQ ID NO: 8131 - protein, 414 aa, Zea mays
MAGMAPEGSQFDAKHYDSKMQELLSTGETEEFFTSYDEVFESFDDMGLQENLLRGIYAYGFEKPSAIQQRGIVPFCKGLDVIQQAQSGTGKTATFCSGILQQLDYGLVECQALVLAPTRELAQQIEKVMRALGDYLGVKVHACVGGTSVREDQRILGSGVHVVVGTPGRVFDMLRRQSLRPDNIKMFVLDEADEMLSRGFKDQIYDIFQLLPAKIQVGVFSATMPPEALEITRKFMNKPVRILVKRDELTLEGIKQFYVNVDKEDWKLDTLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTRDDERMLFDIQKFYNVLIEELPANVADLL

SEQ ID NO: 8132 - protein, 413 aa, Glycine max
MAGSAPEGSQFDARQYDAKMNELLGTDGQDFFTSYDEVCESFDAMGLQENLLRGIYAYGFEKPSAIQQRGIVPFCKGLDVIQQAQSGTGKTATFCSGVLQQLDYSLVECQALVLAPTRELAQQIEKVMRALGDYLGVKVHVCVGGTIVREDQRILSSGVHVVVGTPGRVFDMLCRQSLRPDNIRMFVLDEADEMLSRGFKDQIYDIFQLLPPKIQVGVFSATMPPEALEITRKFMNKPVRILVKRDELTLEGIKQFFVNVDKEDWKLETLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTGDDERMLFDIQKFYNVQIEELPANVADLI

SEQ ID NO: 8133 - protein, 410 aa, Saccharum officinarum
MAGLAPEGSQFDDKQYDKKMQELLIEDFFTSYDEVCESFDNMGLQENLLRGIYAYGFEKPSAIQQRGIVPFCKGLDVIQQAQSGTGKTATFCSGILQQLDYGLVECQALVLAPTRELAQQIEKVMRALGDYLGVKVHACVGGTSVREDQRILASGVHVVVGTPGRVFDMLRRQSLRPDNIKMFVLDEADEMLSRGFKDQIYDIFQLLPSKIQVGVFSATMPPEALEITRKFMNKPVRILVKRDELTLEGIKQFYVNVEKEDWKLDTLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTRDDERMLFDIQRFYNVTIEELPANVADLL

SEQ ID NO: 8134 - protein, 410 aa, Panicum virgatum
MAGLAPEGSQFDAKQYDNKMQELLTEDFFTTYDEVVESFDNMGLQENLLRGIYAYGFEKPSAIQQRGIVPFCKGLDVIQQAQSGTGKTATFCSGILQQLDYGLVECQALVLAPTRELAQQIEKVMRALGDYLGVKVHACVGGTSVREDQRILASGVHVVVGTPGRVFDMLRRQSLRPDNIKMFVLDEADEMLSRGFKDQIYDIFQLLPSKIQVGVFSATMPPEALEITRKFMNKPVRILVKRDELTLEGIKQFYVNVEKEDWKLDTLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTRDDERMLFDIQRFYNVTIEELPANVADLL

SEQ ID NO: 8135 - protein, 412 aa, Triphysaria pusilla
MAGSAPEGSQFDARQYDAKMTEIVDGGDEFFTSYDEVYDSFDGMGLQENLLRGIYAYGFEKPSAIQQRGIVPFCKGLDVIQQAQSGTGKTATFCSGILQQLDYGLTQCQALVLAPTRELAQQIEKVMRALGDYLGVKVHACVGGTSVREDQRILSAGVHVVVGTPGRVFDMLRRQSLRSDSIKMFVLDEADEMLSRGFKDQIYDIFQLLPAKVQVGVFSATMPPEALEITRKFMNKPVRILVKRDELTLEGIKQFYVNVEKEEWKLETLCDLYETLAITQSVIFVNTRRKVDWLTDNMRTRDHTVSATHGDMDQNTRDIIMREFRSGSSRVLITTDLLARGIDVQQVSLVINFDLPTQPENYLHRIGRSGRFGRKGVAINFMTTQDEKMLQDIQKFYNVVVEELPSNVADLL

SEQ ID NO: 8136 - protein, 414 aa, Triticum aestivum
MAGMAPEGSQFDAKQYDSKMTELLNQGDTGEFFTSYDEVHESFDDMGLQENLLRGIYAYGFEKPSAIQQRGIVPFCKGLDVIQQAQSGTGKTATFCSGILQQLDYGLVECQALVLAPTRELAQQIEKVMRALGDYLGVKVHACVGGTSVREDQRILASGVHVVVGTPGRVFDMLRRQSLRPDNIKMFVLDEADEMLSRGFKDQIYDIFQLLPSKIQVGVFSATMPPEALEITRKFMNKPVRILVKRDELTLEGIKQFYVNVEKEEWKLDTLCDLYETLAITQSVIFVNTRRKVDWLTDKMRGRDHTVSATHGDMDQNTRDIIMREFRSGSSRVLITTDLLARGIDVQQVSLVINYDLPTQPENYLHRIGRSGRFGRKGVAINFVTREDERMLFDIQKFYNVVIEELPANVADLL

SEQ ID NO: 8137 - protein, 414 aa, Triticum aestivum
MAGMAPEGSQFDAKNYDSKMQELLNQGETEEFFTSYDEVHESFDDMGLQENLLRGIYAYGFEKPSAIQQRGIVPFCKGLDVIQQAQSGTGKTATFCSGILQQLDYGLVECQALVLAPTRELAQQIEKVMRALGDYLGVKVHACVGGTSVREDQRILASGVHVVVGTPGRVFDMLRRQSLRPDNIKMFVLDEADEMLSRGFKDQIYDIFQLLPGKIQVGVFSATMPPEALEITRKFMNKPVRILVKRDELTLEGIKQFYVNVEKEEWKLDTLCDLYETLAITQSVIFVNTRRKVDWLTDKMRGRDHTVSATHGDMDQNTRDIIMREFRSGSSRVLITTDLLARGIDVQQVSLVINYDLPTQPENYLHRIGRSGRFGRKGVAINFVTREDERMLFDIQKFYNVVIEELPANVADLL

SEQ ID NO: 8138 - protein, 413 aa, Orobanche aegyptiaca
MAGTAPEGSQFDASKFDARMNDLVGADAEEFFTNYDDVYDSFDAMGLQENLLRGIYAYGFEKPSAIQQRGIVPFCKGLDVIQQAQSGTGKTATFCSGILQQLDYNVVECQALVLAPTRELAQQIEKVMRALGDFLGVKVHACVGGTSVREDQRILSSGVHVVVGTPGRVFDMLKRQSLRPNYIRMFVLDEADEMLSRGFKDQIYDIFQMLPPKIQVGVFSATMPPEALEITRKFMNKPVRILVKRDELTLEGIKQFYVNVDKEEWKLETLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTKDDERMLSDIQRFYNVVVEELPANVADLL

SEQ ID NO: 8139 - protein, 412 aa, Arabidopsis thaliana
MAGSAPEGTQFDTRQFDQRLNEVLDGQDEFFTSYDEVHESFDAMGLQENLLRGIYAYGFEKPSAIQQRGIVPFCKGLDVIQQAQSGTGKTATFCSGVLQQLDYALLQCQALVLAPTRELAQQIEKVMRALGDYQGVKVHACVGGTSVREDQRILQAGVHVVVGTPGRVFDMLRRQSLRPDCIKMFVLDEADEMLSRGFKDQIYDIFQLLPPKIQVGVFSATMPPEALEITRKFMSKPVRILVKRDELTLEGIKQFYVNVEKEDWKLETLCDLYETLAITQSVIFVNTRRKVDWLTDKMRSRDHTVSATHGDMDQNTRDIIMREFRSGSSRVLITTDLLARGIDVQQVSLVINFDLPTQPENYLHRIGRSGRFGRKGVAINFVTLDDQRMLFDIQKFYNVVVEELPSNVADLL

SEQ ID NO: 8140 - protein, 414 aa, Hordeum vulgare
MAGMAPEGSQFDAKHYDSKMTELLNQGDTEEFFTSYDEVHESFDDMGLQENLLRGIYAYGFEKPSAIQQRGIVPFCKGLDVIQQAQSGTGKTATFCSGILQQLDYGLVECQALVLAPTRELAQQIEKVMRALGDYLGVKVHACVGGTSVREDQRILASGVHVVVGTPGRVFDMLRRQSLRPDNIKMFVLDEADEMLSRGFKDQIYDIFQLLPSKIQVGVFSATMPPEALEITRKFMNKPVRILVKRDELTLEGIKQFYVNVEKEEWKLDTLCDLYETLAITQSVIFVNTRRKVDWLTDKMRGRDHTVSATHGDMDQNTRDIIMREFRSGSSRVLITTDLLARGIDVQQVSLVINYDLPTQPENYLHRIGRSGRFGRKGVAINFVTREDERMLFDIQKFYNVVIEELPANVADLL

SEQ ID NO: 8141 - protein, 412 aa, Brassica napus
MAGSAPEGTQFDTRQFDQKLNEVLEGQDEFFTSYDEVHESFDAMGLQENLLRGIYAYGFEKPSAIQQRGIVPFCNGLDVIQQAQSGTGKTATFCSGVLQQLDFTLVQCQALVLAPTRELAQQIEKVMRALGDYLGVKVHACVGGTSVREDQRILQAGVHVVVGTPGRVFDMLRRQSLRADSIKMFVLDEADEMLSRGFKDQIYDIFQLLPPKIQVGVFSATMPPEALEITRKFMSKPVRILVKRDELTLEGIKQFYVNVEKEDWKLETLCDLYETLAITQSVIFVNTRRKVDWLTDKMRSRDHTVSATHGDMDQNTRDIIMREFRSGSSRVLITTDLLARGIDVQQVSLVINFDLPTQPENYLHRIGRSGRFGRKGVAINFVTKDDERMLFDIQKFYNVVVEELPSNVADLL

SEQ ID NO: 8142 - protein, 413 aa, Gossypium hirsutum
MAGVAPDGSQYDARQYDSKMNELLADDGNDFFTTYDEVYESFDKMGLQENLLRGIYAYGFEKPSAIQQKGIVPFCKGLDVIQQAQSGTGKTATFCSGILQQLDYGLVQCQALVLAPTRELAQQIEKVMRALGDYLGVKVHACVGGTSVREDQRILAAGVHVVVGTPGRVFDMLRRQSLRADYIKMFVLDEADEMLSRGFKDQIYDIFQQLPPKIQVGVFSATMPPEALEITRKFMNKPVRILVKRDELTLEGIKQFYVNVDKEEWKLDTLCDLYETLAITQSVIFVNARRKVDWLTDQMRSRDHTVSATHGEMDQNTRDIIMREFRSGSSRVLITTDLLARGIDVQQVSLVINYDLPTQPENYLHRIGRGGRFGRKGVAINFTTRDDERMLADIQRFYNVVIEELPANVADLI

SEQ ID NO: 8143 - protein, 414 aa, Pennisetum glaucum
MAGMAPEGSQFDAKHYDSKMQELLSTGETEEFFTSYDEVFESFDDMGLQENLLRGIYAYGFEKPSAIQQRGIVPFCKGLDVIQQAQSGTGKTATFCSGILQQLDYGLVECQALVLAPTRELAQQIEKVMRALGDYLGVKVHACVGGTSVREDQRILASGVHVVVGTPGRVFDMLRRQSLRPDHIKMFVLDEADEMLSRGFKDQIYDIFQLLPAKIQVGVFSATMPPEALEITRKFMNKPVRILVKRDELTLEGIKQFYVNVEKEDWKLDTLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTRDDDRMLFDIQRFYNVVIEELPANVADLL

SEQ ID NO: 8144 - protein, 414 aa, Oryza sativa
MAGMAPEGSQFDAKHYDSKMQELLHQGDNEEFFTSYDEVFESFDDMGLQENLLRGIYAYGFEKPSAIQQRGIVPFCKGLDVIQQAQSGTGKTATFCSGILQQLDYGLVECQSLVLAPTRELAQQIEKVMRALGDYLGVKVHACVGGTSVREDQRILASGVHVVVGTPGRVFDMLRRQSLRPDHIKMFVLDEADEMLSRGFKDQIYDIFQLLPPKIQVGVFSATMPPEALEITRKFMNKPVRILVKRDELTLEGIKQFYVNVEKEDWKLDTLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTRDDERMLFDIQRFYNVTIEELPANVADLL

SEQ ID NO: 8145 - protein, 410 aa, Sorghum bicolor
MAGLAPEGSQFDDKQYDKKMQEILTEDFFTSYDEVCESFDNMGLQENLLRGIYAYGFEKPSAIQQRGIVPFCKGLDVIQQAQSGTGKTATFCSGILQQLDYGLVECQALVLAPTRELAQQIEKVMRALGDYLGVKVHACVGGTSVREDQRILASGVHVVVGTPGRVFDMLRRQSLRPDNIKMFVLDEADEMLSRGFKDQIYDIFQLLPSKIQVGVFSATMPPEALEITRKFMNKPVRILVKRDELTLEGIKQFYVNVEKEDWKLDTLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTRDDERMLFDIQRFYNVTIEELPANVADLL

SEQ ID NO: 8146 - protein, 412 aa, Brassica napus
MAGSAPEGTQFDARQFDQKLNEVLEGQDEFFTSYDEVHDSFDVMGLQENLLRGIYAYGFEKPSAIQQRGIVPFCKGLDVIQQAQSGTGKTATFCSGVLQQLDFAIVQCQALVLAPTRELAQQIEKVMRALGDYLGVKVHACVGGTSVREDQRILQAGVHVVVGTPGRVFDMLKRQSLRADNIKMFVLDEADEMLSRGFKDQIYDIFQLLPPKIQVGVFSATMPPEALEITRKFMSKPVRILVKRDELTLEGIKQFYVNVEKEDWKLETLCDLYETLAITQSVIFVNTRRKVDWLTDKMRGRDHTVSATHGDMDQNTRDIIMREFRSGSSRVLITTDLLARGIDVQQVSLVINYDLPTQPENYLHRIGRSGRFGRKGVAINFVTKDDERMLFDIQKFYNVVVEELPSNVADLL

SEQ ID NO: 8147 - protein, 413 aa, Artemisia annua
MAGVAAEGSQFDTRQFDSKMDELLSADGQDFFTSYDEVTETFDAMGLLENLLRGIYAYGFEKPSAIQQRGIVPFTKGLDVIQQAQSGTGKTATFCSGILQQLDYNVVECQALVLAPTRELAQQIEKVMRALGDYLGVKVHACVGGTSVREDQRILSAGVHAVVGTPGRVFDMLRRQSLRSDYIKMFVLDEADEMLSRGFKDQIYDIFQLLPPKVQVGVFSATMPPEALEITRKFMNKPVRILVKRDELTLEGIKQFYVNVEKEDWKLETLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTLDDSRMLSDIQKFYNVVVEELPSNVADLI

SEQ ID NO: 8148 - protein, 410 aa, Brassica napus
MAGSAPEGTQFDARQFDQKLNEVLEGQDEFFTSYDEVHDSFDAMGLQENLLRGIYAYGFEKPSAIQQRGIVPFCQGLDVIQQAQSGTGKTATFCSGVLQQLDFTLVQCQALVLAPTRELAQQIEKVMRALGDYLGVKVHACVGGTSVREDQRILQAGVHVVVGTPGRVFDMLKRQSLRADSIKMFVLDEADEMLSRGFKDQIYDIFQLLPPKIQVGVFSATMPPEALEITRKFMSKPVRILVKRDELTLEGIKQFYVNVEKEDWKLETLCDLYETLAITQSVIFVNTRRKVDWLTDKMRGRDHTVSATHGDMDQNTRDIIMREFRSGSSRVLITTDLLARGIDVQQVSLVINYDLPTQPENYLHRIGRSGRFGRKGVAIVTKDDERMLFDIQKFYNVVVEELPSNVADLL

SEQ ID NO: 8149 - protein, 414 aa, Leymus cinereus x Leymus triticoides
  misc_feature (15)..(15): Xaa can be any naturally occurring amino acid
  misc_feature (18)..(18): Xaa can be any naturally occurring amino acid
  misc_feature (21)..(21): Xaa can be any naturally occurring amino acid
  misc_feature (25)..(25): Xaa can be any naturally occurring amino acid
  misc_feature (28)..(28): Xaa can be any naturally occurring amino acid
  misc_feature (30)..(30): Xaa can be any naturally occurring amino acid
MAGMAPEGSQFDAKXYDXKMXELLXQGXTXEFFTSYDEVHESFDDMGLQENLLRGIYAYGFEKPSAIQQRGIVPFCKGLDVIQQAQSGTGKTATFCSGILQQLDYGLVECQALVLAPTRELAQQIEKVMRALGDYLGVKVHACVGGTSVREDQRILASGVHVVVGTPGRVFDMLRRQSLRPDNIKMFVLDEADEMLSRGFKDQIYDIFQLLPGKIQVGVFSATMPPEALEITRKFMNKPVRILVKRDELTLEGIKQFYVNVEKEEWKLDTLCDLYETLAITQSVIFVNTRRKVDWLTDKMRGRDHTVSATHGDMDQNTRDIIMREFRSGSSRVLITTDLLARGIDVQQVSLVINYDLPTQPENYLHRIGRSGRFGRKGVAINFVTREDERMLFDIQKFYNVVIEELPANVADLL

SEQ ID NO: 8150 - protein, 414 aa, Oryza sativa
MAGMAPEGSQFDAKHYDSKMQELLNQGETEEFFTSYDEVHESFDDMGLQENLLRGIYAYGFEKPSAIQQRGIVPFCKGLDVIQQAQSGTGKTATFCSGILQQLDYAVVECQALVLAPTRELAQQIEKVMRALGDYLGVKVHACVGGTSVREDQRILASGVHVVVGTPGRVFDMLRRQSLRPDYIKMFVLDEADEMLSRGFKDQIYDIFQLLPSKIQVGVFSATMPPEALEITRKFMNKPVRILVKRDELTLEGIKQFYVNVEKEEWKLDTLCDLYETLAITQSVIFVNTRRKVDWLTDKMRGRDHTVSATHGDMDQNTRDIIMREFRSGSSRVLITTDLLARGIDVQQVSLVINYDLPTQPENYLHRIGRSGRFGRKGVAINFVTRDDERMLFDIQRFYNVVIEELPANVADLL

SEQ ID NO: 8151 - protein, 414 aa, Pennisetum glaucum
MAGMAPEGSQFDAKHYDSKMQELLSTGETEEFFTSYDEVFESFDDMGLQENLLRGIYAYGFEKPSAIQQRGIVPFCKGLDVIQQAQSGTGKTATFCSGILQQLDYGLVECQALVLAPTRELAQQIEKVMRALGDYLGVKVHACVGGTSVREDQRILASGVHVVVGTPGRVFDMLRRQSLRPDHIKMFVLDEADEMLSRGFKDQIYDIFQLLPAKIQVGVFSATMPPEALEITRKFMNKPVRILVKRDELTLEGIKQFYVNVEKEDWKLDTLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTRDDDRMQFDIQRFYSVVIEELPTNVADLL

SEQ ID NO: 8152 - protein, 411 aa, Lactuca sativa
  misc_feature (263)..(263): Xaa can be any naturally occurring amino acid
  misc_feature (357)..(357): Xaa can be any naturally occurring amino acid
  misc_feature (360)..(362): Xaa can be any naturally occurring amino acid
  misc_feature (375)..(375): Xaa can be any naturally occurring amino acid
  misc_feature (383)..(383): Xaa can be any naturally occurring amino acid
  misc_feature (396)..(396): Xaa can be any naturally occurring amino acid
  misc_feature (403)..(403): Xaa can be any naturally occurring amino acid
MAGIAPEGSQFDARQFDSKMSELLSADGQDFFTSYDEVYDSFDAMGLQENLLRGIYAYGFEKPSAIQQRGIVPFTKGLDVIQQAQSGTGKTATFCSGILQQLDYNVVECQALVLAPTRELAQQIEKVMRALGDYLGVKVHACVGGTSVREDQRILSAGVHVVVGTPGRVFDMLRRQSLRADYIKMFVLDEADEMLSRGFKDQIYDIFQLLPSKVQVGVFSATMPPEALEITRKFMNKPVRILVKRDELTLEGIKQFYVNVEKXDWKLETLCDLYETLAITQSVIFVNTRRKVDWLTDKMRSRDHTVSATHGDMDQNTRDIIMREFRSGSSRVLITTDLLARGIDVHRCLWLLIMICXHSXXXIFIGLVEVGGLGXKVSPLILXLWRMRRCLRIFRXFIMLSWXSCRQMLLI

SEQ ID NO: 8153 - protein, 413 aa, Vigna unguiculata
  misc_feature (220)..(220): Xaa can be any naturally occurring amino acid
MAGQAPEGSVFDGRQYDAKMNELLGPDGQEFFTSYDEVCESFDAMGLQENLLRGIYAYGFEKPSAIQQRGIVPFCKGLDVIQQAQSGTGKTATFCSGVLQQLDYSLVECQALVLAPTRELAQQIEKVMRALGDYLGVKVHACVGGTSVREDQRILSSGVHVVVGTPGRVFDMLRRQSLRPDYIKMFVLDEADEMLSRGFKDQIYDIFQLLPPKIQVGVFXATMPPEALEITRKFMNKPVRILVKRDELTLEGIKQFFVNVDKEEWKLETLCDLYETLAITQSVIFVNTRRKVDWLTDKMRNRDHTVSATHGDMDQNTRDIIMREFRSGSSRVLITTDLLARGIDVQQVSLVINYDLPTQPENYLHRIGRSGRFGRKGVAINFVTSDDERMLVDIQKFYNVVVEELPANVADLI

SEQ ID NO: 8154 - protein, 410 aa, Zea mays
MAGLAPEGSQFDDKQYDKKMQEILTEDFFTSYDDVCESFDSMGLQENLLRGIYAYGFEKPSAIQQRGIVPFCKGLDVIQQAQSGTGKTATFCSGILQQLDYGLVECQALVLAPTRELAQQIEKVMRALGDYLGVKVHACVGGTSVREDQRILASGVHVVVGTPGRVFDMLRRQSLRPDNIKMFVLDEADEMLSRGFKDQIYDIFQLLPSKIQVGVFSATMPPEALEITRKFMNKPVRILVKRDELTLEGIKQFYVNIDKEDWKLDTLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTRDDERMLFDIQRFYNVTVEELPANVADLL

SEQ ID NO: 8155 - protein, 414 aa, Brassica oleracea
MAGMASEGTQYDPRQFDSKMNAILGEEGEETFYTTYDEVCDSFDAMELKSDLLRGIYAYGFEKPSAIQQRGIIPFCKGLDVIQQAQSGTGKTATFCSGVLQQLDYTLVQCQALVLAPTRELAQQIEKVMRALGDYLGVKVHACVGGTSVREDQRILQSGVHVVVGTPGRVFDMLRRQSLRADAIKMFVLDEADEMLSRGFKDQIYDIFQLLPSKVQVGVFSATMPPEALEITRKFMNKPVRILVKRDELTLEGIKQFYVNVDKEEWKLETLCDLYETLAITQSVIFVNTRRKVDWLTDKMRSRDHTVSATHGDMDQNTRDIIMREFRSGSSRVLITTDLLARGIDVQQVSLVINFDLPTQPENYLHRIGRSGRFGRKGVAINFMTTDDERMLSDIQKFYNVVVEELPSNVADLL

SEQ ID NO: 8156 - protein, 413 aa, Phaseolus coccineus
MAGQAPEGSQFDGRHYDAKMDELLGADGQDFFTSYDEVCESFDAMGLQENLLRGIYAYGFEKPSAIQQRGIVPFCKGLDVIQQAQSGTGKTATFCSGVLQQLDYSLVECQALVLAPTRELAQQIEKVMRALGDYIGVKVHACVGGTSVREDQRILSSGVHVVVGTPGRVFDMLRRQSLRPDHIKMFVLDEADEMLSRGFKDQIYDIFQLLPPKIQVGVFSATMPPEALEITRKFMNKPVRILVKRDELTLEGIKQFFVNVDKEEWKLETLCDLYETLAITQSVIFVNTRRKVDWLTDKMRNRDHTVSATHGDMDQNTRDIIMREFRSGSSRVLITTDLLARGIDVQQVSLVINYDLPTQPENYLHRIGRSGRFGRKGVAINFVTSDDDRMLLDIQKFYNVMVEELPANVADLI

SEQ ID NO: 8157 - protein, 414 aa, Brassica napus
MAGMASEGTQYDPRQFDSKMNAILGEEGEETFYTTYDEVCDSFDAMELKSDLLRGIYAYGFEKPSAIQQRGIIPFCKGLDVIQQAQSGTGKTATFCSGVLQQLDYTLVQCQALVLAPTRELAQQIEKVMRALGDYLGVKVHACVGGTSVREDQRILQSGVHVVVGTPGRVFDMLRRQSLRADAMKMFVLDEADEMLSRGFKDQIYDIFQLLPSKVQVGVFSATMPPEALEITRKFMNKPVRILVKRDELTLEGIKQFYVNVDKEEWKLETLCDLYETLAITQSVIFVNTRRKVDWLTDKMRSRDHTVSATHGDMDQNTRDIIMREFRSGSSRVLITTDLLARGIDVQQVSLVINFDLPTQPENYLHRIGRSGRFGRKGVAINFMTTDDERMLSDIQKFYNVVVEELPSNVADLL

SEQ ID NO: 8158 - protein, 410 aa, Cenchrus ciliaris
  misc_feature (6)..(6): Xaa can be any naturally occurring amino acid
MAGLAXEGTQFDGKQYDNKMQELMTEDFFTPYDEVCESFDNMGLLENLLRGIYAYGFEKPSAIQQRGIVPFCKGLDVIQQAQSGTGKTATFCSGILQQLDYGLVECQALVLAPTRELAQQIEKVMRALGDYLGVKVHACVGGTSVREDQRILASGVHVVVGTPGRVFDMLRRQSLRPDNIKMFVLDEADEMLSRGFKDQIYDIFQLLPSKIQVGVFSATMPPEALEITRKFMNKPVRILVKRDELTLEGIKQFYVNVEKEDWKLDTLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTRDDERMLFDIQKFYNVTVEELPANVADLL

SEQ ID NO: 8159 - protein, 413 aa, Nuphar advena
MAGLAPEGSQFDARQYDSRMSELLSGDAEEFFASYDEVHDSFDSMGLQENLLRGIYAYGFEKPSAIQQRGIVPFCKGLDVIQQAQSGTGKTATFCSGILQQLDYSLVECQALVLAPTRELAQQIEKVMRALGDYLGVKVHACVGGTSVREDQRILSSGVHVVVGTPGRVYDMLRRQSLRPDNIKMFVLDEADEMLSRGFKDQIYDIFQLLPSKIQVGVFSATMPPEALEITRKFMNKPVRILVKRDELTLEGIKQFYVNVDKEEWKLDTLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFITHDDDRMLGDIQRFYNVIIEELPANVADLI

SEQ ID NO: 8160 - protein, 413 aa, Triphysaria pusilla
MAGAAPEGSQFDAKSFDAKMVEILGEDTGEFFTSYDEVYESFDSMGLQENLLRGIYAYGFEKPSAIQQRGIVPFCKGLDVIQQAQSGTGKTATFCSGILQQLDYNVVECQALVLAPTRELAQQIEKVMRALGDYLGVKVHACVGGTSVREDQRILSSGVHVVVGTPGRVFDMLRRQSLRSDYIKMFVLDEADEMLSRGFKDQIYDIFQLLPPKIQVGVFSATMPPEALEITRKFMNKPVRILVKRDELTLEGIKQFFVSVEKEEWKLETLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTKDDERMLFDIQKFYNVAIEELPANVADLL

SEQ ID NO: 8161 - protein, 413 aa, Triphysaria pusilla
  misc_feature (375)..(375): Xaa can be any naturally occurring amino acid
MAGAAPEGSQFDAKSFDAKMVEILGEDTGEFFTSYDEVYESFDSMGLQENLLRGIYAYGFEKPSAIQQRGIVPFCKGLDVIQQAQSGTGKTATFCSGILQQLDYNVVECQALVLAPTRELAQQIEKVMRALGDYLGVKVHACVGGTSVREDQRILSSGVHVVVGTPGRVFDMLRRQSLRSDYIKMFVLDEADEMLSRGFKDQIYDIFQLLPPKIQVGVFSATMPPEALEITRKFMNKPVRILVKRDELTLEGIKQFFVSVEKEEWKLETLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGXKGVAINFVTKDDERMLFDIQKFYNVAIEELPANVADLL

SEQ ID NO: 8162 - protein, 410 aa, Mimulus guttatus
MAAEGSQFDTRQYDSRMSEILQPDQQEFFTSYDEVHESFDAMGLQENLLRGIYAYGFEKPSAIQQRGIVPFCKGLDVIQQAQSGTGKTATFCSGILQQLDYSLTQCQALVLAPTRELAQQIEKVMRALGDYLGVKVHACVGGTSVREDQRILSAGVHVVVGTPGRVFDMLRRQSLRADYIKIFVLDEADEMLSRGFKDQIYDIFQLLPSKVQVGVFSATMPPEALEITRKFMNKPVRILVKRDELTLEGIKQFYVNVEKEDWKLETLCDLYETLAITQSVIFVNTRRKVDWLTDKMRGRDHTVSATHGDMDQNTRDIIMREFRSGSSRVLITTDLLARGIDVQQVSLVINYDLPTQPENYLHRIGRSGRFGRKGVSINFLTTEDEKMLGDIQKFYNVVIEELPSNVADLL

SEQ ID NO: 8163 - protein, 413 aa, Cycas rumphii
MAGLAAEGTQFDARQYDAKMNEILSTEGEELFATYDEVHETFDSMGLHENLLRGIYAYGFEKPSAIQQRGIVPFCKGLDVIQQAQSGTGKTATFCSGILQQLDYNLLECQALVLAPTRELAQQIEKVMRALGDYLQVKVHACVGGTSVREDQRILMSGVHVVVGTPGRVFDMLRRHSLRPDYIKMFVLDEADEMLSRGFKDQIYDIFQLLPSKIQVGVFSATMPPEALEITRKFMNKPVRILVKRDELTLEGIKQFYVNVDKEDWKLDTLCDLYETLAITQSVIFVNTRRKVDWLTDKMRARDHTVSATHGDMDQNTRDIIMREFRSGSSRVLITTDLLARGIDVQQVSLVINYDLPTQPENYLHRIGRSGRFGRKGVAINFVTRDDERMLQDIQRFYNVVIEELPSNVADLL

SEQ ID NO: 8164 - protein, 390 aa, Populus trichocarpa
LANDGQDFFTSYDEVYDTFDSMGLQENLLRGIYAYGFEKPSAIQQRGIVPFCKGLDVIQQAQSGTGKTATFCSGILQQLDYGLVQCQALVLAPTRELAQQIEKVMRALGDYLGVKVHACVGGTSVREDQRILQAGVHVVVGTPGRVFDMLRRQSLRPDYIKMFVLDEADEMLSRGFKDQIYDIFQLLPSKVQVGVFSATMPPEALEITRKFMNKPVRILVKRDELTLEGIKQFYVNVDKEEWKLETLCDLYETLAITQSVIFVNTRRKVDWLTDKMRGRDHTVSATHGDMDQNTRDIIMREFRSGSSRVLITTDLLARGIDVQQVSLVINYDLPTQPENYLHRIGRSGRFGRKGVAINFVTSDDDRMLFDIQKFYNVVVEELPSNVADLL

SEQ ID NO: 8165 - protein, 411 aa, Pennisetum glaucum
TSGGLAPEGTQFDGKQYDNKMQELMTEDFFTPYDEVCESFDNMGLLENLLRGIYAYGFEKPSAIQQRGIVPFCKGLDVIQQAQSGTGKTATFCSGILQQLDYGLVECQALVLAPTRELAQQIEKVMRALGDYLGVKVHACVGGTSVREDQRILASGVHVVVGTPGRVFDMLRRQSLRPDNIKMFVLDEADEMLSRGFKDQIYDIFQLLPSKIQVGVFSATMPPEALEITRKFMNKPVRILVKRDELTLEGIKQFYVNVEKEDWKLDTLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFATRDDERMLHDIQRFYNVTVEELPANVADLL

SEQ ID NO: 8166 - protein, 413 aa, Pisum sativum
MAGLAPEGSQFDAGKFDARMNDLMAGDGNEFYTISDEVCESFDAMGLQENLLRGIYAYGFEKPSAIQQRGIVPFCKGHDVIQQAQSGTGKTATFCSGVLQQLDYNVTQCQALVLAPTRELAQQIEKVMRALGDYLGVKVHACVGGTSVREDQRILSSGVHVVVGTPGRVFDMLRRQSLHPDYIKMFVLDEADEMLSRGFKDQIYDIFQLLPGKIQVGVFSATMPPEALEITRKFMNKPVRILVKRDELTLEGIKQFYVNVEKEEWKLDTLCDLYETLAITQSVIFVNTRRKVDWLTDKMRSRDHTVSATHGDMDQNTRDIIMREFRSGSSRVLITTDLLARGIDVQQVSLVINFDLPTQPENYLHRIGRSGRFGRKGVAINFVNKEDEAMLQDIQKFYNVLVEELPSNVAELL

SEQ ID NO: 8167 - protein, 394 aa, Solanum tuberosum
MTELLGTEQQEFFTSYDEVHDSFDAMGLQENLLRGIYAYGFEKPSAIQQRGIVPFCKGLDVIQQAQSGTGKTATFCSGILQQLDYSLVECQALVLAPTRELAQQIEKVMRALGDYLGVKVHACVGGTSVREDQRILQSGVHVVVGTPGRVFDMLRRQSLRPDHIKMFVLDEADEMLSRGFKDQIYDIFQLLPPKIQVGVFSATMPPEALEITRKFMNKPVRILVKRDELTLEGIKQFYVNVDKEEWKLETLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTKDDERMLFDIQKFYNVVVEELPANVADLL

SEQ ID NO: 8168 - protein, 394 aa, Solanum tuberosum
MTELLGTEQQEFFTSYDEVYDSFDAMGLQENLLRGIYAYGFEKPSAIQQRGIVPFCKGLDVIQQAQSGTGKTATFCSGVLQQLDYSLVECQALVLAPTRELAQQIEKVMRALGDYLGVKVHACVGGTSVREDQRILQSGVHVVVGTPGRVFDMLRRQSLRPDHIKMFVLDEADEMLSRGFKDQIYDIFQLLPPKIQVGVFSATMPPEALEITRKFMNKPVRILVKRDELTLEGIKQFYVNVDKEEWKLETLCDLYETLAITQSVIFVNTRRKVDWLTDKMRGRDHTVSATHGDMDQNTRDIIMREFRSGSSRVLITTDLLARGIDVQQVSLVINYDLPTQPENYLHRIGRSGRFGRKGVAINFVTKDDERMLFDIQKFYNVVIEELPANVADLL

SEQ ID NO: 8169 - protein, 234 aa, Carthamus tinctorius
  misc_feature (58)..(58): Xaa can be any naturally occurring amino acid
MAGVAPEGSQFDTRHFDSKMNELLSTDGQDFFTSYDEVYDSFDAMGLQENLLRGIYAXGFEKPSAIQQRGIVPFCKGLDVIQQAQSGTGKTATFCSGILQQLDYNVVECQALVLAPTRELAQQIEKVMRALGDYLGVKVHACVGGTSVREDQRILSAGVHVVVGTPGRVFDMLRRQSLRADYIKMFVLDEADEMLSRGFKDQIYDIFQLLPSKVQVGSSPQPCLPRPSRSPASS

SEQ ID NO: 8170 - protein, 417 aa, Brassica napus
MAGSAPEGTQFDTRQFDQRLNEVLEGQDEFFTSYDEVHESFDAMGLQENLLRGIYAYGFEKPSAIQQRGIVPFCKGLDVIQQAQSGTGKTATFCSGVLQQLDFSLVQCQALVLAPTRELAQQIEKVMRALGDYLGVKVHACVGGTSVREDQRILQAGVHVVVGTPGRVFDMLRRQSLRSDSIKMFVLDEADEMLSRGFKDQIYDIFQLLPPKIQVGVFSATMPPEALEITRKFMSKPVRILVKRDELTLEGIKQFYVNVEKEEWKLETLCDLYETLAITQSVIFVNTRRKVDWLTDKMRSRDHTVSATHGDMDQNTRDIIMREFRSGSSRVLITTDLLARGIDVQQVSLVINFDLPTQPENYLHRIGRSGRFGRKGVAIVTKDDERMLFDIQKFYNVVVEELPSNVADLRKTTVVRR

SEQ ID NO: 8171 - protein, 418 aa, Brassica napus
MAGSAPEGTQFDTRQFDQRLNEVLEGQDEFFTSYDEVHESFDAMGLQENLLRGIYAYGFEKPSAIQQRGIVPFCKGLDVIQQAQSGTGKTATFCSGVLQQLDFSLVQCQALVLAPTRELAQQIEKVMRALGDYLGVKVHACVGGTSVREDQRILQAGVHVVVGTPGRVFDMLRRQSLRSDSIKMFVLDEADEMLSRGFKDQIYDIFQLLPPKIQVGVFSATMPPEALEITRKFMSKPVRILVKRDELTLEGIKQFYVNVEKEEWKLETLCDLYETLAITQSVIFVNTRRKVDWLTDKMRSRDHTVSATHGDMDQNTRDIIMREFRSGSSRVLITTDLLARGIDVQQVSLVINFDLPTQPENYLHRIGRSGRFGRKGVAIVTKDDERMLFDIQKFYNVVVEELPSNVADLEKKTTVVRR

SEQ ID NO: 8172 - protein, 413 aa, Aquilegia formosa
MAGMAQEGLQFNAQHYDSRMTEVLSSEGQDFFTSYDEVHESFDAMNLRENLLRGIYAYGFEKPSAIQQRGIVPFTKGLDVIQQAQSGTGKTATFCSGILQQLDFELVECQALVLAPTRELAQQIEKVMRALGDYLSVKVHACVGGTSVREDQHILSNGVHVVVGTPGRVFDMLRRKSLRADYIKMFVLDEADEMLSRGFKDQIYDIFQLLPAKVQVGVFSATMPPEALEITRKFMNKPVRILVKRDELTLEGIKQFYVNVDKEEFKLETLCDLYETLAITQSVIFVNTRRKVDWLTDKMRGRDHTVSATHGDMDQNTRDIIMREFRSGSSRVLITTDLLARGIDVQQVSLVINFDLPTQPENYLHRIGRSGRFGRKGVAINFVTRDDERMLYDIQKFYNVQIEELPSNVGDLL

SEQ ID NO: 8173 - protein, 412 aa, Mesembryanthemum crystallinum
MAAVPEGSQYDTRQYDTKMSELLDTDVDQFFTSYDEVYETFDGMGLQENLLRGIYAYGFEKPSAIQQRGIVPFCKGLDVIQQAQSGTGKTATFCSGILQQLDYSLVQCQALVLAPTRELAQQIEKVMRALGDYLGVKVHACVGGTSVREDQRILQSGVHVVVGTPGRVFDMLRRQSLRSDSIKMFVMDEADEMLSRGFKDQIYDIFQLLPPEIQIGVFSATMPPEALEITRKFMKKPVRILVKRDELTLEGIKQFYVNVDKEEWKLETLCDLYETLAITQSVIFVNTRRKVDWLTDNMRSRDHTVSATHGDMDQNTRDIIMREFRSGSSRVLITTDLLARGIDVQQVSLVINYDLPTQPENYLHRIGRSGRFGRKGVAINFVTHDDERMLADIQRFYNVTVEELPANVADLI

SEQ ID NO: 8174 - protein, 412 aa, Triphysaria pusilla
MAGSAPEGSQFDAKQYDAKMTEIVDAGEEYYTSYDVVHDSFDSMSLLENLLRGIYAYGFEKPSAIQQRGIVPFCEGRDVIQQAQSGTGKTATFCSGILQQLDYSLTQCQALVLAPTRELAQQIEKVMRALGDFLGVKVHACVGGTSVREDQRILSAGVHVVVGTPGRVFDMLRRQSLRSDNIKMFVLDEADEMLSRGFKDQIYDIFQLLPAKVQVGVFSATMPPEALDITRKFMNKPVRILVKRDELTLEGIKQFYVNVEKEEWKLETLCDLYETLAITQSVIFVNTRRKVDWLTDNMRTRDHTVSATHGDMDQNTRDIIMREFRSGSSRVLITTDLLARGIDVQQVSLVINFDLPTQPENYLHRIGRSGRFGRKGVAINFMTVEDQKMLQDIQKFYNVVVEELPSNVADLL

SEQ ID NO: 8175 - protein, 414 aa, Lactuca sativa
MAGAAPEGSQFNAQQFDSKMNELLSTDGQDFFTSYDEVYDSFDAMGLQENLLRGIYAYGFEKPSAIQQRGIVPFCKGLDVIQQAQSGTGKTATFCSGILQQLDYNVVECQALVLAPTRELAQQIEKVMRALGDYLGVKVHACVGGTSVREDQRILSAGVHVVVGTPGRVFDMLRRQSLRADYIKMFVLDEADEMLSRGFKDQIYDIFQLLPSKVQVGVFSATMPPEALEITRKFMNKPVRILVKRDELTLEGIKQFYVNVEKEEWKLETLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTLDDERMLAIFRSFIMLWVRSCLPMVRISYK

SEQ ID NO: 8176 - protein, 413 aa, Physcomitrella patens
MAGSAPEGSQFDARQYDAKMENILSAEGEDFISTWEEVHDTFDVMGLHENLLRGIYAYGFEKPSAIQQRGIVPFTKGLDVIQQAQSGTGKTATFCSGILQQLDYQLLECQALVLAPTRELAQQIEKVMRALGDYLQVKVHACVGGTSVREDQRILQAGVHVVVGTPGRVYDMLRRNALRADSIKCFVLDEADEMLSRGFKDQIYDIFQLLPQKLQVGVFSATMPPEALEITRKFMNKPVKILVKRDELTLEGIKQFYVNVDREEWKLDTLCDLYETLAITQSVIFINTRRKVDWLTDKMRARDHTVSATHGDMDQNTRDIIMREFRSGSSRVLITTDLLARGIDVQQVSLVINYDLPTQPENYLHRIGRSGRFGRKGVAINFVTRDDDRMLQDIQKFYNTVIEELPSNVADLL

SEQ ID NO: 8177 - protein, 413 aa, Theobroma cacao
  misc_feature (172)..(172): Xaa can be any naturally occurring amino acid
  misc_feature (297)..(297): Xaa can be any naturally occurring amino acid
  misc_feature (304)..(304): Xaa can be any naturally occurring amino acid
  misc_feature (315)..(315): Xaa can be any naturally occurring amino acid
  misc_feature (338)..(338): Xaa can be any naturally occurring amino acid
  misc_feature (341)..(341): Xaa can be any naturally occurring amino acid
  misc_feature (352)..(352): Xaa can be any naturally occurring amino acid
  misc_feature (359)..(359): Xaa can be any naturally occurring amino acid
  misc_feature (364)..(366): Xaa can be any naturally occurring amino acid
  misc_feature (388)..(388): Xaa can be any naturally occurring amino acid
  misc_feature (396)..(396): Xaa can be any naturally occurring amino acid
  misc_feature (403)..(403): Xaa can be any naturally occurring amino acid
  misc_feature (407)..(407): Xaa can be any naturally occurring amino acid
  misc_feature (413)..(413): Xaa can be any naturally occurring amino acid
MAGLATDGSQYDAHQYDSKMNELLSDEGKEFFTTYDEVCESFDKMGLKENLLRGIYAYGFEKPSAIQQRGIVPFCKGLDVIQQAQSGTGKTATFCSGILQQLDYDLVQCQALVLAPTRELAQQIEKVMRALGDYLGVKVHACVGGTSVREDQRILAAGVHVVVGTPGRVFDXLRRQSLRADAIRMFVLDEADEMLSRGFKDQIYDIFQQLPAKIQVGVFSATMPPEALEITRKFMNKPVRILVKRDELTLEGIKQFYVNVDKEEWKLDTLCDLYETLAITQSVIFVNTRRKVDWLTXQLRSRDXTVSATHGDMDXNTRDIIMREFRSGSSRVLITTDXLAXGIDVQQVSLVXNYDLPTXPENYXXXIGRSGRFGRKGVAINFVTRDDXRMLTDIQXFYNVVIXELPXNVADLX

SEQ ID NO: 8178 - protein, 413 aa, Marchantia polymorpha
MAGLAPEGSQFDARQYDQKMDQVLNQEGEDFISTWDEVHETFDAMGLHENLLRGIYAYGFEKPSTIQQRGIVPFCKGLDVIQQAQSGTGKTATFCSGILQQLDYNLVECQALVLAPTRELAQQIEKVMRALGDYLQVKVHACVGGTSVREDQRILQAGVHVVVGTPGRVYDMLRRHALRPESIKCFVLDEADEMLSRGFKDQIYDIFQLLPQKLQVGVFSATMPPEALEITRKFMNKPVKILVKRDELTLEGIKQFYVNVDREEWKLDTLCDLYETLAITQSVIFINTRRKVDWLTDKMRARDHTVSATHGDMDQNTRDIIMREFRSGSSRVLITTDLLARGIDVQQVSLVINYDLPTQPENYLHRIGRSGRFGRKGVAINFVTKEDERMLQDIQRFYNTVIEELPSNVADLL

SEQ ID NO: 8179 - protein, 413 aa, Pinus taeda
MAGAVADATLFDARQYDAKMKEILSTEGDELFASYDEVHESFDEMGLHENLLRGIYAYGFEKPSAIQQRGIVPFCKGLDVIQQAQSGTGKTATFCSGILQQLDYGLLECQALVLAPTRELAQQIEKVMRALGDYLQVKVHACVGGTSVRDDQRILMSGVHVVVGTPGRVFDMLRRHSLRPDYIKMFVLDEADEMLSRGFKDQIYDIFQLLPSKIQVGVFSATMPPEALEITRKFMSKPVRILVKRDELTLEGIKQFYVNVEKEDWKLDTLCDLYETLAITQSVIFVNTRRKVDWLTDKMRARDHTVSATHGDMDQNTRDIIMREFRSGSSRVLITTDLLARGIDVQQVSLVINYDLPTQPENYLHRIGRSGRFGRKGVAINFVTRDDERMLQDIQRFYNVVVEELPSNVADLL

SEQ ID NO: 8180 - protein, 413 aa, Picea glauca
MAGVVADATLFDARQYDAKMKEILSTEGDELFASYDEVHESFDEMGLHENLLRGIYAYGFEKPSAIQQRGIVPFCKGLDVIQQAQSGTGKTATFCSGILQQLDYGLLDCQALVLAPTRELAQQIEKVMRALGDYLQVKVHACVGGTSVRDDQRILMSGVHVVVGTPGRVFDMLRRHSLRPDYIKMFVLDEADEMLSRGFKDQIYDIFQLLPSKIQVGVFSATMPPEALEITRKFMSKPVRILVKRDELTLEGIKQFYVNVEKEDWKLDTLCDLYETLAITQSVIFVNTRRKVDWLTDKMRARDHTVSATHGDMDQNTRDIIMREFRSGSSRVLITTDLLARGIDVQQVSLVINYDLPTQPENYLHRIGRSGRFGRKGVAINFVTKDDERMLQDIQRFYNVVVEELPSNVADLL

SEQ ID NO: 8181 - protein, 421 aa, Brassica napus
MAGSAPEGTQFDTRQFDQKLNEVLEGQDEFFTSYDEVHESFDAMGLQENLLRGIYAYGFEKPSAIQQRGIVPFCNGLDVIQQAQSGTGKTATFCSGVLQQLDFTLVQCQALVLAPTRELAQQIEKVMRALGDYLGVKVHACVGGTSVREDQRILQAGVHVVVGTPGRVFDMLRRQSLRADSIKMFVLDEADEMLSRGFKDQIYDIFQLLPPKIQVGVFSATMPPEALEITRKFMSKPVRILVKRDELTLEGIKQFYVNVEKEDWKLETLCDLYETLAITQSVIFVNTRRKVDWLTDKMRSRDHTVSATHGDMDQNTRDIIMREFRSGSSRVLITTDLLARGIDVQQVSLVINFDLPTQPENYLHRIGRSGRFGRKGVAIVTKDDERMLFDIQKFYNVVVEELPSNVADLEEKGYLVCKFLI

SEQ ID NO: 8182 - protein, 414 aa, Arabidopsis lyrata
MAGMTSDGTQYDPRQFDTKMNAVLGEEGEETFYTNYDEVCDSFDAMELKPDLLRGIYAYGFEKPSAIQQRGIIPFCKGLDVIQQAQSGTGKTATFCSGVLQQLDISLVQCQALVLAPTRELAQQIEKVMRALGDYLGVKAQACVGGTSVREDQRVLQSGVHVVVGTPGRVFDLLRRQSLRADAIKMFVLDEADEMLSRGFKDQIYDIFQLLPSKVQVGVFSATMPPEALEITRKFMNKPVRILVKRDELTLEGIKQFYVNVDKEEWKLETLCDLYETLAITQSVIFVNTRRKVDWLTDKMRSRDHTVSATHGDMDQNTRDIIMREFRSGSSRVLITTDLLARGIDVQQVSLVINFDLPTQPENYLHRIGRSGRFGRKGVAINFMTTEDERMLADIQRFYNVVVEELPSNVADLL

SEQ ID NO: 8183 - protein, 414 aa, Arabidopsis thaliana
MAGMASDGTQYDPRQFDTKMNAILGEEGEETFYTNYDEVCDSFDAMELQPDLLRGIYAYGFEKPSAIQQRGIIPFCKGLDVIQQAQSGTGKTATFCSGVLQQLDISLVQCQALVLAPTRELAQQIEKVMRALGDYLGVKAQACVGGTSVREDQRVLQSGVHVVVGTPGRVFDLLRRQSLRADAIKMFVLDEADEMLSRGFKDQIYDIFQLLPSKVQVGVFSATMPPEALEITRKFMNKPVRILVKRDELTLEGIKQFYVNVDKEEWKLETLCDLYETLAITQSVIFVNTRRKVDWLTDKMRSRDHTVSATHGDMDQNTRDIIMREFRSGSSRVLITTDLLARGIDVQQVSLVINFDLPTQPENYLHRIGRSGRFGRKGVAINFMTSEDERMMADIQRFYNVVVEELPSNVADLL

SEQ ID NO: 8184 - protein, 423 aa, Brassica napus
MAGSAPEGTQFDTRQFDQKLNEVLEGQDEFFTSYDEVHESFDAMGLQENLLRGIYAYGFEKPSAIQQRGIVPFCNGLDVIQQAQSGTGKTATFCSGVLQQLDFTLVQCQALVLAPTRELAQQIEKVMRALGDYLGVKVHACVGGTSVREDQRILQAGVHVVVGTPGRVFDMLRRQSLRADSIKMFVLDEADEMLSRGFKDQIYDIFQLLPPKIQVGVFSATMPPEALEITRKFMSKPVRILVKRDELTLEGIKQFYVNVEKEDWKLETLCDLYETLAITQSVIFVNTRRKVDWLTDKMRSRDHTVSATHGDMDQNTRDIIMREFRSGSSRVLITTDLLARGIDVQQVSLVINFDLPTQPENYLHRIGRSGRFGRKGVAIVTKDDERMLFDIQKFYNVVVEELPSNVADLEEKVTWFASFVFDF

SEQ ID NO: 8185 - protein, 406 aa, Lolium multiflorum
TRRLPVDAKHYDTKMTELLSQGDTEEFFTSYDEVHESFDDMGLQENLLRGIYAYGFEKPSAIQQRGIVPFCKGLDVIQQAQSGTGKTATFCSGILQQLDYGLVDCQALVLAPTRELAQQIEKVMRALGDYLGVKVHACVGGTSVREDQRILASGVHVVVGTPGRVFDMLRRQSLRPDHIKMFVLDEADEMLSRGFKDQIYDIFQLLPGKIQVGVFSATMPPEALEITRKFMNKPVRILVKRDELTLEGIKQFYVNVEKEEWKLDTLCDLYETLAITQSVIFVNTRRKVDWLTDKMRGRDHTVSATHGDMDQNTRDIIMREFRSGSSRVLITTDLLARGIDVQQVSLVINYDLPTQPENYLHRIGRSGRFGRKGVAINFVTREDERMLFDIQKFYNVVIEELPGKCC

SEQ ID NO: 8186 - protein, 413 aa, Physcomitrella patens
MAGSAPEGSQFDARQYDAKMETVLAGEGEDFISTWEEVHETFDVMDLHENLLRGIYAYGFEKPSAIQQRGIVPFTKGLDVIQQAQSGTGKTATFCSGILQQLDYQLLECQALVLAPTRELAQQIEKVMRALGDYLQVKVHACVGGTSVREDQRILQAGVHVVVGTPGRVYDMLRRNALRADAIKCFVLDEADEMLSRGFKDQIYDIFQLLPQKLQVGVFSATMPPEALEITRKFMNKPVKILVKRDELTLEGIKQFYVNVDREEWKLDTLCDLYETLAITQSVIFINTRRKVDWLTDKMRARDHTVSATHGDMDQNTRDIIMREFRSGSSRVLITTDLLARGIDVQQVSLVINYDLPTQPENYLHRIGRSGRFGRKGVAINFVTRDDDRMLQDIQRFYNTVIEELPSNVADLL

SEQ ID NO: 8187 - protein, 413 aa, Physcomitrella patens
MAGSAPEGSQFDARQYDAKMENILSGEGDDFISTWEEVHETFDVMGLHENLLRGIYAYGFEKPSAIQQRGIVPFTKGLDVIQQAQSGTGKTATFCSGILQQLDYQLLECQALVLAPTRELAQQIEKVMRALGDYLQVKVHACVGGTSVREDQRILQAGVHVVVGTPGRVYDMLRRNALRADSIKCFVLDEADEMLSRGFKDQIYDIFQLLPQKLQVGVFSATMPPEALEITRKFMNKPVKILVKRDELTLEGIKQFYVNVDREEWKLDTLCDLYETLAITQSVIFINTRRKVDWLTDKMRARDHTVSATHGDMDQNTRDIIMREFRSGSSRVLITTDLLARGIDVQQVSLVINYDLPTQPENYLHRIGRSGRFGRKGVAINFVTKEDERMLQDIQRFYNTVIEELPSNVADLL

SEQ ID NO: 8188 - protein, 390 aa, Centaurea maculosa
  misc_feature (20)..(20): Xaa can be any naturally occurring amino acid
  misc_feature (106)..(106): Xaa can be any naturally occurring amino acid
MAGVAPEGSQFDARQFDSKXSELLSADGQDFFTSYDEVYESFDAMGLQENLLRGIYAYGFEKPSAIQQRGIVPFTKGLDVIQQAQSGTGKTATFCSGILQQLDYNXVECQALVLAPTRELAQQIEKVMRALGDYLGVKVHACVGGTSVREDQRILSAGVHVVVGTPGRVFDMLRRQSLRADYIKMFVLDEADEMLSRGFKDQIYDIFQLLPSKVQVGVFSATMPPEALEITRKFMNKPVRILVKRDELTLEGIKQFYVNVEKEEWKLETLCDLYETLAITQSVIFVNTRRKVDWLTDKMRSRDHTVSTTHGDMDQNTRDIIMREFRSGSSRVLITTDLLARGIDVQQVSLVINYDLPTQPENYLHRIGRSGRFGRKGVAINFVTLDDEKM

SEQ ID NO: 8189 - protein, 413 aa, Physcomitrella patens
MAGSAPEGSQFDARQYDAKMETILGGEGEDFISTWEEVHETFDVMGLHENLLRGIYAYGFEKPSAIQQRGIVPFTKGLDVIQQAQSGTGKTATFCSGILQQLDYQLLECQALVLAPTRELAQQIEKVMRALGDYLQVKVHACVGGTSVREDQRILQAGVHVVVGTPGRVYDMLRRNALRADSIKCFVLDEADEMLSRGFKDQIYDIFQLLPQKLQVGVFSATMPPEALEITRKFMNKPVKILVKRDELTLEGIKQFYVNVDREEWKLDTLCDLYETLAITQSVIFINTRRKVDWLTDKMRARDHTVSATHGDMDQNTRDIIMREFRSGSSRVLITTDLLARGIDVQQVSLVINYDLPTQPENYLHRIGRSGRFGRKGVAINFVTKEDERMLQDIQRFYNTVVEELPSNVADLL

SEQ ID NO: 8190 - protein, 414 aa, Eragrostis curvula
  misc_feature (308)..(308): Xaa can be any naturally occurring amino acid
  misc_feature (350)..(350): Xaa can be any naturally occurring amino acid
  misc_feature (354)..(354): Xaa can be any naturally occurring amino acid
  misc_feature (372)..(372): Xaa can be any naturally occurring amino acid
  misc_feature (376)..(376): Xaa can be any naturally occurring amino acid
  misc_feature (378)..(378): Xaa can be any naturally occurring amino acid
  misc_feature (381)..(381): Xaa can be any naturally occurring amino acid
  misc_feature (384)..(384): Xaa can be any naturally occurring amino acid
  misc_feature (396)..(397): Xaa can be any naturally occurring amino acid
  misc_feature (400)..(400): Xaa can be any naturally occurring amino acid
  misc_feature (404)..(405): Xaa can be any naturally occurring amino acid
  misc_feature (409)..(410): Xaa can be any naturally occurring amino acid
MAGMAPEGTQFDAKHYDSKLQELLSSGETEEFFTPYDEVFESFDDMGLQENLLRGIYAYGFEKPSAIQQRGIVPFTKGLDVIQQAQSGTGKTATFCSGILQQLDYGLVECQALVLAPTRELAQQIEKVMRALGDYLGVKVHACVGGTSVREDQRILASGVHVVVGTPGRVFDMLRRQSLRPDHIKMFVLDEADEMLSRGFKDQIYDIFQLLPAKIQVGVFSATMPPEALEITRKFMNKPVRILVKRDELTLEGIKQFYVNVEKEDWKLDTLCDLYETLAITQSVIFVNTRRKVDWLTDKMRSRDHTVXATHGDMDQNTRDIIMREFRSGSSRVLITTDLLARGIDVQQVXLVIXYDLPTQPENYLHRIGRSXRFGXKXVAXNFXTRDDERMLFDIXXFYXVVIXXLPAXXADLL

SEQ ID NO: 8191 - protein, 413 aa, Solanum lycopersicum
MAGAAPDGSQFDARQFDSKMTELLNAEGQEFFTSYDEAYDTFDAMELKEDLLKGIYAYGFEKPSAIQQRGIVPFCKGLDVIQQSQSGTGKTATFCSGVLQQLDYELLGCQALVLAPTRELAQQIEKVMEALGQCLKVKVHACVGGTSVREDQRILSIGVHVVVGTPGRVFDMLRRQSLRADHIKMFVLDEADEMLSRGFKDQIYDIFQLLPPKIQVGVFSATMPPEALEITRKFMNKPVRILVKRDELTLEGIKQFYVNVEKEEWKFDTLCDLYETLAITQSVIFVNTRRKVDLLTEQMQSKDHTVSATHGDMDHKTRDVIMHEFRSGSSRVLITTDLLARGIDVQQVSLVINYDLPTQPENYLHRIGRSGRFGRKGVAINFVTMDDERMLSDIQSFYNMVIEELPANVADLL

SEQ ID NO: 8192 - protein, 406 aa, Ricinus communis
MAGLALEGSQFDARQLSNDAQEFFTSSDEVYDSFDAMGLQENLLRGIYAYGFEKPSAIQQRGIVPFCKGLDVIQQAQSGTGKTATFCSGVLQQLDYGLVQCQALVLAPTRELAQQIDMVLRALGDYLDVKVHACVGGTSVREDQRILRAGVHVVVGTPGRVFDMLRRQSLPADYIKMFVLDEADEMLSRGFKDQIYDIFQFLPAKVQVGVFSATMPPEALDITRKFMNKPVRILVKRDELTLEGIKQYYVHVDKDEWKLETLCDLYETLPIAQSVIFVNTRRKVDWLTDKMRSRDHTVSATHGDMDQNASDVIMREFRSGSSRVLIATDLLARGIDVQQVSLVINYDLTTQPENYLHRIGRGGRFGRKGVAINFVTKEDDRMLFEIQKFYNMVIQELPANVADLQL

SEQ ID NO: 8193 - protein, 410 aa, Brassica napus
MAGSATQFDDARQFDQALSEILEGHDEFFTSYDEVYESFDGMGLQENLLRGIYAYGFEKPSAIQQRGIVPFCKGLDVIQQAQSGTGKTATFCSGVLQQLDVTLVQCQALVLAPTRELAQQIEKVMRALGDYIGVKVHACVGGTSVLDDKRILQAGVHVVVGTPGRVFDMLQRQSLRSDCIKMFVLDEADEMLSRGFKDQIYDIFQLLPPKIQVGVFSATMPPEALEITRKFMSKPVRILVKRDELTLEGIRQFYVDVDKEEWKFETLCDLYETLAITQSVIFVNTRRKVDWLTEKMRSRDHTVSATHGDMDQNTRDIIMREFRSGSSRVLITTDLLARGIDVQQVSLVINFDLPTQPANYLHRIGRSGRFGRKGAAINFVTRDDEKMLADIQKFYNMVVEELPSNLADLL

SEQ ID NO: 8194 - protein, 410 aa, Brassica rapa
MAGSATQFDDARQFDQALSEILEGQDEFFTSYDEVYESFDGMGLQENLLRGIYAYGFEKPSAIQQRGIVPFCKGLDVIQQAQSGTGKTATFCSGVLQQLDVTLVQCQALVLAPTRELAQQIEKVMRALGDYIGVKVHACVGGTSVLDDKRILQAGVHVVVGTPGRVFDMLQRQSLRSDCIKMFVLDEADEMLSRGFKDQIYEIFQLLPPKIQVGVFSATMPPEALEITRKFMSKPVRILVKRDELTLEGIRQFYVDVDKEEWKFETLCDLYETLAITQSVIFVNTRRKVDWLTEKMRSRDHTVSATHGDMDQNTRDIIMREFRSGSSRVLITTDLLARGIDVQQVSLVINFDLPTQPANYLHRIGRSGRFGRKGAAINFVTRDDEKMLADIQKFYNMVVEELPSNLADLL

SEQ ID NO: 8195 - protein, 411 aa, Selaginella moellendorffii
MAGLAPETSQFDPRQYDQKMEFALEGDDVISSWDEVNETFDSMGLHENLLRGIYAYGFEKPSTIQQRGIVPFCKGIDVIQQAQSGTGKTATFCSGILQQLDYNNVECQALVLAPTRELAQQIEKVMRALGDYLQVKVHACVGGTDVRQDQRILQAGVHVVVGTPGRVYDMLRRRALRPDYIKMFVLDEADEMLSRGFKDQIYDIFQLLPSKVQVGLFSATMPPEALEITRKFMNKPVRILVKRDELTLEGIKQFYVNVEREDWKLDTLCDLYETLAITQSVIFCNTRRKVDWLTDKMRSRDHTVSATHGDMDQNTRDIIMREFRSGSSRVLITTDLLARGIDVQQVSLVINYDLPTQPENYLHRIGRSGRFGRKGVAINFMVREDERMLHDIQKFYNTVIEELPNNVADLI

SEQ ID NO: 8196 - protein, 383 aa, Gossypium hirsutum
MAGLAPEGSQFDARQYDQKMSDLLQTDGDDFFTSYDEVYDSFDAMGLQENLLRGIYAYGFEKPSAIQQRGIVPFCKGLDVIQQAQSGTGKTATFCSGILQQLDYGIVQCQALVLAPTRELAQQIEKVMRALGDYLGVKVHACVGGTSVREDQRNLQSGVHVVVGTPGRVFDMLRRQSLRPDYIKMFVLDEADEMLSRGFKDQIYDIFQLLPGKIQVGVFSATMPPEALEITRKFMNKPVRILVKRDELTLEGIKQFYVNVEKEEWKLETLCDLYETLAITQSVIFVNTRRKVDWLTDKMRSRDHTVSATHGDMDQNTRDVIMREFRSGSSRVLITTDLLARGIDVQKVSLVINYDLTTQPENYLHRIGRSGRFGRKGVAINFV

SEQ ID NO: 8197 - protein, 383 aa, Catharanthus roseus
  misc_feature (29)..(29): Xaa can be any naturally occurring amino acid
  misc_feature (100)..(100): Xaa can be any naturally occurring amino acid
  misc_feature (107)..(107): Xaa can be any naturally occurring amino acid
  misc_feature (129)..(129): Xaa can be any naturally occurring amino acid
MAGLAPEGSQFDARQFDAKMTELLNTDGXEFFTSYDEVYDSFDSMGLQENLLRGIYAYGFEKPSAIQQRGIVPFCKGLDVIQQAQSGTGKTATFCSGILXQLDYNLXECQALVLAPTRELAQQIEKVMXALGDYLGVKVHACVGGTSVREDQRILSSGVHVVVGTPGRVFDMLRRQSLRPDYIKMFVLDEADEMLSRGFKDQIYDIFQLLPPKIQVGVFSATMPPEALEITRKFMNKPVRILVKRDELTLEGIKQFYVNVEKEEWKLETLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFV

SEQ ID NO: 8198 - protein, 414 aa, Brassica napus
MAGSATQFDDARQFDQALSEILEGHDEFFTSYDEVYESFDGMGLQENLLRGIYAYGFEKPSAIQQRGIVPFCKGLDVIQQAQSGTGKTATFCSGVLQQLDVTLVQCQALVLAPTRELAQQIEKVMRALGDYIGVKVHACVGGTSVLDDKRILQAGVHVVVGTPGRVFDMLQRQSLRSDCIKMFVLDEADEMLSRGFKDQIYDIFQLLPPKIQVGVFSATMPPEALEITRKFMSKPVRILVKRDELTLEGIRQFYVDVDKEEWKFETLCDLYETLAITQSVIFVNTRRKVDWLTEKMRSRDHTVSATHGDMDQNTRDIIMREFRSGSSRVLITTDLLARGIDVQQVSLVINFDLPTQPANYLHRIGRSGRFGRKGAAIVTRDDEKMLADIQKFYNMVVEELPSNLADLPCFADEE

SEQ ID NO: 8199 - protein, 384 aa, Artemisia annua
MAGVAAEGSHFDTRQFDSKMDELLSADGQDFFTSYDEVTETFDAMGLLENLLRGIYAYGFEKPSAIQQRGIVPFTKGLDVIQQAQSGTGKTATFCSGILQQLDYNLVECQALVLAPTRELAQQIEKVMRALGDYLGVKVHACVGGTSVREDQRILSAGVHAVVGTPGRVFDMLRRQSLRSDYIKMFVLDEADEMLSRGFKDQIYDIFQLLPPKVQVGVFSATMPPEALEITRKFMNKPVRILVKRDELTLEGIKQFYVNVEKEDWKLETLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVG

SEQ ID NO: 8200 - protein, 412 aa, Selaginella moellendorffii
MAGMAPEGSQFDPRQFDQKMEFALETGEEALSTWEEVNETFDSMGLHENLLRGIYAYGFEKPSAIQQRGIVPFCRGLDVIQQAQSGTGKTATFCSGILQQLDGHLNECQALVLAPTRELAQQIEKVMRALGDYLQTKVHACVGGTDVRQDQRICQAGVHVVVGTPGRVYDMLRRRALRSEHIRMFVLDEADEMLSRGFKDQIYDIFQLLPAKVQVGLFSATMPPEALEITRKFMSNPVRILVKRDELTLEGIKQFYVNVEREDWKLDTLCDLYETLAITQSVIFCNTRRKVDWLTDKLRSRDHTVSATHGDMDQNTRDIIMREFRSGSSRVLITTDLLARGIDVQQVSLVINFDLPTQPENYLHRIGRSGRFGRKGVAINFLTKDDEKMLFDIQKFYNTVIEELPSNVADLI

SEQ ID NO: 8201 - protein, 376 aa, Phaseolus coccineus
MAGLAPEGTQFDGRQYDAKMSELLSTDGQEFFTSYDEVYESFDAMGLQENLLRGIYAYGFERPSAIQQRGIVPFCKGLDVIQQAQSGTGKTATFCSGILQQLDYGLVQCQALVLAPTRELAQQIEKVMRALGDYLGVKVHACVGGTSVREDQRILQAGVHTVVGTPGRVFDMLRRQSLRPDCIKMFVLDEADEMLSRGFKDQIYDIFQLLPSKIQVGVFSATMPPEALEITRKFMNKPVRILVKRDELTLEGIKQFYVNVDKEEWKLETLCDLYETLAITQSVIFVNTRRKVDWLTDKMRSNDHTVSATHGDMDQNTRDIIMREFRSGSSRVLITTDLLARGIDVQQVSLVINYDLPTQPENYLHRIGRSGRFGRK

SEQ ID NO: 8202 - protein, 382 aa, Brassica rapa
MAGSAPEGTQFDTRQFDQKLNEVLEGQDEFFTSYDEVHESFDAMGLQENLLRGIYAYGFEKPSAIQQRGIVPFCNGLDVIQQAQSGTGKTATFCSGVLQQLDFTLVQCQALVLAPTRELAQQIEKVMRALGDYLGVKVHACVGGTSVREDQRILQAGVHVVVGTPGRVFDMLRRQSLRADSIKMFVLDEADEMLSRGFKDQIYDIFQLLPPKIQVGVFSATMPPEALEITRKFMSKPVRILVKRDELTLEGIKQFYVNVEKEDWKLETLCDLYETLAITQSVIFVNTRRKVDWLTDKMRSRDHTVSATHGDMDQNTRDIIMREFRSGSSRVLITTDLLARGIDVQQVSLVINFDLPTQPENYLHRIGRSGRFGRKGVAINFV

SEQ ID NO: 8203 - protein, 117 aa, Orobanche aegyptiaca
MASLATEASQFDTRQFDARMTELLHADGEEFFTNYDVINETFDSMGLQENLLRGIYAYGFEKPSAIQQRGIVPFCQGLDVIQQAQSGTGKTATFCSGILQQLDYGLTQCQALVFGTH

SEQ ID NO: 8204 - protein, 411 aa, Pinus taeda
MAAADPAGNNFDAKSYDKNMQSVLGGEELYSTWEEVHETFDSMGLQENLLRGIYAYGFEKPSAIQQRGIVPFCQGLDVIQQAQSGTGKTATFCSGILQQLDYSIPECQALVLAPTRELAQQIEKVMRALGDYLQVRVHACVGGTSIREDLRILQAGVHVVVGTPGRVYDMLRRRALRPDSIKMFVLDEADEMLSRGFKDQIYDIFQLLPANLQVGVFSATMPPEALEITRKFMTNPVRILVKRDELTLEGIKQFYVNVEREDWKLDTLCDLYETLAITQSVIFINTRRKVDWLTDQMRARDHTVSATHGDMDQNTRDIIMREFRSGSSRVLITTDLLARGIDVQQVSLVINYDLPTQPENYLHRIGRSGRFGRKGVAINFVTKDDERMLQDIQRFYNVVIEELPSNVADLI

SEQ ID NO: 8205 - protein, 411 aa, Pinus taeda
MAGVEQAGNNFDAKNYDKNMQSVLGGEELYSTWEEVNETFDSMGLQENLLRGIYAYGFEKPSAIQQRGIVPFCQGLDVIQQAQSGTGKTATFCSGILQQLDYSLPQCQALVLAPTRELAQQIEKVMRALGDYLQVRVHACVGGTSIREDLRILQAGVHVVVGTPGRVYDMLRRHALRSDSIKMFVLDEADEMLSRGFKDQIYDIFQLLPPNLQVGVFSATMPPEALEITRKFMNNPVRILVKRDELTLEGIKQFYVNVEREDWKLDTLCDLYETLAITQSVIFINTRRKVDWLTDQMRARDHTVSATHGDMDQNTRDIIMREFRSGSSRVLITTDLLARGIDVQQVSLVINYDLPTQPENYLHRIGRSGRFGRKGVAINFVTKDDERMLQDIQRFYNVVIEELPNNVADLI

SEQ ID NO: 8206 - protein, 369 aa, Raphanus sativus
  misc_feature (106)..(106): Xaa can be any naturally occurring amino acid
MGLQENLLRGIYAYGFEKPSAIQQRGIVPFCKGLDVIQQAQSGTGKTATFCSGVLQQLDVTLVQCQALVLAPTRELAQQIEKVMRALGDYLGVKVHACVGGTSVRXDQRILQAGVHVVVGTPGRVFDMLRRQSLRSDSIKMFVLDEADEMLSRGFKDQIYDIFQLLPPKIQVGVFSATMPPEALEITRKFMSKPVRILVKRDELTLEGIKQFYVNVEKEEWKLETLCDLYETLAITQSVIFVNTRRKVDWLTDKMRSRDHTVSATHGDMDQNTRDIIMREFRSGSSRVLITTDLLARGIDVQQVSLVINFDLPTQPENYLHRIGRSGRFGRKGVAINFVTRDDERMLFDIQKFYNVVVEELPSNVADLL

SEQ ID NO: 8207 - protein, 380 aa, Mesembryanthemum crystallinum
  misc_feature (8)..(9): Xaa can be any naturally occurring amino acid
NPCSVAMXXASTGLQENLLRGIYAYGFEKPSAIQQRGIVPFCQGLDVIQQAQSGTGKTATFCSGILQQLDYELLECQALVLAPTRELAQQIEKVMRALGDYLGVKVHACVGGTSVREDQRILAAGVHVVVGTPGRVFDMLRRQSLRADRIKMFVLDEADEMLSRGFKDQIYDIFQQLPPKIQVGVFSATMPPEALEITRKFMNKPVRILVKRDELTLEGIKQFYVNVDKEEWKLDTLCDLYETLAITQSVIFVNTRRKVDWLTDQMRARDHTVSATHGDMDQNTRDIIMREFRSGSSRVLITTDLLARGIDVQQVSLVINYDLPTQPENYLHRIGRSGRFGRKGVAINFVTRDDERMLADIQKFYNVVVEELPANVADLI

SEQ ID NO: 8208 - protein, 411 aa, Picea glauca
MAGVDQAGNNFDAKNYDKNMQSVLGGEELYSTWEEVNETFDSMGLQENLLRGIYAYGFEKPSAIQQRGIVPFCRGLDVIQQAQSGTGKTATFCSGILQQLDYNVPECQALVLAPTRELAQQIEKVMRALGDYLQVRVHACVGGTSIREDLRILQAGVHVVVGTPGRVYDMLRRRALRPDSIKMFVLDEADEMLSRGFKDQIYDIFQLLPSNLQVGVFSATMPPEALEITRKFMNNPVRILVKRDELTLEGIKQFYVNVEREDWKLDTLCDLYETLAITQSVIFINTRRKVDWLTDQMRARDHTVSATHGDMDQNTRDIIMREFRSGSSRVLITTDLLARGIDVQQVSLVINYDLPTQPENYLHRIGRSGRFGRKGVAINFVTKDDERMLQDIQRFYNVVIEELPNNVADLI

SEQ ID NO: 8209 - protein, 407 aa, Mesostigma viride
  misc_feature (266)..(266): Xaa can be any naturally occurring amino acid
MAGEGQYDARGYDQKMEGFLQDEELISTWDEVAESFDQMNLHENLLRGIYSYGFEKPSAIQQRGIVPFTRGLDVIQQAQSGTGKTATFCAGILQQLDYSLLQCQGLVLAPTRELAQQIEKVMRALGDYLGVKCHACVGGTSVREDQRILQGGVHVVVGTPGRVYDMLRRHALRSDCIRMFVLDEADEMLSRGFKDQIYDIFQLLPPKLQVGVFSATMPPEALEITRKFMSKPVKILVKRDELTLEGIKQFYVNVDREDWKLDTLCXLYETLAITQSVIFCNTRRKVDWLTDKMRVRDHTVSATHGDMDQNTRDIIMREFRSGSSRVLITTDLLARGIDVQQVSLVINYDLPLQPENYLHRIGRSGRFGRKGVAINFVTKDDERLVQDIQRFYNTTIEELPNNVADLI

SEQ ID NO: 8210 - protein, 369 aa, Arachis hypogaea
MGLQENLLRGIYAYGFERPSAIQQRGIVPFCKGLDVIQQAQSGTGKTATFCSGILQQLDYGLVQCQALVLAPTRELAQQIEKVMRALGDYLGVKVHACVGGTSVREDQRILQAGVHTVVGTPGRVFDMLRRQSLRPDHIKMFVLDEADEMLSRGFKDQIYDIIQLLPGKIQVGVFSATMPPEALEITRKFMNKPVRILVKRDELTLEGIKQFYVDVQKEEWKLETLCDLYETLAITQSVIFVNTRRKVDWLTDKMRANDHTVSATHGDMDQNTRDIIMREFRSGSSRVLITTDLLARGIDVQQVSLVINYDLPTQPENYLHRIGRSGRFGRKGVAINFVTQDDARMLSDIQKFYNVNVEELPSNVADLL

SEQ ID NO: 8211 - protein, 411 aa, Picea glauca
MAGVDQAGNNFDAKSYDKNMQSVLGGEELYSTWEEVHETFDSMGLQENLLRGIYAYGFEKPSAIQQRGIVPFCQGLDVIQQAQSGTGKTATFCSGILQQLNYNVPECQALVLAPTRELAQQIEKVMRALGDYLQVRVHACVGGTSIREDLRILQAGVHVVVGTPGRVYDMLRRRALRPDSIKMFVLDEADEMLSRGFKDQIYDIFQLLPTNLQVGVFSATMPPEALEITRKFMTNPVRILVKRDELTLEGIKQFYVNVEREDWKLDTLCDLYETLAITQSVIFINTRRKVDWLTDQMRARDHTVSATHGDMDQNTRDIIMREFRSGSSRVLITTDLLARGIDVQQVSLVINYDLPTQPENYLHRIGRSGRFGRKGVAINFVTKDDERMLQDIQRFYNVVIEELPNNVADLI

SEQ ID NO: 8212 - protein, 411 aa, Picea glauca
MAGVDPAGNNFDAKSYDKNMQSVLGGEELYSTWEEVNETFDSMGLQENLLRGIYAYGFEKPSAIQQRGIVPFCQGLDVIQQAQSGTGKTATFCSGILQQLDYNVPECQALVLAPTRELAQQIEKVMRALGDYLQVRVHACVGGTSIREDLRILQAGVHVVVGTPGRVYDMLRRRALRPDSIKMFVLDEADEMLSRGFKDQIYDIFQLLPSNLQVGVFSATMPPEALEITRKFMNNPVRILVKRDELTLEGIKQFYVNVEREDWKLDTLCDLYETLAITQSVIFINTRRKVDMLTDQMRARDHTVSATHGDMDQNTRDIIMREFRSGSSRVLITTDLLARGIDVQQVSLVINYDLPTQPENYLHRIGRSGRFGRKGVAINFITKDDERMLQDIQRFYNVVVEELPNNVADLI

SEQ ID NO: 8213 - protein, 413 aa, Chlamydomonas reinhardtii
MAAAPVERTGFDDRAFDTKMQQFLGNNEDKFYTDWEESFESFDQMNLHENLLRGIYAYGFEKPSAIQSKGIVPFTKGLDVIQQAQSGTGKTATFCAGILNNIDYNSNECQALVLAPTRELAQQIEKVMRALGDFLQVKCHACVGGTSVREDARILGAGVQVVVGTPGRVFDMLRRRYLRADSIKMFTLDEADEMLSRGFKDQIYDIFQLLPPKLQVGVFSATLPPEALEITRKFMNKPVRILVKRDELTLEGIKQFYVNVDKEEWKLDTLCDLYETLAITQSVIFANTRRKVDWLTDKMRERDHTVSATHGDMDQNTRDVIMREFRSGSSRVLITTDLLARGIDVQQVSLVINYDLPTQPENYLHRIGRSGRFGRKGVAINFVTKDDERMLQDIQRFYNTVIEELPSNVADLI

SEQ ID NO: 8214 - protein, 411 aa, Pinus taeda
MAGVEAAGNNFDAKNYDKNMQSVLGGEELYSTWEEVNETFDSMGLQENLLRGIYAYGFEKPSAIQQRGIVPFCQGLDVIQQAQSGTGKTATFCSGILQQLDYNVPECQALVLAPTRELAQQIEKVMRALGDYLQVRVHACVGGTSIREDLRILQAGVHVVVGTPGRVYDMLRRRALRPDSIKMFVLDEADEMLSRGFKDQIYDIFQLLPSNLQVGVFSATMPPEALEITRKFMNNPVRILVKRDELTLEGIKQFYVNVEREDWKLDTLCDLYETLAITQSVIFINTRRKVDMLTDQMRARDHTVSATHGDMDQNTRDIIMREFRSGSSRVLITTDLLARGIDVQQVSLVINYDLPTQPENYLHRIGRSGRFGRKGVAINFITKDDERMLQDIQRFYNVVVEELPNNVADLI

SEQ ID NO: 8215 - protein, 414 aa, Volvox carteri
MAAPPVEQRTGFDDRAFDSKMQAFLTNNQDNFYTDWEESFESFDQMNLHENLLRGIYAYGFEKPSAIQAKGIVPFTKGLDVIQQAQSGTGKTATFCAGILNNLDYNLNECQALVLAPTRELAQQIEKVMRALGDFLQVKCHACVGGTSVREDARILGAGVQVVVGTPGRVFDMLRRRYLRADNIKMFVLDEADEMLSRGFKDQIYDIFQLLPPKLQVGVFSATLPPEALEITRKFMNKPVRILVKRDELTLEGIKQFYVDVDKEEWKLDTLCDLYETLAITQSVIFANTRRKVDWLTEKMRERDHTVSATHGDMEQNARDVIMREFRSGSSRVLITTDLLARGIDVQQVSLVINYDLPTQPENYLHRIGRSGRFGRKGVAINFIVKEDERMLQDIQRFYNTVVEELPSNVADLI

SEQ ID NO: 8216 - protein, 51 aa, Taraxacum officinale
MAGAAPEGSQFNAQQFDSKMNELLSLTGKTFSHHMMKSTIVSMPWVSKKTF

SEQ ID NO: 8217 - protein, 386 aa, Brassica rapa
  misc_feature (340)..(340): Xaa can be any naturally occurring amino acid
MAGMASEGTQYDPRQFDSKMNAILGEEGEETFYTTYDEVCDSFDAMELKSDLLRGIYAYGFEKPSAIQQRGIIPFCKGLDVIQQAQSGTGKTATFCSGVLQQLDYTLVQCQALVLAPTRELAQQIEKVMRALGDYLGVKVHACVGGTSVREDQRILQSGVHVVVGTPGRVFDMLRRQSLRADAMKMFVLDEADEMLSRGFKDQIYDIFQLLPSKVQVGVFSATMPPEALEITRKFMNKPVRILVKRDELTLEGIKQFYVNVDKEEWKLETLCDLYETLAITQSVIFVNTRRKVDWLTDKMRSRDHTVSATHGDMDQNTRDIIMREFRSGSSRVLITTDLXARGIDVQQVSLVINFDLPTQPENYLHRIGRMGKVWEEGSGDQLHDN

SEQ ID NO: 8218 - protein, 352 aa, Panicum virgatum
KPSAIQQRGIVPFCKGLDVIQQAQSGTGKTATFCSGILQQLDYGLVECQALVLAPTRELAQQIEKVMRALGDYLGVKVHACVGGTSVREDQRILASGVHVVVGTPGRVFDMLRRQSLRPDHIKMFVLDEADEMLSRGFKDQIYDIFQLLPAKIQVGVFSATMPPEALEITRKFMNKPVRILVKRDELTLEGIKQFYVNVEKEDWKLDTLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTRDDERMLFDIQRFYNVVIEELPANVADLL

SEQ ID NO: 8219 - protein, 413 aa, Ostreococcus lucimarinus
MSGEGGFDDANYDRGMEELLKDDQDENGEGGITEWTEVHETFDTMNLQENLLRGIYAYGFEKPSAIQQRGIVPFSKGFDVIQQAQSGTGKTATFCAGILQSLDYSVHECQALVLAPTRELAQQIEKVMRALGDYLQVKCHACVGGTSVREDTRILQAGVHVIVGTPGRVYDMLRRRALKSDSIKIFALDEADEMLSRGFKDQIYDIFTLLPPKVQVGVFSATLPPEALEITRKFMTKPVRILVKRDELTLEGIKQFYVNVDKEQWKLDTLCDLYETLAITQSVIFANTRRKVDWLTDNMRARDFTVSATHGDMDQNTRDVIMREFRSGSSRVLITTDLLARGIDVQQVSLVINYDLPTQPENYLHRIGRSGRFGRKGVSINFVTAEDERLLQDIQRFYQTVIEELPSNVADLI

SEQ ID NO: 8220 - protein, 352 aa, Pseudoroegneria spicata
  misc_feature (2)..(3): Xaa can be any naturally occurring amino acid
KXXAIQQRGIVPFCKGLDVIQQAQSGTGKTATFCSGILQQLDYGLVECQALVLAPTRELAQQIEKVMRALGDYLGVKVHACVGGTSVREDQRILASGVHVVVGTPGRVFDMLRRQSLRPDNIKMFVLDEADEMLSRGFKDQIYDIFQLLPGKIQVGVFSATMPPEALEITRKFMNKPVRILVKRDELTLEGIKQFYVNVEKEEWKLDTLCDLYETLAITQSVIFVNTRRKVDWLTDKMRGRDHTVSATHGDMDQNTRDIIMREFRSGSSRVLITTDLLARGIDVQQVSLVINYDLPTQPENYLHRIGRSGRFGRKGVAINFVTREDERMLFDIQKFYNVVIEELPANVADLL

SEQ ID NO: 8221 - protein, 348 aa, Saccharum officinarum
IQQRGIVPFCKGLDVIQQAQSGTGKTATFCSGILQQLDYGLVECQALVLAPTRELAQQIEKVMRALGDYLGVKVHACVGGTSVREDQRILASGVHVVVGTPGRVFDMLRRQSLRPDNIKMFVLDEADEMLSRGFKDQIYDIFQLLPAKIQVGVFSATMPPEALEITRKFMNKPVRILVKRDELTLEGIKQFYVNVEKEDWKLDTLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTRDDERMLFDIQRFYNVVIEELPANVADLL

SEQ ID NO: 8222 - protein, 140 aa, Unknown
  Sequence found in Organisms: Solanum tuberosum, Solanum phureja
MAQYGNQDQMRKTDEYGNHVQETGTHQGTGMGGMQAGTGGMMGGMGTGGMGGTQGSGTGMGMGTGTHHHEGQQQLRRSDSSSSSEDDGEGGRRKKGMKEKIMQKMPGGGHGQQEGQTTGEGAGEKKGMMDKIKDKIPGMH

SEQ ID NO: 8223 - protein, 243 aa, Pseudoroegneria spicata
MEGGGARNVSAAAAQTKGSADDGSHKPLPPCCVKAQAAVPESEAKCHATVVSGWFTGTRSRSGKPSKAQYFNNPMWPGEAHSLKVEKILYQGKSPYQEVLVFESSTYGNVLVLDGIVQLTDKDECAYQEMVTHLALCSIPSPKNVLVVGGGDGGVLREIAKHDSVESIDICEIDQLVIDVCKDFFPRLYVGYKDPRVRLHVGDAVEFLRNSPEGKYDAIIVDSSDPIGPAQELVEKPFFSDNC

SEQ ID NO: 8224 - protein, 385 aa, Triticum aestivum
MEGGGARNVSAAAAQTEGSADDGSCKPLPPCCVKAQAAVPESEAKCHATVVSGWFTGTRSRSGKPSKAQYFNNPMWPGEAHSLKVEKILYQGKSPYQEVLVFESSTYGNVLVLDGIVQLTDKDECAYQEMVTHLALCSIPSPKNVLVVGGGDGGVLREIAKHDSVETIDICEIDQLVIDVCKDFFPRLYVGYKDPRVRLHVGDAVEFLRNSPEGKYDAIIVDSSDPIGPAQELVEKPFFQTIARALKPGGVLSNLAESMWLHTHLIQDMLSICREVFKGGVHYAWASVPTYPSGVIGFLLCAKDGPPVDFLTPVNPIEKIEGATKDGREMRFYNSEIHRAAFILPTFVKRELEAYSTSTEKEKPEKPTAKPVKMKVMRDSAITAS

SEQ ID NO: 8225 - protein, 385 aa, Hordeum vulgare
MEGGGARNVSAAAVQTKGTGDDGSRKPLPPCCVKAQAAVAESEAKCHATVVSGWFTGTRSRSGKPSKAQYFNNPMWPGEAHSLKVEKILYQGKSPYQEVLVFESSTYGNVLVLDGIVQLTDKDECAYQEMVTHLALCSIPSPKNVLVVGGGDGGVLREIAKHDSVESIDICEIDQLVIDVCKDFFPRLYVGYKDPRVRLHVGDAVEFLRNSPEGKYDAIIVDSSDPIGPAQELVEKPFFQAIARALKPGGVLSNLAESMWLHTHLIQDMLSICREVFKGGVHYAWASVPTYPSGVIGFLLCAKEGPPVDFLTPVNPIEKIEGATKDGREMRFYNSEIHRAAFILPTFVKRELEAYNTSTEKEKLEKPTAKPVKMKVMRDSAITAS

SEQ ID NO: 8226 - protein, 384 aa, Brachypodium distachyon
MEDGGARNVSAAAAQTKSGDDGTSKPLPPCCIKAKAAAAESEAKCHATVVSGWFTEPRSRFGKTSKVQYFNNPMWPGEAHSLKVEKILFQGKSPYQEILVFESSTYGNVLVLDGIVQLTDKDECAYQEMVTHLPLCSIPSPKNVLVVGGGDGGVLREIAKHDSVQTIDICEIDQLVINVCKDYFPHLYVGYEDPRVQLHVGDAVDFLRNAPEGKYDAIIVDSSDPIGPAQELVEKPFFQTIARALKPGGVLCNLAESMWLHTHLIQDMLSICRETFKGAIHYAWTSVPTYPSGVIGFLLCAKEGPPVNFLTPVNPIEKLVGDTIAGKEMRFYNSEIHRAAFILPTFVRKELEAHSISTKKEKPEKPAMKPVQMNIMPDSAILSS

SEQ ID NO: 8227 - protein, 387 aa, Oryza sativa
MEGGGAKDGSAAAAQTRGSGDDGSHKPLPPCCLKAKAAAAESEAKCHATVVSGWFTEPRSHSGKTSKVQYFNNPMWPGEAHSLKVENILYQGKSPYQEILVFESSTYGNVLVLDGIVQLTEKDECAYQEMVTHLPLCSIPSPKSVLVVGGGDGGVLREIARHASVENIDICEIDQLVIDVCKDFFPQLSVGFKDPRVQLHVGDAVDFLRNAPEGKYDAIIVDSSDPIGPAQELVEKPFFQTIARALKPGGVLCNQAESMWLHTHLIQDMLSICRETFKGAVHYAWTSVPTYPSGVIGFLLCAKEGPAVNFLSPVNPIEKLEGAMEAGREIRFYNSEVHRAAFVLPTFVRRELESHNTCAEKDKSETKPVAKPKKMKIMPNSAIPTAS

SEQ ID NO: 8228 - protein, 389 aa, Panicum virgatum
MEAGDAGNGSAAVAQIKGSGDDAYCKPLPPCCVKAKAGVPESEAKCHDTVVSGWFTEPRSRFGKTSKVQYYNNPMWPGEAHSLKVEKILYQGKSPYQEILVFESSTYGNVLVLDGIVQLTDKDECAYQEMVTHLPLCSIPSPKNVLVVGGGDGGVLREIARHDSVETIDICEIDQLVIDVCKEFFPNLSMGFKDPRVRLHVGDAVDFLRDSPEGKYDAIIVDSSDPIGPAQALVEKPFIQTIARALKAGGVLCNLAESMWLHTHLIQDMLSICRQTFKGGVHYAWTSVPTYPSGVIGFLLCAKEGPPVNFLTPVNPIEKIQGATKAGKELRFYNSEIHRAAFVLPTFVRRELESYTTCSTSTEKEKPKESVSKSQKIKILLNNAILTAS

SEQ ID NO: 8229 - protein, 360 aa, Brachypodium distachyon
MEDGGARNVSAAAAQTKSGDDGTSKPLPPCCIKAKAAAAESEAKCHATVVSGWFTEPRSRFGKTSKVQYFNNPMWPGEAHSLKVEKILFQGKSPYQEILVFESSTYGNVLVLDGIVQLTDKDECAYQEMVTHLPLCSIPSPKNVLVVGGGDGGVLREIAKHDSVQTIDICEIDQLVINVCKDYFPHLYVGYEDPRVQLHVGDAVDFLRNAPEGKYDAIIVDSSDPIGPAQELVEKPFFQTIARALKPGGVLCNLAESMWLHTHLIQDMLSICRETFKGAIHYAWTSVPTYPSGVIGFLLCAKEGPPVNFLTPVNPIEKLVGDTIAGKEMRFYNSEIHRAAFILPTFVRKELEAHSISTKK

SEQ ID NO: 8230 - protein, 389 aa, Panicum virgatum
MEAGDAGNGSAAAAQIKGSGDDASCKPLPPCCVKAKAGVPEAEAKCHDTVVSGWFTEPQSRFGKTSKVQYYNNPMWPGEAHSLKVEKILYQGKSPYQEILVFESSTYGNVLVLDGIVQLTDKDECAYQEMVTHLPLCSIPSPKNVLVVGGGDGGVLREIARHDSVETIDICEIDQLVIDVCKEFFPNLSMGFKDPRVRLHVGDAVDFLRDSPEGKYDAIIVDSSDPIGPAQALVEKPFIQTIARALKPGGVLCNLAESMWLHTHLIQDMLSICCQTFKGGVHYAWTSVPTYPSGVIGFLLCAKEGRPVNFLAPVNPIEKIQGATKAGKELRFYNSEIHRAAFVLPTFVRRELESYTATKTSTEKEKPKESVSKSQKIKILPNNAILTAS

SEQ ID NO: 8231 - protein, 386 aa, Panicum virgatum
MEGGGAGNGFTGTAQTKGTGGDGSAKPLPPCCVKARAAAAESEAKCHATVVSGWFTEPRSRCGKASKVQYYNNPMWPGEAHSLKVEKILYQGKSPYQEVLVFESSTYGKVLVLDGIVQLTDKDECAYQEMITHLPLCSISSPKKVLVIGGGDGGVLREISRHSSVESIDICEIDQLVIDVCKDFFPQLSVGFEDPRVQLHVGDAVEFLRNAPEGTYDAIIVDSSDPIGPAQELVEKPFFDTIARALRPGGVLCNQAESMWLHTHLIQDMLSICHETFKGSVHYAWTSVPTYPSGVIGFLLCAKEGPPVNFLTPINPIEKLEGATKAGREIRFYNSEMHRAAFVLPTFVKKELEAYCVSTGREEPEETAATAPKITVTSKSEILTAS

SEQ ID NO: 8232 - protein, 388 aa, Sorghum bicolor
MEVGDARNGSAAAAQTKGSADDAARKPLPPCCVKAKAGVPESEAKCHDTVVSGWFTEPRSRFGKTSKVQYFNNPMWPGEAHSLKVEKILFQGKSPYQEILVFESSTYGNVLVLDGIVQLTDKDECAYQEMVTHLPLCSIPAPKNVLVVGGGDGGVLREIARHDSVDTIDICEIDQLVIDVCKEFFPNISIGYKDPRVRLHVGDAVDFLRNSPEGKYDAIIVDSSDPIGPAQALVEKPFIQTIARALKPGGVLCNLAESMWLHTHLIQDMLAICRQTFKGAVHYAWTSVPTYPSGVIGFLLCAKEGREVNFLSPVNPIEKIGAGKAGRELRFYNSEIHRAAFVLPTFVRRELESYATPSTYAENEKPKESVSEPQKIKILSNNAILTAS

SEQ ID NO: 8233 - protein, 389 aa, Zea mays
MEVGDARNGSAAAALTKGGADDAARKPLPPCCVKAKARVPETEANCHDTVVSGWFTEPRSRFGKTSKVQYFNNPMWPGEAHSLKVEKILFQGKSPYQEILVFESSTYGNVLVLDGIVQLTDKDECAYQEMVTHLPLCSIPAPKNVLVVGGGDGGVLREIARHDSVETIDICEIDQLVIDVSKEFFPNLSIGFKDPRVRLHVGDAVDFLRNSPEGKYDAIIVDSSDPIGPAQALVEKPFIQTIARALKPGGVLCNLAESMWLHTHLIQDMLAICRQTFKGAVHYAWTSVPTYPSGVIGFLLCAKEGRAVNFLTPANPIEKIEGAAKAGRELRFYNSEIHRAAFVLPTFVRRELEAYTTPISSAENEKPKESVSEPQKIKILSNNAILTAS

SEQ ID NO: 8234 - protein, 386 aa, Sorghum bicolor
MEAGGAGNGLNGAVQTKGSGGDGSAKPLPPCCVKARAAAPESEAKCHATVVSGWFTEPRSRCGKASKVQYYNNPMWPGEAHSLKVEKILYQGKSPYQEVLVFESSTYGKVLVLDGIVQLTDKDECAYQEMITHLPLCSIPSPKKVLVIGGGDGGVLREISRHSSVESIDICEIDQLVIDVCKDLFPHLSVGFEDPRVQLHVGDAVEFLRNAPEGTYDAIIVDSSDPIGPAQELVEKPFFETIARALRPGGVLCNQAESMWLHTHLIQDMLSICRETFKGSVRYAWTSVPTYPSGVIGFLLCAKEGPSVNFLTPINPIEKVEGATKAGREIRFYNSEMHRAAFVLPAFAKRELEAYFASTETEQAEETAATRLKLTLASKSEILTAS

SEQ ID NO: 8235 - protein, 362 aa, Sorghum bicolor
MEAGGAGNGSNGAAQTKGSGGDGSTKTPPPLPPCCVKARAAAPESEAKCHATVVSGWFTEPRSHCGKASKVQYYNNPMWPGEAHSLKVEKILYQGKSPYQEVLVFESSTYGKVLVLDGIVQLTDKDECAYQEMITHLPLCSIPSPKKVLVIGGGDGGVLREISRHSSVESIDICEIDQLVIDICKDFFPHLSVGFEDPRVQLHVGDAVEFLRNAPEGTYDAIIVDSSDPIGPAQELVEKPFFETIARALRPGGVLCNQAESMWLHTHLIQDMLSICRETFKGSVRYAWTSVPTYPSGVIGFLLCAKEGPPVNFLTPINPIEKVEGATKAGREIRFYNSEMHRAAFVLPTFAKRELEAYCAST

SEQ ID NO: 8236 - protein, 106 aa, Triticum aestivum
PSSEREEAGATSRAFFSSECAVYVAERRVRAMAGVVGVWFAKFGREAAPAAEAEAEVVGRRHQGDGLLEVEAVKTVQIQERRRRNSAVLANSEDTVCMLMDRFAPA

SEQ ID NO: 8237 - protein, 73 aa, Hordeum vulgare
MAGVVGVWFAKLGREAAPAAEAEVVGRRNQGDGLLEAEAAKTVQIQERRRRNSSVLSNSEDTVCMLMDRFAPA

SEQ ID NO: 8238 - protein, 73 aa, Hordeum vulgare
MAGAVGVWFAKLGREAAPAAEAEVVGRRNQGDGLLEAEAAKTVQIQERRRRNSSVLSNSEDTVCMLMDRFSPA

SEQ ID NO: 8239 - protein, 136 aa, Triticum aestivum
MDGKKKPTAATGSSIVDDLFGPKDGAASSSAGYFSTVFPTPSGATGKDASLRAAAAAGNKSSSAGHQQQGKQHGGSPESPYFGSSSVHYGGRDFYAGAESQRQYSAAAAAPAPKHKDDGDTSAATRGEWWQGSLYY

SEQ ID NO: 8240 - protein, 136 aa, Triticum aestivum
MDGKKKPTAAAGSSIVDDLFGPKDGAAASSAGYFSTVFPTPSGATGKDASLRAAAAAGNKSSSAGHQQQGKQHGGSPESPYFGSSSVHYGGRDFYAGAESQRQYPAAAAAPAPKHKEDGDTSAATRGEWWQGSLYY

SEQ ID NO: 8241 - protein, 137 aa, Hordeum vulgare
MDGKKKPAAATGSSIVDDLFGPKNGAASPSSAGYFSTVFPTPSAATGKDASRRAAAAAGNKSSSAGHQQQGKQHGGSPESPYFGSSSVHYGGRDFYAGAESQRQYPPAAAAPAPKHKDDGDTSAATRGDWWQGSLYY

SEQ ID NO: 8242 - protein, 138 aa, Pseudoroegneria spicata
  misc_feature (48)..(48): Xaa can be any naturally occurring amino acid
  misc_feature (110)..(110): Xaa can be any naturally occurring amino acid
MDGKKKPAAAAGSSIVDDLFGPKDGAASPSSAGYFSTVFPTPSAATGXDAARRAAAAAAGNKSSSAGHQQQGKQHGGSPESPYFGSSSVHYGGRDFYAGAESQRQYPAAXATPAPKHKDDGDTSAATRGDWWQGSLYY

SEQ ID NO: 8243 - protein, 329 aa, Triticum aestivum
MGMPAVRRRERDAEAELNLPPGFRFHPTDDELVEHYLCRKAAGQRLPVPIIAEVDLYRFDPWALPDRALFGTREWYFFTPRDRKYPNGSRPNRAAGNGYWKATGADKPVAPRGGRTMGIKKALVFYAGKAPKGVKTDWIMHEYRLADAGRAAASKKGSLRLDDWVLCRLYNKKNEWEKMQLQQQGEEETMMEPKAENTASDMVVTSHSHSQSQSHSHSWGEARTPESEIVDNDPSLFQQATAAAFQAQSPAAAAAHQEMMATLMVPKKEAADEAGRNDLFVDLSYDDIQSMYNGLDMMPPGDDLLYSSLFASPRVRGSQPGAGGMPAPF

SEQ ID NO: 8244 - protein, 324 aa, Pseudoroegneria spicata
MGMPAVRRRERDAEAELNLPPGFRFHPTDDELVEHYLCRKAAGQRLPVPIIAEVDLYRFDPWALPDRALFGTREWYFFTPRDRKYPNGSRPNRAAGNGYWKATGADKPVAPRGGRTMGIKKALVFYAGKAPKGVKTDWIMHEYRLADAGRAAASKKGSLRLDDWVLCRLYNKKNEWEKMQLHQEQDGEMMVEPKAENTASDMVVTSHSHSQSQSHSHSWGEARTPESEIVDNDPSLFQKAAAFQTQSPAAAHQEMMATLMVPKKEAADEGRNDLFVDLSYDDIQSMYNGFDMMPPGDDLLYSTLFPSPRVRGSQPGAGGMPAPF

SEQ ID NO: 8245 - protein, 330 aa, Hordeum vulgare
MGMPAARRRERDAEAELNLPPGFRFHPTDDELVEHYLCRKAAGQRLPVPIIAEVDLYRFDPWALPDRALFGTREWYFFTPRDRKYPNGSRPNRAAGNGYWKATGADKPVAPRGGRTMGIKKALVFYAGKAPKGVKTDWIMHEYRLADAGRAAASKKGSLRLDDWVLCRLYNKKNEWEKMQLQQQQGEGETMMEPKAEENTASDMVVTSHSHSQSQSHSHSWGEARTPESEIVDNDPSLFHQAQATAFQTQSPAAAAAHQEMMATLMVPKKEAADEGRNDLFVDLSYDDIQSMYNGLDMMPPGDDLLYSSFFASPRVRGSQPGSGGMPAPF

SEQ ID NO: 8246 - protein, 319 aa, Avena sativa
MGMAVRRRERDAEAELNLPPGFRFHPTDDELVEHYLCRKAAGQRLPVPIIAEVDLYRFDPWALPDRALFGTREWYFFTPRDRKYPNGSRPNRAAGNGYWKATGADKPVAPRGGRTMGIKKALVFYAGKAPKGVKTDWIMHEYRLADAGRASASAKKGSLRLDDWVLCRLYNKKNEWEKMQQQGEQKVEPKAEEASAASDMVTSQSHSHSWGEARTPESEIVDTDPALFQQQAAAAGFQSPVAAAAHQEMMATLMVPKKEAADEGRNDLFVDLSYDDIQSMYSGLDVMPPGDDLLYSSLFASPRLRGSQPGAAGGMPGPF

SEQ ID NO: 8247 - protein, 724 aa, Brachypodium distachyon
MPSIVGGGGWRLFSADRGMTSLRRRQSPLFSSLAGGGGDAPHLPVVIVGAGPVGLVLSFLLTKFGIKCTVIEKSMEFTRHPRAHFINNRTMEIFRKFDGLAGDIEKAQPPVDLWRKFVYCTSLSGSVLGSVDHMKQEDFDKVISPISVAHFSQYKLVDLLLNKLEGIGFHTCFPDDIGGRLTRDLVLENKILMGHECSSIQLTDEGILLGASFNNGGTMQERKLHCGLLLAADGAKSTVRELAGISMEGARDLQKLVSVHFLSRNLGKYLSSERPGMLFFIFNPDAIGVLVAHDLEHGEFVLQIPFYPPQQMFDDFSIKVCEQIIVKLVGWEPADVQVLDIKPWVMHAEVAEKYTGCNNRVILVGDAAHRFPPAGGFGMNTGVQDAHNLAWKLGLLLNGVAGPSILQTYESERKPVRFFLHAVCFLNVAISNTKLSVQNFKAAMSVPATLGLDPTVANSVHQVINSSLGSVIPRNLQKTVLEGLFSIGRAQVSDYILNEKNPIGSLRLARLRSILDEGKSLQLQFPAEDLGFRYEKGALVAEDCAETAQQAEKLKHINRSSGEYIPSAKVGSRLPHMLVKTLSSSSEGVLSTMDLVSGDKVQFVLIVAPLKKSYELACAMLKIAEELTLSAKVCVMWPQGSVDAKVRGSRSELAPWTNYVDVEEIPRASDNSWWETCQVSKNKVILVRPDEHIAWIKESDMVRDADSEVRRVFSQILCLNRQQV

SEQ ID NO: 8248 - protein, 251 aa, Lolium multiflorum
MSSAVEVAISCSKNVDIAPEEVKERAVVLEHGNGDCAAAATNGKKCAEAASHCRKADEEEDDEDGEKVPEHIDLGPILSIKDQLEKDKDDESLRRWKEQLLGSVDLNSVGETLEPDVKIMSLSIQSPGRPDIVLPLPVEPNAKGVWFTLKEGSMYKLKFTFSVSNNIVSGLRYTNRVWKTGIKVDSTKEMLGTFSPQPEEYTYVTPEETTPSGMFARGSYSARTKFLDDDRKCYLQIDYTFDIRRDWPSSS

SEQ ID NO: 8249 - protein, 245 aa, Hordeum vulgare
MSSAVEAISCSKVAAAAAGPEEAKECAAVAEHGSGNGNGGGDAAPHCGKGVEEEDEEDGEKVPEHIDLGPILSIKDQLEKDKDDESLRRWKEQLLGSVDLNSVGETLEPDVKIMSLSIQSPGRPDIFLPLPAEPSGKGVWFTLKEGSPYKLKFTFSVSNNIVSGLRYTNTVWKTGIKVDSAKEMLGTFSPQPEPYAYVTPEETTPSGMFARGSYSAKTKFLDDDRKCYLQINYTFDIRREWPSSG

SEQ ID NO: 8250 - protein, 160 aa, Hordeum vulgare
MSSAVEAISCSKVAAAAAGPEEAKECAAVAEHGSGNGNGGGDAAPHCGKGVEEEDEEDGEKVPEHIDLGPILSIKDQLEKDKDDESLRRWKEQLLGSVDLNSVGETLEPDVKIMSLSIQSPGRPDIFLPLPAELSGKGVWFTLKEGSPYKLKFTSPSATT

SEQ ID NO: 8251 - protein, 238 aa, Brassica rapa
  misc_feature (186)..(186): Xaa can be any naturally occurring amino acid
MGFVDNNNNKKDGDDGNTSKTASSHQHEGTDDEGAGSLGRQMSEASLSAAEEEEDDDSKLQLGPQYTIKEHLEKDKDDESLRKWKEQLLGSVDVTNIGETLDPEVKIISLVILSPGRPDIVLMVPENGNPKGMWFTLKEGSRYCLKFTFQVKNNIVSGLRYTNTVWKTGVKVDRGKEMLGTFSPQXEPYNHVMPEETTPSGMFARGSYSARTKFLDDDNKCYLEINYSFDIRKEWPAV

SEQ ID NO: 8252 - protein, 237 aa, Brassica napus
MGFVDNNNKKDGDDGNTSKTASSHQHEGTDDEGAGSLGRQMSEASLSAAEEEEEDDSKLQLGPQYTIKEHLEKDKDDESLRKWKEQLLGSVDVTNIGETLDPEVKIISLAILSPGRPDIVLMVPENGNPKGMWFTLKEGSKYCLKFTFQVKNNIVSGLRYTNTVWKTGVKVDRGKEMLGTFSPQSEPYNHVMPEETTPSGMFARGSYSARTKFLDDDNKCYLEINYSFDIRKEWPAV

SEQ ID NO: 8253 - protein, 227 aa, Raphanus sativus
MGFDDENTSKTSHQHDGTDDEGAAGSLGRQMSEASLSAAEEEEDDDSKLQLGPQYTIKEHLEKDKDDESLRKWKEQLLGSVDVTNIGETLDPEVKIISLAILSPGRPDIVLMVPENGNPKGMWFTLKEGSKYNLKFTFQVNNNIVSGLRYTNTVWKTGVKVDRGKEMLGTFSPQSEPYNHVMPEETTPSGMFARGSYSARTKFLDDDNKCYLEINYSFDIRKEWAAV

SEQ ID NO: 8254 - protein, 230 aa, Raphanus sativus
MSLVSGAVSGSRDMDNKKNEGTDDEGVGSVGRQMSESSLSAAEEEEDDDSKLHLGPQYTIKEHLEKDKDDESLRKWKEQLLGSVDVTNIGETLDPEVRIISLAILSPGRPDIVLMVPENGNPKGMWFTLKEGSKYCLKFTFQVNNNIVSGLRYTNTVWKTGVKVDRGKEMLGTFSPQLEPYNHVMPEETTPSGMFARGSYSARTKFLDDDNKCYLEINYSFDIRKEWPAV

SEQ ID NO: 8255 - protein, 235 aa, Brassica napus
MSLVSSSRDMGGDDESTSRTHRHDGTDDEGVESLGRQMSESSIYATEEEEEDDDSKLHLGPQYTIKEHLEKDKDDESLRKWKEQLLGSVDVTNIGETLDPEVKIISLAILSPGRPDIVLMVPENGNPKGMWFTLKEGSKYCLKFTFHVNNNIVSGLRYTNTVWKTGVKVDRTKEMLGTFSPQLEPYNHVMPEETTPSGLFARGSYSARTKFLDDDNKCYLEINYSFDIRKEWPAV

SEQ ID NO: 8256 - protein, 235 aa, Brassica napus
MSLVSSSRDMGGDDESTSRTHRHDGTDDEGVESLGRQMSESSICATEEEEEDEDSKLHLGPQYTIKEHLEKDKDDESLRKWKEQLLGSVDVTNIGETLDPEVKIISLAILSPGRPDIVLMVPENGNPKGMWFTLKEGSKYCLKFTFHVNNNIVSGLRYTNTVWKTGVKVDRTKEMLGTFSPQLEPYNHVMPEETTPSGLFARGSYSARTKFLDDDNKCYLEINYSFDIRKEWPAV

SEQ ID NO: 8257 - protein, 228 aa, Brassica napus
MDNNNNKNNEENGNTSKTASDDEGVGSVGRQMSESSLCVTEEEEEDDSKLHLGPQYTIKEHLEKDKDDESLRKWKEQLLGSVDVTNIGETLDPEVRIISLVILSPGRPDIVLMVPENGNPKGMWFTLKEGSRYCLKFTFQVNNNIVSGLRYTNTVWKTGVKVDRGKEMLGTFSPQLEPYNHVMPEETTPSGMFARGSYSARTKFLDDDNKCYLEINYSFDIRKEWPAV

SEQ ID NO: 8258 - protein, 240 aa, Raphanus sativus
MSLVSGAVSSSRDMGGDDESTSRTHHHNDGTDDEGVESLGRQMSESSICATEDEEEDDDSKLHLGPQYTIKEHLEKDKDDESLRKWKEQLLGSVDVTNIGETLDPEVKIISLAILSPGRPDIVLMVPENGNPKGMWFTLKEGSKYCLKFTFHVNNNIVSGLRYTNTVWKTGVKVDRTKEMLGTFSPQLEPYNHVMPEETTPSGLFARGSYSARTKFLDDDNKCYLEINYSFDIRKEWPAV

SEQ ID NO: 8259 - protein, 179 aa, Brassica napus
MGGDDESTSRTHRHDGTDDEGVESLGRQMSESSIYATEEEEEDDDSKLHLGPQYTIKEHLEKDKDDESLRKWKEQLLGSVDVTNIGETLDPEVKIISLAILSPGRPDIVLMVPENGNPKGMWFTLKEGSKYCLNSRFMLTTTLSLVLGTPILFGRQVLKWTEQRRCLELLVLSWSHTTT

SEQ ID NO: 8260 - protein, 240 aa, Arabidopsis thaliana
MSLVSGARDMGFDDNNNNKNNKDGDDENSSSRTRADDDALSRQMSESSLCATEEEEDDDSKLQLGPQYTIKEHLEKDKDDESLRKWKEQLLGSVDVTNIGETLDPEVRIDSLAIISPGRPDIVLLVPENGNPKGMWFTLKEGSKYNLKFTFHVNNNIVSGLRYTNTVWKTGVKVDRAKEMLGTFSPQLEPYNHVMPEETTPSGMFARGSYSARTKFLDDDNKCYLEINYSFDIRKEWPAL

SEQ ID NO: 8261 - protein, 240 aa, Raphanus sativus
  misc_feature (25)..(25): Xaa can be any naturally occurring amino acid
  misc_feature (27)..(27): Xaa can be any naturally occurring amino acid
MSLVSGAVSSSRDMGGDDESTSRTXHXNDGTDDEGVESLGRQMSESSICATEDEEEDDDSKLHLGPQYTIKEHLEKDKDDESLRKWKEQLLGSVDVTNIGETLDPEVKIISLAIVSPGRPDIVLMVPENGNPKGMWFTLKEGSKYCLKFTFHVNNNIVSGLRYTNTVWKTGVKVDRTKEMLGTFSPQLEPYNHVMPEETTPFGLFARGSYFARTKFLDDDNKCYLEINYSFDIRKEWPAV

SEQ ID NO: 8262 - protein, 232 aa, Arabidopsis lyrata
MGFDDNNNNNNKDGDDENSSSRTRTRTDDDALARQMSESSLCATEEEEDDDSKLQLGPQYTIKEHLEKDKDDESLRKWKEQLLGSVDVTNIGETLDPEVRILSLAILSPGRPDIVLLVPENGNPKGMWFTLKEGSKYNLKFTFQVNNNIVSGLRYTNTVWKTGVKVDRAKEMLGTFSPQLEPYNHVMPEETTPSGMFARGSYSARTKFLDDDNKCYLEINYSFDIRKEWPAV

SEQ ID NO: 8263 - protein, 227 aa, Raphanus sativus
  misc_feature (83)..(83): Xaa can be any naturally occurring amino acid
  misc_feature (171)..(171): Xaa can be any naturally occurring amino acid
MGGDDESTSRTRHHNDGTDDEGVESLGRQMSESSICATEDEEEDDDSKLHLGPQYTIKEHLEKDKDDESLRKWKEQLLGSVDXTNIGETLDPEVKIISLAILSPGRPDIVLMVPENGNPKGMWFTLKEGSKYCLKFTFHVNNNIVSGLRYTNTVWKTGVKVDRTKEMLGTXSPQLEPYNHVMPEETTPSGLFARGSYSARTKFLDDDNKCYLEINYSFDIRKEWPAV

SEQ ID NO: 8264 - protein, 221 aa, Saccharum officinarum
MASERVTGTVKWFSVDKGFGFITPDDGSEDLFVHQSSIKSDGYRSLKEGEAVEYTVGSGNDGRTKAHDVTAPGGGNLAGGERPDGGNGGGRYGGGGGGYGGGGGDRGYGGGGDRGYGGGGDRGYGGGGDRGYGGGGDRGYGGGGDRGYGGGGGYGGGGGGGGGRGCYKCGEEGHMARDCSQGGGGYGGGGGGYGGGGGGGRECYNCHQEGHISRDCPEKRR

SEQ ID NO: 8265 - protein, 264 aa, Saccharum officinarum
  misc_feature (144)..(144): Xaa can be any naturally occurring amino acid
  misc_feature (246)..(246): Xaa can be any naturally occurring amino acid
MASERVTGTVKWFSVDKGFGFITPDDGSEDLFVHQSSIKADGYRSLKEGEAVEYTVGSGNDGRTKAHDVTAPGGGNLAGGERPDGGNGGGRYGGGGGGYGGGGGDRGYGGGDRGYGGGGDRGYGGGGDRGYGGGGDRGYGGGGXRGYGGGGGYGGGGGGGGGRGCYKCGEEGHMARDCSQGGGGYGGGGGGYVRRRWWPRVLQLPPGGPHLPRLPREEALGAWRGAPVAPDPAESHVVFRPPPYPXKESLGLLWMKSSEPAIYQ

SEQ ID NO: 8266 - protein, 215 aa, Sorghum bicolor
MAEERVTGTVKWFNVDKGFGFITPDDASEDLFVHQSSIKCDGYRSLKEGEAVEYTVGSGQDGRTKAMDVTAPGGGNLAGGERPDGGHGGGGRYGGGGGDRGYGGGGDRGYGGGGGYGGGGDRGYGGGGDRVYGGGGDRGYGRGGGGGYGGGGGGGRGCFKCGEEGHMARDCSQGGGGGGYGGGGGGGYGGGGGGRECYNCHQEGHISRDCPEKMR

SEQ ID NO: 8267 - protein, 271 aa, Saccharum officinarum
MASERVTGTVKWFSVDKGFGFITPDDGSEDLFVHQSSIKSDGYRSLKEGEAVEYTVGSGNDGRTKAHDVTAPGGGNLAGGERPDGGNGGGRYGGGGGGYGGGGGDRGYGGGGDRGYGGGGDRGYGGGGDRGYGGGGDRGYGGGGDRGYGGGGGYGGGGGRRSRLLQVRRGGPHGKGLLPGRRRLQRRRRRLRRWRWWLRRRRWRWPRVLQLPPGGPHLPRLPREEALGARRGAPVAPDPAESHVVSRPLPYPLKVSLGLLWMKSSEPAIYQ

SEQ ID NO: 8268 - protein, 634 aa, Glycine max
SVTMAGKTQTHYFLLLFLFLISINAKLDLYPSDYKALLTLQKDLGVNGQVSATLACETEGVFCERRKLSGKETYALRITRLVFKSNNLNGVLSPSIGRLTELKELSLSDNNLFGRLPPQIFDCRKLQILDLANNLFSGPVPPELSSLTRLRVLDISTNRLSGNLNFLKYFPNLETLSVADNLFTGRVPPSVRSFRNLRQFNFSGNRFLEPSLQSSSPETILSRRFLLDGDGDVPAPAPAPAPNNSNKKKKSNASSGAAAAPGPAPNNHKHKKSRRKLLGWILGFVAGAVAGILAGFVFSLMFKLALALIKGRGRKAGPDIYSPLIKKAEDLAFLEKEEGMASLEIIGRGGCGEVYKAELPGSNGKMIAIKKIIQPPKEGAELAEEDSKVLNKKMRQIRSEITTVGQIRHRNLLPLLAHVSRPGCHYLVYEFMKNGSLHDTLSKVEVGEFELDWLSRHKIALGVAAGLEYLHLNHNPRIIHRDLKPANILLDDDMEARIADFGLAKAMPDYKTHITTSNVAGTVGYIAPEYHQILKFTDKCDIYSFGVILGVLVIGKLPSHEFFQHTEEMSLVKWMRKILSSENPKEAIDTKLLGNGYEDQMLLVLKIACFCTMDDPKERPNSKDVWCMLSQIKH

SEQ ID NO: 8269 - protein, 314 aa, Hordeum vulgare
MASRDFLGRFGGEKGASSDKAGGGAGEPDEVVELSLGLSLGGCFGANSGRDAKKPRLVRSSSLAAMCTLPGASDDLAAATPPPAPLMRTSSLPTETEEERWRRREMQSLKRLQAKRKRLERRTSMNSGKSGGSSSRDDAQEPLYPSAFQLRRSVVDQGNTSSSMPDQGSGDGAEAKSTSSMEISSDNNNNASNQNKSLPPPAPSPAGKLPNGIVKEQPPLRTLRSLTMRTTSTGDLRKSMMEDMPMVSSKVDGPNGKKIDGFLYKYRKGEEVRIVCVCHGNFLTPAEFVKHAGGGDVTNPLRHIVVNPSPSVFL

SEQ ID NO: 8270 - protein, 316 aa, Leymus cinereus x Leymus triticoides
MASRDFLGRFGGEKGASSDKAGGGAGEPEEVVELSLGLSLGGCFGANSGRDAKKPRLVRSSSLAAMCSLPGNSDDLAAATPPPAPLMRTSSLPTETEEERWRRREMQSLKRLQAKRKRLERRTSMNSGKSGGSSSRDDAQEPLYPSAFQLRRSVVDQGNTSSSMPEQGAGSGDGAEAKSTSSMEISSDNNNNASNQNKSLPPPSPSPAGKLPNGIVKEQPPLRTLRSLTMRTTSTGDLRKSMMEDMPMVSSKVDGPNGKKIDGFLYKYRKGEEVRIVCVCHGNFLTPAEFVKHAGGGDVTNPLRHIVVNPSPSVFL

SEQ ID NO: 8271 - protein, 335 aa, Brachypodium distachyon
MASRDFLGRFGGEKGAASERAGGGGGGEAEEAVELSLGLSLGGCFGASSGRDAKKPRLQLARSSSIGSMCSLPAGGGGGAGSENDDLAAATPAPAPLMRTSSLPAETEEERWRRREMQSLKRLQAKRKRLERRNSMNSGKSGGGAGDAQEPLYPSAFQLRRSVVSQGSTSSGIPDQGGSAAAAAAAEARSTSSMETSSDNNNNGSNQSKSLPPPAPTPAGKPPAPPPNGTAKEQPPPPPPLRTLRSLTMRTTSTGDLRKSMMEDMPMVSSKVDGPNGKKIDGFLYKYRKGEEVRIVCVCHGNFLTPAEFVKHAGGGDVTNPLRHIVVNPSPSVFL

SEQ ID NO: 8272 - protein, 288 aa, Hordeum vulgare
MQMDSYYFHDDAHFFAGCGVPGSPFADLIASLSTEPLPAAAASQSAFREYRGVGLELPGAARGGMAGVGSKGNIHRRMMGVLARMGPSAGGSYCEEDGQEERPQQQAAGAVESSRGFRHMMRERQRREKLSQSYADLYAMVSSRSKGDKNSIVQSAAVYLHELKVAKDQLQRRNDELKAKILGHDAQQQCVKVQFEVDEPSSSIDSMIGALRRLKSMNVKTRGIHSTLSGQRLTTEMNVETTIAAGEVEKAVEEALQEVERNQLHDSEASFPGSRSGWPQTSHVQNVF

SEQ ID NO: 8273 - protein, 199 aa, Hordeum vulgare
MEPKSTTPPPPGPVLGAPVGYPPAAVYPPAPPPGYPHAPALYAPQPPPAAVAAASQQTAAQQQQQLQVFWAEQYREIEATTDFKNHNLPLARIKKIMKADEDVRMIAAEAPVVFARACEMFILELTHRGWAHAEENKRRTLQKSDIAAAIARTEVFDFLVDIVPRDEAKDAEAAVAAGMPHPAAGMPAADMGYYYVPQQ

SEQ ID NO: 8274 - protein, 191 aa, Triticum aestivum
  misc_feature (8)..(8): Xaa can be any naturally occurring amino acid
SHQIQHPXAPVGYPPAAVYPAAAPPGYPHAPALYAPQPPPAAVAAASQQTAAQQQQQLQVFWAEQYREIEATTDFKNHNLPLARIKKIMKADEDVRMIAAEAPVVFARACEMFILELTHRGWAHAEENKRRTLQKSDIAAAIARTEVFDFLVDIVPRDEAKDAEAAVAAGMPHPAAGMPAADMGYYYVPQQ

SEQ ID NO: 8275 - protein, 205 aa, Oryza sativa
MEPKSTTPPPPPPPPVLGAPVPYPPAGAYPPPVGPYAHAPPLYAPPPPAAAAASAAATAASQQAAAAQLQNFWAEQYREIEHTTDFKNHNLPLARIKKIMKADEDVRMIAAEAPVVFARACEMFILELTHRGWAHAEENKRRTLQKSDIAAAIARTEVFDFLVDIVPRDEAKDAEAAAAVAAGIPHPAAGLPATDPMAYYYVQPQ

SEQ ID NO: 8276 - protein, 201 aa, Brachypodium distachyon
MDPTKSSTPPPPPVLGAPVGYPPGAYSPQPGAAAAAYAPQLYAPPAAAAAQQAAAAQQHLQMFWAEQYREIEATTDFKNHNLPLARIKKIMKADEDVRMIAAEAPVVFARACEMFILELTHRGWAHAEENKRRTLQKSDIAAAIARTEVFDFLVDIVPRDDAKDADAAAAAAAAAAAAGIPRPAAGVPATDPMAYYYVPQQ

SEQ ID NO: 8277 - protein, 202 aa, Sorghum bicolor
MDPSKSSTPPPPPVMGAPVAYPPAAYPPGAAAGAAAYAPQLYAPPAAAAAQQAAAAQQQQLQMFWAEQYREIEATTDFKNHNLPLARIKKIMKADEDVRMIAAEAPVVFARACEMFILELTHRGWAHAEENKRRTLQKSDIAAAIARTEVFDFLVDIVPRDDAKDADAAAAAAAAAAAAGIPRPAAGVPATDPLAYYYVPQQ

SEQ ID NO: 8278 - protein, 203 aa, Hordeum vulgare
MDPTKSSTPPPPPVLGAPVGYPPGAYPPPPGAAPAPYPPQLYAPPGAAAAQQAAAQQQQQLQVFWAEQYREIEATTDFKNHNLPLARIKKIMKADEDVRMIAAEAPVVFARACEMFILELTHRGWAHAEENKRRTLQKSDIAAAIARTEVFDFLVDIVPRDDAKDVEAAAAAAMATAAAGIPRPAAGVPATDPSMAYYYVPQQ

SEQ ID NO: 8279 - protein, 200 aa, Zea mays
MDPNKSSTPPPPPVMGAPVAYPPPAYPPGVAAGAGAYPPQLYAPPAAAAAQQAAAAQQQQLQIFWAEQYREIEATTDFKNHNLPLARIKKIMKADEDVRMIAAEAPVVFARACEMFILELTHRGWAHAEENKRRTLQKSDIAAAIARTEVFDFLVDIVPRDDGKDADAAAAAAAAAAGIPRPAAGVPATDPLAYYYVPQQ

SEQ ID NO: 8280 - protein, 201 aa, Sorghum bicolor
MEPKSTTPPPPPVMGAPVAYPPPPGAAYPAGPYAHAPAAALYPPPPPPPAPPTSQQGAAAAQQLQLFWAEQYREIEATTDFKNHNLPLARIKKIMKADEDVRMIAAEAPVVFARACEMFILELTHRGWAHAEENKRRTLQKSDIAAAVARTEVFDFLVDIVPRDEAKEADSAAAMGPAGIPHPAAGLPATDPMGYYYVQPQ

SEQ ID NO: 8281 - protein, 200 aa, Zea mays
MEPKSTTPPPPPVMGAPIAYPPPPGAAYPAGPYVHAPAAALYPPPPLPPAPPSSQQGAAAAHQQQLFWAEQYREIEATTDFKNHNLPLARIKKIMKADEDVRMIAAEAPVVFSRACEMFILELTHRGWAHAEENKRRTLQKSDIAAAVARTEVFDFLVDIVPRDEAKDADSAAMGAAGIPHPAAGLPAADPMGYYYVQPQ

SEQ ID NO: 8282 - protein, 143 aa, Brassica oleracea
  misc_feature (132)..(132): Xaa can be any naturally occurring amino acid
MADTPSSPAGDGGESGGGSVREQDRYLPIANISRIMKKALPPNGKIGKDAKDTVQECVSEFISFITSEASDKCQKEKRKTVNGEDLLWAMATLGFEDYLEPLKVYLARYRELEGDNKGSGKSGDGSNRDAAXWGVPNEDMPSW

SEQ ID NO: 8283 - protein, 141 aa, Thellungiella halophila
MADTPSSPAGDGGESGGSVREQDRYLPIANISRIMKKALPPNGKIGKDAKDTVQECVSEFISFITSEASDKCQKEKRKTVNGEDLLWAMATLGFEDYLEPLKIYLARYRELEGDNKGSGKSGDGSNRDAAGGASGEDMPGW

SEQ ID NO: 8284 - protein, 112 aa, Unknown
  Sequence found in Organisms: Arabidopsis thaliana, Arabidopsis lyrata
MADTPSSPAGDGGESGGSVREQDRYLPIANISRIMKKALPPNGKIGKDAKDTVQECVSEFISFITSEASDKCQKEKRKTVNGDDLLWAMATLGFEDYLEPLKIYLARYREVW

SEQ ID NO: 8285 - protein, 139 aa, Raphanus sativus
MADTPSSPGGGESGGSVREQDRYLPIANISRIMKRALPPNGKIGKDAKDTVQECVSEFISFVTSEASDRCQKEKRKTVNGEDLLWAMTTLGFEDYLEPLKLYLARYRELEGDNKGSGKSGESNNRDAAGGASGEDLPSW

SEQ ID NO: 8286 - protein, 140 aa, Cleome gynandra
MDTPTSPVGDGGESGGSVREQDRFLPIANISRIMKKALPPNGKIGKDAKDTVQECVSEFISFITSEASDKCQKEKRKTVNGDDLLWAMATLGFEDYLDPLRIYLQRYRELEGDNKGSAKGGDSSNRDGAGAFPGQDMPGW

SEQ ID NO: 8287 - protein, 120 aa, Populus trichocarpa
MADNPTSPAAGSHESGGEQSPRSGVREQDRYLPIANISRIMKKALPANGKIAKDAKDTVQECVSEFISFVTSEASDKCQKEKRKTINGDDLLWAMATLGFEDYIEPLKVYLARYREQLGG

SEQ ID NO: 8288 - protein, 174 aa, Manihot esculenta
MADNPTSPAGGSHESGGEQSPHSGVREQDRYLPIANISRIMKKALPANGKIAKDAKDTVQECVSEFISFITSEASDKCQKEKRKTINGDDLLWAMATLGFEDYIEPLKVYLARYREMEGDTKGSARGGDGSAKRDAIGGLPVQNPQFAIQGSMNYISSQAQGQHMIVPSMQGNE

SEQ ID NO: 8289 - protein, 119 aa, Ricinus communis
MADNPTSPAGGSHESGGEQSPHSGVREQDRYLPIANISRIMKKALPANGKIAKDAKDTVQECVSEFISFITSEASDKCQKEKRKTINGDDLLWAMATLGFEDYIEPLKVYLARYREMEG

SEQ ID NO: 8290 - protein, 174 aa, Ricinus communis
MADNPTSPAGGSHESGGEQSPHSGVREQDRYLPIANISRIMKKALPANGKIAKDAKDTVQECVSEFISFITSEASDKCQKEKRKTINGDDLLWAMATLGFEDYIEPLKVYLARYREMEGDTKGSARGGDGSGKRDAMGGLPGQNPQFALQGSMNYINSQAQGQHMIVPSMQGNE

SEQ ID NO: 8291 - protein, 175 aa, Citrus sinensis
MAEAPTSPAGGSHESGGEQSPHAGGVREQDRYLPIANISRIMKKALPANGKIAKDAKDTVQECVSEFISFITSEASDKCQKEKRKTINGDDLLWAMATLGFEDYIDPLKAYLMRYREMEGDTKGSARGGDGSAKRDTIGALPGQNAQYALQGPLNYANPQAQGQHMIVPSMQGNE

SEQ ID NO: 8292 - protein, 173 aa, Tropaeolum majus
MADAPTSPPGGSHDSGGDHSPRSGVREQDRYLPIANISRIMKKALPPNGKIAKDAKDTVQECVSEFISFITSEASDKCQKEKRKTINGDDLLWAMATLGFEEYIEPLKVYLSRYRETEGDTKGSARGEGSLKRDGVGGIPGQNTQFALQGSVNYINNQGQGHHLIHPSMQGNE

SEQ ID NO: 8293 - protein, 162 aa, Gossypium hirsutum
MGGGPTSPAGGSHESGGEHSSPQSTVREQDRYLPIANISRIMKKALPSNGKIAKDAKDTVQECVSEFISFITSEASDKCQKEKRKTINGDDLLWAMATLGFEDYIEPLKIYLARYRELEGDTKGSARGGDGSFKRDAAGALPAQNPQAQGQHMIIPSMQGNE

SEQ ID NO: 8294 - protein, 171 aa, Glycine max
MSDAPPSPTHESGGEQSPRGSSSGAREQDRYLPIANISRIMKKALPPNGKIAKDAKDTMQECVSEFISFITSEASEKCQKEKRKTINGDDLLWAMATLGFEDYIEPLKVYLARYREGDTKGSARSGDGSATPDQVGLAGQNSQLVHQGSLNYIGLQVQPQHLVMPSMQSHE

SEQ ID NO: 8295 - protein, 174 aa, Medicago truncatula
MADAPNQCEESHESGGEQSPRGSSSASREQDRFLPIANISRIMKKALPSNGKIAKDAKDTMQECVSEFISFITSEASEKCQKEKRKTINGDDLLWAMATLGFEDYIEPLKVYLARYREGDSKGSVRNSDGSGRRDQVGGPPGQNAQFVHQGSLSYIDSQVHPQHLVMPSMQNHE

SEQ ID NO: 8296 - protein, 122 aa, Secale cereale
TFYCRKPACQVWIIGEGADATQQLRAPKGTRFIPYSQFPPRMARKDCCTYSTTPAMSVPKTLQNVHSCENWLPRRVMSAWRVAGIVHALEGWDENECGDKVLDMDKVWSAALLHGFRPVAET

SEQ ID NO: 8297 - protein, 495 aa, Pennisetum glaucum
DGFLLIAFLHAGPVEFLYYWFHRALHHHFLYTRYHSHHHASIVTEPITSVIHPFAELVAYELLFAIPLISCALTGCASIVAFEIYVLYIDFMNNMGHCNFELVPNWLFKWFPPLKYLMYTPSFHSLHHTKFRTNYSLFMPFYDYIYNTMDKSSDALYEKSLKGKEETVEVVHLTHLTSLQSIYHMRPGFAEYASKPYTSKWYMRMMWPVSWLSMVLTWTYGSSFTVERNVMKKLKMQSWAIPRYSFHYGLTWEKEAINNLIEKAICEAEKKGAKVVSLGLLNQAHNLNGNGELYLQKYPKLGVRLVDGTSLASAVVVNSIPQGTDQVVLAGNISKVARAVAAALCKKNVKVVMTNKQDYHFLKPNMPENAADNLLFSKTATAKVWLLGEGLDASEQFKAQKGTQFIPYSQFPPKMVRKDSCTYSTTPAMAVPKTLENVHSCENWLPRRVMSAWRIAGMVHALEGWNDHECGDIVLDMEKVWSAALLHGFRPVAQV

SEQ ID NO: 8298 - protein, 92 aa, Triticum aestivum
EFILYSQVPPRMARKDTCTYSITPAMAVPKTLQNVHSCENWLPRRVMSAWRIAGMVHALEGWNEHECGDIVLDMEKVWSGALLHGFRPVAQV

SEQ ID NO: 8299 - protein, 209 aa, Festuca arundinacea
GTRLNQAQSLNGSGELYLQKYPKLGVKLVDGTSLAAAVVVNSIPKGTDQVVLAGNISKVARAVAAALCKKNIKIIMTNKQDYHFLKPKIPEDAADNLLLSKTGTANVWVIGEGLDAAEQFRAPKGTRFIPYSQFPPRTVRKDCCAYSTTPAMSVPKTLQNVHSCENWLPRRVMSAWRIAGIVHALEGWNEHECGDMVLDMDKVWSAAIL

SEQ ID NO: 8300 - protein, 266 aa, Triticum aestivum
MGKLTIQSWAIPRYNFHYGLNLEKEAINSLVVKAICEADKKGAKVVSLGLLNQGQNLNGSGQLYLQKYPKLGVKLVDGTSLAAAVIANSIPQGTYQVVLAGDISKVARAVAQALCRKNIKVTMTNTQDYHFLKAKIPEDAAGNLSLLSKTGTAKVWLIGEGLDADEQLRAPKGTRFIPYSQFPPRKLHEECYTYSMTPAMCVPKTLQNVHSCENWLPRRVMSAWRIAGIVHALEGWNEHECGDTVLDMDKVWSAAISHGFRPVATD

SEQ ID NO: 8301 - protein, 523 aa, Carica papaya
MGSLPESEPQSSHGKPPGIRFIEYIKQSKLSYKTHQVIVLIVTFLAYTSYHAARKTTSVVKSTLDPQSSPSELGLKFFSWRVIYRDETAIGGGLSWKLGDGWFPFNRPDGTSLLGELDVAFLSVYALGMYFSGHLGDRMNLRIFLTVGMIGTGVFTSLFGVGYWANVHNFYYYLIAQMLAGLFQSTGWPSVVAVVGNWCGKKKRGLIMGIWNAHTSVGNITGSLVAAALLRYGWGWSFVAPGLLIAFIGIVVFLLLPVSPESVGADKNEDEMSSPRKPGEETREPLLNSGTELKEEAVGFLEAWKIPGVASFALCLFFAKLVAYTFLYWLPFYISHTAIEGKYLSSETAGNLSTLFDVGGVVGGILAGHISDRLDARAITAASFMYCAIPALFFYRSYGQLSLTMNIALMFITGMFVNGPYALITTAVSADLGTHSSLKGNSRALATVTAIIDGTGSVGAAIGPLLTGYISSKSWSAVFTMLMGAALIAGLLLTQLVVAEVAAKISESRSQERLTTRSSELNV

SEQ ID NO: 8302 - protein, 524 aa, Citrus sinensis
  misc_feature (28)..(28): Xaa can be any naturally occurring amino acid
  misc_feature (84)..(84): Xaa can be any naturally occurring amino acid
MGSLSEPAPQRSSRKPLGIRFLECIKGXNLSFKNHQAIVLIVTFFAYTSYHAARKTTSIVKSTLDPQSPDTSLKSLPWRISYLXEPAESRKLSWKLGDGWAPFNGSDGTALLGELDLAFLSIYAGGMFFSGHLGDRLDLRIFLTVGMVGTGLFTSLYGIGYWGNVHSFYYYLVVQMLAGLFQSTGWPSVVAVVGNWFGKSKRGLIMGIWNAHTSIGNITGSLVASALLTYGWGWSFVVPGLIIAFVGLIVFLFLPVNPQSVGTDTNEEDESLSPKKIGEGVTEPLLRRETEIEEKAVGFIEAWKIPGVAPFALCLFFAKLVAYTFLYWLPFYVSHTAVDGKYLSSEMAGNLSTFFDVGGVLGGILAGHISDRLDARAITAASFMYCAIPALFFYRSYGHLSLALNIALMFITGMFVNGPYALITTAVSADLGTHSSLKGNSRALATVTAIIDGTGSVGAAIGPLLTGYISATSWTAVFTMLMAAALISGLLLTRLVVAEVAAKFVESRSQSGNQSRSQAGVLDV

SEQ ID NO: 8303 - protein, 523 aa, Ricinus communis
MGSLSEPAAEGNKNKPYGIQFLECIKKNRLSYKTYQVIVLIVTFFAYASYHAARKTTSIVKSTLDPQSSEMGLKLYPWKITYLSEPVERRRFSWTLGDGWAPFNASDGTSLLGELDLAFLSVYAIGMYFSGHIGDRMNLRILLTIGMVGTGFFTSLFGVGYWANVHNFYYFLIAQMLAGLFQSTGWPSVVAVLGNWFGKRKRGLIMGIWNAHTSIGNISGSLIAAAMLSYGWGWSFVVPGLVIAFIGLVVLLLLPVDPESVGVERDEDDLHSPKKAGEEVTEPLLESDSEVKETAVGFIEAWKIPGVAPFALCLFFAKLVAYTFLYWLPFYISHTAIDGKYLSSDTAGNLSTLFDVGGVIGGILAGHISDRLNARAITAASFTYCAIPALFFYRSYGHISLAMNIALMFITGMFVNGPYALITTAVSADLGTHSSLKGNSRALATVTAIIDGTGSVGAAIGPLITGYISAKSWSAVFTMLMGAALIAGLLLTRLVVAEVAAKISESRSQASVASRTTATTLDV

SEQ ID NO: 8304 - protein, 340 aa, Manihot esculenta
  misc_feature (3)..(3): Xaa can be any naturally occurring amino acid
TAXPSVVAVVGDWFGKSKRGLIMGIWNAHTSIGNISGSLIASAMLSYGWGWSFVVPGFLIAFIGLMVFLVLPVSPDSVGIDRREDELHDPRKIGEEVTEPLLGSDSKVKGTAVGFIEAWKIPGVAPFALCLFFAKLVAYTFLYWLPFYISHTAIDGKYLSDGTAGNLSTLFDVGGVIGGILAGHISDRLDARAITAASFMYCAIPALFFYRSYGHISLGLNIALMFITGLFVNGPYALITTAVSADLGTHSSLKGNSRALATVTAIIDGTGSVGAAIGPLLTGYISAKSWSAVFTMLMAAALIAGLLLTRLVVAEVAAKIAESRSQTSAPSRTPAVQLDV

SEQ ID NO: 8305 - protein, 257 aa, Capsicum annuum
KDEDEVFSPRKEGEEVTEPLLRSDREEESAVGFIEAWKIPGVAPFALCLFFAKLVAYTFLYWLPFYISHTAIEGKYLSNEEAGNLSTLFDVGGVVGGILAGYISDRLDARAITAASFMYCAIPVLYFYRSYGHVSMTVNIILMLITGVFVNGPYALITTAVSADLGTHCSLKGNSRALATVTAIIDGTGSIGAAIGPLLTGYISANSWSAVFTMLMGSAFVAGLFLTRLVVAEVGAKIQQLGSQGSSPRSRSPDLLV

SEQ ID NO: 8306 - protein, 505 aa, Solanum phureja
MKKNNNKPLGIQLIENINKSSLSFKTYQVIVLIVTFFAYTSYHANRKTTSIVKQALDPQSLGVGPIFPWQGNSIRKSFRDGWFPFNGPDGTTLLGDLDVAFLFVYAIGMYFSGHMGDRMDLRVFLTVGMLGTGLFTALFGVGYWANIHSFYYYLIIQMIAGLFQSTGWPSVVAVVGNWFGKKKRGLIMGIWNAHTSVGNITGSLVASILLKYGWGWSMVVPGILIAFSGVVVFLLLPVHPESVGGNKDEDEVLLSPGKEDDEVNEQPLLRSRSDREEESCAVGFIEAWKIPGVAPFAVCLFFAKLVAYTFLYWLPYYISHTAIDGRYLSNEESGNLSTLFDVGGVIGGILAGYISDKLDARAITAASFMYCVIPALYLYRSYGHISMTINIILMLIAGVFVNGPYALITTAVSADLGTHSSLKGNSRALATVTAIIDGTGSIGAAVGPFLTGYISADSWNAVFVMLMGSALVAGLFLTRLVVTEVNGKIQELRSQGSSMSTNLQV

SEQ ID NO: 8307 - protein, 168 aa, Tropaeolum majus
LAFLSVYAFGMYFSGHLGDRTNLRKFLAVGMIGSGIFTSMFGLGYWANIHNFYYFLVVQMLAGLFQSTGWPSVVAVVGNWFGKKKRGLIMGVWNAHTSVGNITGSLIASAFLRYGWGWSFVVPGLLIAFVGVLLFLLLPVSPKSVGAEKMKMNWIVLEKLERTLLSLC

SEQ ID NO: 8308 - protein, 294 aa, Sorghum bicolor
MEDHSVHPMSKSNHGSLSGNGYEMKHSGKKVCDKDSSSESDQSHQEASAVSESSPAEHTSTQSDNDEDHGKDNQNTMKPVLSLGKEGSAFLAPKLDYSPSFAYIPYTADACYGGVGVLTGYAPHAIVHPQQNDTTNSPGILPVEPTEEEPIYVNAKQYHAILRRRQTRAKLEAQNKMVKGRKPYLHESRHRHAMKRARGSGGRFLNTKQLQEQNQQYQALSSSMCSKIIGNSLISQSGPTCTPSSDTAGASTASQDRSCLPSVGFRPMTNFSEQGGGGSKLIVNSMQQRVSTIR

SEQ ID NO: 8309 - protein, 300 aa, Zea mays
MPVILREMEDHSVHPMSKSNHGSLSGNGYEMKHSGHKVCDRDSSSESDRSHQEASAASESSPNEHTSTQSDNDEDHGKDNQDTMKPVLSLGKEGSAFLAPKLHYSPSFACIPYTSDAYYSAVGVLTGYPPHAIVHPQQNDTTNTPGMLPVEPAEEPIYVNAKQYHAILRRRQTRAKLEAQNKMVKNRKPYLHESRHRHAMKRARGSGGRFLNTKQLQEQNQQYQASSGSLCSKIIANSIISQSGPTCTPSSGTAGASTAGQDRSCLPSVGFRPTTNFSDQGRGGLKLAVIGMQQRVSTIR

SEQ ID NO: 8310 - protein, 437 aa, Zea mays
MLSTTREDNAIQRPESVSVRPPHRFQDLVETECQRWKSKGVNIKYEVRGNRKGYKAGALKEGLKHDYVADCEYIAMFDADFQPDSDFLLRTIPFLVHNPEIALVQARWKFVNSDECLLTRFQEMSLDYHFKYEQEAGSSVYSFFGFNGTAGVWRISAIDDAGGWKDRTTVEDMDLAVRAMLQGWKFLYVGDIKVKSELPSTFKAYRFQQHRWSCGPANLFKKMMVEILENKRVSLWSKIHLWYDFFFVGKVAAHTVTFIYYCFAIPVSVLFPEIQIPLWGVVYVPTVITLLKALGTPSSFHLVILWVLFENVMSLHRIKAAVSGLLDAGGRVNEWVVTEKLGDTSKAKPGTNGSDTAVKVIDVKLTEPLVPKLVKRRARFWERYHCSELFVGTCIILCGFYDLLFANKGYYIFLFLQGTAFLVVGFGYVGTLPPCTA

SEQ ID NO: 8311 - protein, 594 aa, Oryza sativa
MSSSGGGGVAEEVARLWGELPVRVVWAAVAAQWAAAAAAARAAVVVPAVRALVAVSLAMTVMILAEKLFVAAVCLAVRAFRLRPDRRYKWLPIGAAAAAASSEDDEESGLVAAAAAFPMVLVQIPMFNEREVYKLSIGAACSLDWPSDRVVIQVLDDSTDLVVKVFIVIYFTDISSRIIRSTSSLVIKDLVEKECQKWQGKGVNIKYEVRGNRKGYKAGALKEGLKHDYVKECEYIAMFDADFQPESDFLLRTVPFLVHNSEIALVQTRWKFVNANECLLTRFQEMSLDYHFKYEQEAGSSVYSFFGFNGTAGVWRIAAIDDAGGWKDRTTVEDMDLAVRATLQGWKFVYVGDVKVKSELPSTFKAYRFQQHRWSCGPANLFKKMMVEILENKKVSFWNKIHLWYDFFFVGKIAAHTVTFIYYCFVIPVSVWLPEIEIPLWGVVYVPTVITLCKAVGTPSSFHLVILWVLFENVMSLHRIKAAVTGILEAGRVNEWVVTEKLGDANKTKPDTNGSDAVKVIDVELTTPLIPKLKKRRTRFWDKYHYSEIFVGICIILSGFYDVLYAKKGYYIFLFIQGLAFLIVGFDYIGVCPP

SEQ ID NO: 8312 - protein, 569 aa, Brachypodium distachyon
MEGAGEEMARRLWAELPVRVDWAAVAAQCAYAWAQARAFLVVPAVRLLVFVSLAMTVMILLEKLFVAAVFLSVYKLSIGAACALEWPSDRVVIQVLDDSTDPVVKDAIAPDSPLISRLFLKLKINGPSGSHCIRQKDGGVRRLLGMAGGRMVAIVGEPERDLVEIECQRWKGKGVNIKYEVRGNRKGYKAGALKEGLKHDYVQECEYIAMFDADFQPESDFLMRTVPFLVHNPEIALVQTRWKFVNSDECLLTRFQEMSLDYHFKFEQEAGSVVYSFFGFNGTAGVWRISAIDDAGGWKDRTTVEDMDLAVRTALQGWKFVYVGDVKVRSELPSTFKAYRFQQHRWSCGPANLFKKMLMEILENKKVSFWNKIHLLYDFFFVGKIAAHTVTFMYYCFAIPLSVFFPEIQIPLWGVVYVPSVITLCKALGSPSSFHLVILWVLFENVMSLHRIKAAVTGLLDAGRVNEWVVTEKLGDASKIKPTIDVLDAVKVIDVELTTPLVPKLKKRRTRFWEKYNCSEIFVGTCIIISGCYDMLYAKKGYYIYLFIQGIAFLVVGFEYIGTRPPRTE

SEQ ID NO: 8313 - protein, 406 aa, Brachypodium distachyon
DLVEIECQRWKGKGVNIKYEVRGNRKGYKAGALKEGLKHDYVQECEYIAMFDADFQPESDFLMRTVPFLVHNPEIALVQTRWKFVNSDECLLTRFQEMSLDYHFKFEQEAGSVVYSFFGFNGTAGVWRISAIDDAGGWKDRTTVEDMDLAVRTALQGWKFVYVGDVKVRSELPSTFKAYRFQQHRWSCGPANLFKKMLMEILENKKVSFWNKIHLLYDFFFVGKIAAHTVTFMYYCFAIPLSVFFPEIQIPLWGVVYVPSVITLCKALGSPSSFHLVILWVLFENVMSLHRIKAAVTGLLDAGRVNEWVVTEKLGDASKIKPTIDVLDAVKVIDVELTTPLVPKLKKRRTRFWEKYNCSEIFVGTCIIISGCYDMLYAKKGYYIYLFIQGIAFLVVGFEYIGTRPP

SEQ ID NO: 8314 - protein, 379 aa, Panicum virgatum
HDYVKDCQYIAMFDADFQPESDFLLRTIPFLVHNPEIALVQARWKFVNSDECLLTRFQEMSLDYHFKYEQEAGSSVYSFFGFNGTAGVWRISAINDAGGWKDRTTVEDMDLAVRTMLRGWKFVYVGDIKVKSELPSTFKAYRFQQHRWSCGPANLFKKMMVEILENKKVSLWSKIHLWYDFFFVGKVAAHTVTFIYYCFAIPVSVLFPEIQIPLWGVVYIPTVITLLKALGTPSSFHLVILWVLFENVMSLHRIKAAVSGLLDAGGRVNEWVVTEKLGDANKTKPTINGSDSIKVIDVNLTELDVKLTEPLIPKIVKRQTRFWERYHCSELFVGMCIILCGCYDVFYAKKGYYIFLFLQGTAFLVAGFGYVGTRPPSTA

SEQ ID NO: 8315 - protein, 415 aa, Triticum aestivum
  misc_feature (14)..(14): Xaa can be any naturally occurring amino acid
  misc_feature (209)..(209): Xaa can be any naturally occurring amino acid
  misc_feature (298)..(298): Xaa can be any naturally occurring amino acid
DPAVKDLVEIECQXWKGKGVNIKYEVRGNRKGYKAGALKEGLKHDYVQECEFIAMFDADFQPESDFLLRTVPFLVHNPDIALVQTRWKFVNSDECLLTRFQEMSLDYHFKFEQEAGSIVYSFFGFNGTAGVWRISAIDDAGGWKDRTTVEDMDLAVRTALKGWKFVYVGAVKVRSELPSTFKAYRFQQHRWSCGPANLFKKMLVEILEXKKVSFWSKLHLLYDFFFVGKIAAHTVTFIYYCFAIPLSVFFPEIQIPLWGVVYVPTVITLCKALGSPSSFHLVILWVLFENVMSLHRIXAAVTGLLDAGRVNEWVVTEKLGDANKTKPATEVLDAVKVIDVELTTPLVPKLKKRRIRLWDKYNCSEIFVGTCIVICGFYDLFYANKGYYIYLFIQGLAFLVVGFEYIGTRPPTPSA

SEQ ID NO: 8316 - protein, 417 aa, Sorghum bicolor
MVDVEEVGNKMQSQMRLHAEPEDDAAADLPLPALFDRASRIHALASSSALDQDGIRTGVDLLRRCDEMVSKLGLFSPNETKEDVSTANLKYLLVPYYLAEMTEKIAQEDRIPVLKASQDHLKEFIALCEVLELIPEDELELSRQKQPDTMANRRAQKVARFKRQKAAETKLQEIRERKERRGRSLRAAALSAPIEAGEEDDLEDDGEEEREAWLATISLALCKAFDLLDMLKKEEEMLLAVKERKAKDGNAFAREMLDERTKKAEAWHHNAANRVVYSKPADPITCATFAQDVIEGRASVSQAHEHKHQPLIFGPASLVGGGLTSERERMAAQVFQPSYRMPTMSIEEAGLREMKIMEKWQERTAEIMKEANSAWHKDGTSSAQEDEDAEEAKARAWDDWKDDNPRGAGNKKLTPCG

SEQ ID NO: 8317 - protein, 416 aa, Zea mays
MVDVEETGNKLQSQMRLHAEPEDDAADLPLPALFDRASRLHALASSSALDQDGIRTGVDLLRRCDDMVSKLGLFSPNETKEDVSTANLKYLLVPYYLAEMTEKIAQEDRIPVLKTSQDHLKEFIALCEVLELIPEDELELSRQKQPDTMTNRRAQKVARFKRQKAAETKLQEIRERKERRGRSLRAAALSAPIEAGEEDDLENDGEEEREAWLATISLALCKAFDLLDMLKKEEEMLQAVKERKAKDGNAFAREMLDERTKKAETWHHNAANRVAYSKPADPITCATFAQDVIEGRASVSQAHEHKHQPLIFGPASIVGGGLTSERERMTAQVFQPSYRMPTMSIEEAGLREMKMMEKWQERTAELMKESTSAWHKDGSSSAQEDEDAEEEKARAWDDWKDDNPRGAGNKKLTPCG

SEQ ID NO: 8318 - protein, 417 aa, Saccharum officinarum
MVDMEEVRNKMQSQMRLHGEPEDDDAADLPLPALFDRASRLHALASSSALDQDGIHTGVDLLRRCDEMVSKLGLFSPNETKEDVSTANLKYLLVPYYLAEMTEKIAQEDRIPVLKASQDHLKEFIALCEVLELIPEDELELSRQKQPDTMANRRAQKVARFKRQKAAETKLQEIRERKERRGRSLRAAALSAPIEAGEEDDLEDDGEEEREAWLATISLAICKAFDLLDMLKKEEEMLLAVKERKAKDGNAFAREMLDERTKKAEAWHHNAANRVAYSKPADPITCATFAQDVIEGRASVSQAHEHKHQPLIFGPASLVGGGLTSERERMAAQVFQPSYRMPTMSIEEAGLREMKMMEKWQERTAEMMKEANSAWHKDGSSSAQEDEDAEEAKARAWDDWKDDNPRGAGNKKLTPCG

SEQ ID NO: 8319 - protein, 417 aa, Saccharum officinarum
MVDMEEVRNKMQSQMRLHGEPEDDDAADLPLPALFDRASRLHALASSSALDQDGIRTGVDLLRRCDEMVSKLGLFSPNETKEDVSTANLKYLLVPYYLAEMTEKIAQEDRIPVLKASQDHLKEFIALCEVLELIPEDELELSRQKQPDTMANRRAQKVARFKRQKAAETKLQEIRERKERRGRSLRAAALSAPIEAGEEDDLEDDGEEEREAWLATISLAICKAFDLLDMLKKEEEMLLAVKERKAKDGNAFAREMLDERTKKAEAWHHNAANRVAYSKPADPITCATFAQDVIEGRASVSQAHEHKHQPLIFGPASLVGGGLTSERERMAAQVFQPSYRMPTMSIEEAGLREMKMMEKWQERTAEMMKEANSAWHKDGSSSAQEDEDAEEAKARAWDDWKDDNPRGAGNKKLTPCG

SEQ ID NO: 8320 - protein, 423 aa, Zea mays
MVDVEEVGNKMQSQMRLHAEPDDAAADLPLPALFDRASRLHALASSSALDQDGIRTGVELLRRCDEMVGRLGLFSPNETKDDVSTANLKYLLVPYYLAEMTEKMAQEDRIPVLKASQDHLKEFIALCEVLELIPEDELELSRQKQSDTMANRRAQKVARFKRQKAAETKLQEIRERKERRGRSLRATALSAPVEAGEEDDLEDDGEEEREAWLATISLAICKAFDLLDMLKKEEEMLLAVKERKAKDGNAFAREMLDERTKKAEAWHHKAASRVAYSKPADPITCATFAQDVIEGRASVSQAHEHKHQPLIFGPASLVGGGLTSERERMAAQVFQPSYRMPTMSIEEAGLREMKMMERWQERTAEMMREANSAWHKGGDSSSSSMPQGEGGDEDAEEAKARAWDDWKDDNPRGAGNKKLTPCG

SEQ ID NO: 8321 - protein, 415 aa, Panicum virgatum
MVEVEEVGNKMQSQMRLHPEPEDDPDLPLPALFDRASRLHGLASSSALDQEGIRKGVELLRRCDEMVSKLGLFSTNETKEDVSTANLKYLLVPYYLGEMTEKIAQEDRIPILKASQNHLKEFIALCEALELIPEDELELSRQKQPDTMANRRAQKIARFRRQKAAETKLQEIKERKERRGRSLRAAALSAPVEAGEEDALEDDGEEEREAWLATISLALCKAFDLLDMLKKEEEMLLAVKERQEKDGNAFAREMLDERTQKAEAWHHNAANRAPYSKPADPITCATFAQDVLEGRASVSQAHEHKHQPLIFGPASLVGGGLTSERERMAAQVFQPGYRLPTMSIEEAGLREMKMMEKWQERTANMIKEANSAWHKDGTSSAQEDEDAEEAKARAWDDWKDDNPRGAGNKKLTPCG

SEQ ID NO: 8322 - protein, 129 aa, Pennisetum glaucum
TERIAQEDRIPILKSSQNHLKEFIALCEVLELIPQDELELSRQKQPDTMANRRAQKIARFKRQKAAETKLQEIKERKERRGRSLRAAALSAPVEAGEEDAFEDDGEEEREAWLATISLALCKAFDLLAC

SEQ ID NO: 8323 - protein, 418 aa, Oryza sativa
MVEVEEVSNKMQAQMRLHPAAAAEEEDADLPLPALFDKASHLHSLASSSSLDQEGIRKGVDLLRRCDEMVSKLGLFSSNETKDDVSTANLKYLLVPYYLGEMTERVAQEDRIPVLKASQDHLKEFISICEALELISEDELELSRQKQPDTMANRRAQKVARFKRQKAAETKLLEIKERKERRRRSLRAAALSAPIEAGEEDAFEDDGEEEREAWLATISLALCKAFDLLDMLKKEEEMLLAVKERQAKDGNAFAREMLDERTKKAEAWHHNAANRAPYSKPADPITCATFAQDVIEGRASVSQAHEHKHQPLIFGPASLVGGGLTSERERMAAQVFQPSYRLPTMSIEEAGLREMKMMEKWQERTAKMIQESNSAWHKDGSRSAQEDEDAEEEKARAWDDWKDDNPRGAGNKKLTPCG

SEQ ID NO: 8324 - protein, 415 aa, Panicum virgatum
MVEVEEVGNKMRSQMRLHPEPEDDADLPLPALFDRASRLHGLASSSALDQEGIRKGVELLRRCDEMVSKLGLFSTNETKEDVSTANLKYLLVPYYLGEMTEKIAQEDRIPILKASQNHLKEFIALCEVLELIPEDELELSRQKQPDTMANRRAQKIARFKRQKAAEMKLQEIKERKERRGRSLRASALSAPVEAGEEDALEDDGEEEREAWLATISLALCKAFDLLDMLKKEEEMLLDVKERQEKDGNAFAREMLDERTQKAEAWHQNAANRAPYSKPADPITCATFAQDVLEGRASVSQAHEHKHQPLIFGPASLVGGGLTTERERTAAKVFQPGYRLPTMSIEEAGLREMKMMEKWQERTANMIKEANSEWHKDGTNSAQEDEDAEEAKARAWDDWKDDNPRGAGNKKLTPCG

SEQ ID NO: 8325 - protein, 418 aa, Oryza sativa
MVEVEEVSNKMQVQMRLHPAAAAEEEDADLPLPALFDKASHLHSLASSSSLDQEGIRKGVDLLRRCDEMVSKVGLFSSNETKDDISTANLKYLLVPYYLGEMTERVAQEDRIPVLKASQDHLKEFISICEALELISEDELEISRQKQPDTMANRRAQKVARFKRQKAAETKLLEIKERKERRRRSLRAAALSAPIEAGEEDAFEDDGEEEREAWLATISLALCKAFDLLDMLKKEEEMLPAVKERKAKDGNAFAREMLDERTKRAEAWHHNAANRAPYSKPADPITCATFAQDVIEGRASVSQAHEHKHQPLIFGPASLVGGGLTSERERMAAQVFQPSYRLPTMSIEEAGLREMKMMEKWQERTAKMIQESNSAWHKDGSRSAQEDEDAEEEKARGWDDWKDDNPRGAGNKKLTPCG

SEQ ID NO: 8326 - protein, 417 aa, Avena sativa
MTEVEEVGNRMEAQLRLHAGPAAEDNGDLPLPALFERASHLHSLASSSSLDQEGIRTGIDLLRRCDEMVSKLGLFSSNETKEDVSTANLKYLLVPYYLGEMTEQVEQEDRIPVLKASQDHLKEFISICEALELIPEDELQSSRQGQSETPANRRAQKVARFKRQKAAETKLQEIKERKERRGRSLRAAALSAPIEAGEEDDFENDGEEEREAWLATISLALCKAFDLVDMLKKEEEMLLAVKERKEKDGNAFAREMLDERTQNAEAWHQNAASRAPYSKPAKPITCATFAQDVIEGRASVSQAHDHKHQPLIFGPASLVGGGLTSERERMAAQVFQPSYRMPTMSIEEAGLTEMKIMEEWQERTAKMIQEASSSWHKDDTSRAEDDEDAEEEKARAWDDWKDENPRGAGNKKLTPCG

SEQ ID NO: 8327 - protein, 419 aa, Brachypodium distachyon
MAEVEEVGSRMEAQLRLHAGPAAGEEDDGDLPLPVLFDRASHLHALASSSSLDQEGIRKGVDLLRQCDEMVSKLGLFSSNETKDDVSTANLKYLLVPYYLGEMTEQVDREDRIPVLKASQDHLKEFISICEALELIPEDELELSRQGQSETAANRRAQKVARFKRQKAAETKLQEIKQRKEKRGRSLRAATLSAPIEAGEEDDFEDGGEEEREAWLATIALALCKAFDLVDMLKKEEEMLLAVKERKEKDGNAFAREMLDERTQKAEAWHQNAASRAPYSKPADPITCAHFAQDVIEGRASVSQAHDHKHQPMIFGPASLVGGGLTSERERMAARVFQPSYRMPTMSIEEAGLTEMKIMEEWQANTAKMIQEASSSWHKDGTSSAQDDEDAEEEKARAWDDWKDENPRGAGNKKLTPCG

SEQ ID NO: 8328 - protein, 414 aa, Brachypodium distachyon
MAEVEEVGSRMEAQLRLHAGRGRRRSPAPRALRQGVHLQALGSSSSLDQEGIRKGVDLLRQCDEMVSKLGLFSSNETKDDVSTANLKYLLVPYYLGEMTEQVDREDRIPVLKASQDHLKEFISICEALELIPEDELELSRQGQSETAANRRAQKVARFKRQKAAETKLQEIKQRKEKRGRSLRAATLSAPIEAGEEDDFEDGGEEEREAWLATIALALCKAFDLVDMLKKEEEMLLAVKERKEKDGNAFAREMLDERTQKAEAWHQNAASRAPYSKPADPITCAHFAQDVIEGRASVSQAHDHKHQPMIFGPASLVGGGLTSERERMAARVFQPSYRMPTMSIEEAGLTEMKIMEEWQANTAKMIQEASSSWHKDGTSSAQDDEDAEEEKARAWDDWKDENPRGAGNKKLTPCG

SEQ ID NO: 8329 - protein, 414 aa, Triticum aestivum
MGEMEDVSNRMETQLRVHAAEDDADLPLPALFDRASHLHSLASSSSIDQEGIRKGVDLLRRCDDMVSKLGLFSSNETKEDVSTANLKYLLVPYYLGEMTEQVEQEDRIPVLKASQDHLKEFISVCEALELIPEDELQLYRQGQSETGANRRAQKVARFKRQKAAETKLQEIKERKERRGRSLRATALSAPIEAGEEDDLEADGEEEREAWLATISLALCKAFDLVDMLKKEEEMLLAVKERKEKDGNAFAREMLDERRQKAEAWHQNAASRAPYSKPAAPITCATFAQDVIEGRASVSQAHDHKHQPLIFGPASLVGGGLTSERERMAAQVFQPSFRMPTMSIEQAGLAEMKMMEQWQERTAKMIQEASSSWHKDDTSLAQDDEDAEEEKARAFDDWKDENPRGAGNKKLTPCG

SEQ ID NO: 8330 - protein, 378 aa, Cichorium intybus
MKFNLLNIYTLFSFALVASHAVTPEGYWKSVLPNSPMPKAIKDLLYTAEWSEEKSTAVGVGKGGVAVHTGKPGKRTNVGVRKGGVTVNTGKPGKGTSVGVGKGGVGVHAGKPGKRTDVGVGKGGVAVHTGHKGKPVYVGVGKGQNPFNYMYAASANQLNDNPNVAFFFLENDLHQGTEMKLHFTKDNQKATFLPRQVADSIPFSSNKLPQIYNEFSIKAGSVEAADMKQTLSECESKGIEGEDKYCATSLESMIDFSTTKLGKKVKAISTEVNTKESTPLQKYTIEGAKKLAADKAVVCHKQNYAYAVFYCHKTVSTRAYAVSLVGADGTKAKAVAICHTDTAKWNPKHLAFQVLKVKPGSVPVCHFLPEDHVVWVPY

SEQ ID NO: 8331 - protein, 65 aa, Taraxacum officinale
MKFNLLNICTLFSLALVASHAVTPDVYWKSVLPNSPMPKAIKDLVYTSESWSEEKTLKSELGKEV

SEQ ID NO: 8332 - protein, 257 aa, Petunia hybrida
MEFFRSLNATSILLVFLLSCFSFSSTDAFDALDPNGNITIKWDVISWTPDGYVATVSMFNFQQYRHIQAPGWTLGWTWAKKEVIWNMMGAQTTEQGDCSKFKGNIPHCCKKDPTVVDLLPGTPYNQQIANCCKGGVINSWGQDPATAVSSFQVSVGGSGTTNKTVRVPKNFTLKAPGPGYTCGPAKIVKPTKFVTNDGRRVTQAMMTWNITCTYSQFLAQKLQHAASLSHPSTMTQLYRARHALVAARRMALSLEIV

SEQ ID NO: 8333 - protein, 432 aa, Triphysaria pusilla
ITLFIFFVLFTSIAAYDPLDPNGNITIKWDIMSWTADGYVASVTMNNFQMYRHIMSPGWTVGWTWAKKEVIWSMIGSQTTEQGDCSKFKGNIPHCCKKIPTVVDLLPGVPYNQQFSNCCKGGVLAAWGQDPQASVSAFQISVGQAGTSNKTVKLPKNFTLLGPGPGYTCGPAKVAPPTNFLTADLRRKTQALMTWNVTCTYSQFMARKHPSCCVSFSTFYNETITSCPSCACGCENKNKCIKSDSKLLSMVGLNTPKKDNSPLLQCTHHMCPVRVHWHVKANYKDYWRVKVAITNFNYRMNYTQWTLVVQHPNLNNVTQVFSFDYKPLVPFGSINDTGMFYGTKFYNDLLMEAGPSGNVQSEVLMQKDKDTFSPKQGWAFPRRVYFNGEECMLPPPDSYPFLPNSSRPRRDSTSSLILSAAILSLITIVFLF

SEQ ID NO: 8334 - protein, 456 aa, Vitis vinifera
MEFFFTSIARSITKLSSYAILLVLLFSCSIFTSTEAYDSLDPEGNITIKWDVMSWTPDGYVAVVTMFNFQQYRHIQAPGWSLGWSWAKKEVIWSMMGGQTTEQGDCSRFKGNVPHCCKKDPTVVDLLPGTPYNQQIANCCKGGVINSWVQDPANAASSFQVSVGAAGTTNKTVKLPKNFTLRAPGPGYTCGPAKIVKPTKFTTADQRRVTQALMTWNVTCTYSQFLAQKTPTCCVSLSSFYNNTIVSCPTCTCGCQNNLTHPGSCVDPNNPYLASVVEGSGKTSYQPLVQCTSHMCPIRVHWHVKLNYKDYWRVKITITNFNYRMNYTQWNLVVQHPNFDNLTQIFSFNYKSLTPYAAINDTAMLWGVKFYNDLLSQAGPLGNVQSELLFRKDKATFTFDKGWAFPRRIYFNGDNCVMPPPDAYPWLPNASSRPTVSLLYSILTILAVSVIVLAYA

SEQ ID NO: 8335 - protein, 455 aa, Gossypium hirsutum
  misc_feature (2)..(2): Xaa can be any naturally occurring amino acid
MXNLFLFIARSFFNLSSFSFLLLFLLSFSSFTATEAYDPLDPNGNITIKWDIMSWTADGYVAVVTIFNFQQYRHIQAPGWTLGWKWSKKEVIWSMMGGQTTEQGDCSRFKGNIPHCCKKDPTVVDLLPGTPYNQQIANCCKGGVLNSWVQDPATAGSSFQVSVGQAGTTNKTVRVPKNFTLKAPGPGYTCGPAKIVKPSRFVTADKRRVTQALMTWNVTCTYSQFLAQKTPTCCVSLSSFYNETIVPCPQCACGCQNTSQPGSCVDPKAPHIASVVPSTGKNNYAPLVQCTSHMCPVRVHWHVKQNYKEYWRVKVTITNFNYNMNYTQWNLVVQHPNFDNLTQIFSFNYKSLTPYTAINDTAMLWGVKFYNDLLSQAGQLGNVQSELLFRKDKATFTFEKGWAFARRIYFNGDNCVMPPPDTYPWLPNGSSHQLISTLSLLTTLLAAMAFLLGYA

SEQ ID NO: 8336 - protein, 454 aa, Coffea canephora
MDSSCFRSLSKFTACAIVVLLSLSCFSFTTTEAYDALDPNGNITIKWDVMAWTPDGYVAVVTMFNFQQYRRIQAPGWTLGWTWAKKEVIWNMVGAQTTEQGDCSRFKGNIPHCCKKDPTVVDLLPGTPYNQQIANCCKGGVLNPWVQDPATAVSAFQVSVGSSGTTNKTVRMPKNFTLKAPGPGYTCGPAKVGKPTKFSTADGRRTTQAMMTWNVTCTYSQFLAQKTPSCCVSLSSFYNDTIVPCPTCTCGCQNNGSHPGSCVDADAPHLASVVSDHGKSNNLAPLIQCTSHMCPIRVHWHVKVNYKEYWRVKVTITNFNYRMNYSQWNLVVQHPNFDNLTQIFSFNFKPLTPYQAINDTAMLFGIKFYNDFLMEAGPYGNVQSELLFRKDKSTFTFDKGWAFPRRIYFNGDNCVMPPPDSYPYLPNGGSRRDISIVVLVTALLSSIAFFFTCL

SEQ ID NO: 8337 - protein, 297 aa, Phaseolus coccineus
  misc_feature (266)..(266): Xaa can be any naturally occurring amino acid
  misc_feature (269)..(269): Xaa can be any naturally occurring amino acid
MGFSLLPKATPCILLLVLLYCTCFTSTDAYDPLDPNGNITIKWDIITWTPDGYVAVVTMNNFQQYRHIASPGWRLGWTWAKKEVIWSMMGGQTTEQGDCSKFKAGIPHCCKKDPTVVDLLPGTPYNQQIANCCKGGVLGSWVQDPTNAVSSFQVSVGRAGTTNKTVKVPKNFTLSAPGPGYTCGPAKIVKPTQFIQADKRRVTQALMTWNVTCQYSQFLAQKTPSCCVSLSSFYNDTIVPCPTCACGCQGNSSLSGSCVNSQTPHXGIXLFLALGRITCHLWFNVLIICVQSESTGM

SEQ ID NO: 8338 - protein, 456 aa, Ricinus communis
MYFLFKPVMRTLSQFSILVLFLISCTTFTQTEAYDALDPTGNITIKWDIINWTPDGYVAVVTMYNFQQYRHIQAPGWTLGWTWAKKEVIWNMVGGQTTEQGDCSKFKGNIPHCCKKNPTVVDLLPGTPYNQQIANCCKGGVISSWGQDPSKAVSAFQLSVGAAGTTNKTVRVPKNFTLKAPGPGYTCGPAKIVRPSRFFTTDKRRVTQALMTWNVTCTYSQFLAQKTPTCCVSLSSFYNNTIVPCPTCACGCQSNSSLSGGCVDPDAPHLASVVSGSGKNSPAPLVQCTRHMCPVRIHWHVKLNYREYWRVKITITNFNYNMNYSQWNLVVQHPNFDNLTQIFSFNYKSLNPYAAINDTAMLWGVQFYNDLLMQAGPSGNVQSELLFQKDKTTFTFEKGWAFPRRIYFNGDNCVMPPPDAYPWLPNAGSRQFSPPLVLTITLLSALAFLNFLVFQP

SEQ ID NO: 8339 - protein, 448 aa, Glycine max
MGFFLLPKATPCILFLALLSCTCFTSTDAYDPLDPNGNITIKWDIISWTPDGYVAVVTMNNFQQYRHIASPGWSMGWTWAKKEVIWSMMGGQTTEQGDCSKFKGGIPHCCKKDPTVVDLLPGTPYNQQIANCCKGGVLSSWVQDPTNAVSSFQVSVGRAGTTNRTVKVPKNFTLKAPGPGYTCGPAKIVAPTKFITSDKRRVTQALMTWNVTCTYSQFLAQKTPSCCVSLSSFYNDTLVPCLTCACGCQSNSSQSGTCVDPDTPHLASVVAGSGKNNFSPLVQCTHHMCPVSIHWHVKLNYKEYWRVKVTITNYNYRMNYSEWNMVVQHPNFDNLTQLFSFNYKSLTPYGSINDTAMLWGVKFYNDFLNQAGPNGNVQSELLFRKDKATFTFDKGWAFPRRIYFNGDNCVMPPPDAYPWLPNAGARQEVSLFALVIASLVALVFYAPA

SEQ ID NO: 8340 - protein, 448 aa, Glycine max
MGFSLLPKATPCILFLALLFCTCFTSTDAYDPLDPNGNITIKWDIISWTPDGYVAVVTMNNFQQYRHIASPGWSMGWTWAKKEVIWSMMGGQTTEQGDCSKFKGGIPHCCKKDPTVVDLLPGTPYNQQIANCCKGGVLSSWAQDPTNAVSSFQVSVGRAGTTNKTVKVPKNFTLKAPGPGYTCGPAKIVAPTKFITSDKRRVTQALMTWNVTCTYSQFLAQKTPSCCVSLSSFYNDTLVPCPTCACGCQSNSSRSGTCVDPDTPHLASVVAGSGKNNFSPLVQCTRHMCPVRIHWHVKLNYKEYWRVKVTITNFNYRMNYSEWNMVVQHPNFDNLTQLFSFNYKSLTPYGSINDTAMLWGVKFYNDFLNQAGPNGNVQSELLFRKDKATFTFDKGWAFPRRVYFNGDNCVMPPPDSYPWLPNAGARQEVSLFSLVIASLVALVFYAHA

SEQ ID NO: 8341 - protein, 449 aa, Tragopogon dubius
MDYCFRSLTRLSISTIVLAILLSSFSFTCTEAYDALDPNGNITIKWDIISWTPDGYVAVVTMYNFQQYRHISPPGWTLGWTWAKKEVIWSMMGSQTTEQGDCSKFKSAPPHCCKKTPTVVDLLPGTPYNQQIANCCKGGVINSWAQDPNNYASSFQVSVGGAGTTNKTVKPPKNFTLLAPGPGYTCGPAVVGKPTKFITSDGRRVTQAMMTWNVTCTYSQFLAQKTPTCCVSLSSFYNETIVPCPTCTCGCQNNATHPGSCVNPNSPYLASVVNGPGKNSLTPLVQCTKHMCPIRIHWHVKLNYKEYWRVKVTITNFNYRMNYSQWNLVLQHPNFDNLTQIFSFNYKPLTPYSSINDTAMLWGVKFYNDFLNQAGPLGNVQSELLFRKDKSTFTFEKGWAFPRRIYFNGDNCVMPPPDAYPYLPNATSRLSFSLFTLLMASLAFFFCSV

SEQ ID NO: 8342 - protein, 456 aa, Castanea mollissima
MESLSLSASGSITKLSSFAVLFVVVFLCSSFTSTEAYDALDPTGNITIKWDVISWTPDGYVATVTMYNFQQYRHIQAPGWTLGWTWAKKEVIWSMMGGQTTEQGDCSRFKGNVPHCCKKDPTVVDLLPGTPYNQQIANCCKGGVLNSWVQDPSNAASSFQVSVGAAGTTNKTVKLPKNFTLKAPGPGYSCGPAKIVRPSKYLTADKRRVTQALMTWNVTCTYSQFLAQKTPTCCVSLSSFYNDTIVNCPTCTCGCQNNITEPGSCVNPDSPYLASAVSGPGKSSNAPLVQCTSHMCPIRVHWHVKLNYKDYWRVKITITNFNYRMNYTQWNLVVQHPNFDNLTQLFSFQYKSLTPYAGLNDTAMLWGVKFYNDFLSQAGPYGNVQSELLFRKDQSTFTFEKGWAFPRRIYFNGDNCVMPPPDAYPWLPNAGSRPLSSLLHSAFTILSSLVFLLAFA

SEQ ID NO: 8343 - protein, 456 aa, Citrus sinensis
MESLRGSVTGSITSKLSGFTILLLFLLSCSTFTSTEAYDALDPNGNITIKWDIMSWTPDGYVAVVTIFNFQQYRHIQAPGWTLGWTWAKKEVIWSMMGGQTTEQGDCSKYKGNIPHCCKKDPTVVDLLPGTPYNQQIANCCKGGVISSWAQDPTTALSSFQLSVGAAGTTNKTVRVPKNFTLKAPGPGYTCGPAKVGKPTKFITSDKRRVTQAMMTWNVTCTYSQFLAQKTPTCCVSLSSFYNETIVSCPTCACGCQNNGTESGSCINPKTPHLASVVNTPGKPNRPMVQCTSHMCPIRVHWHVKLNYKEYWRVKITITNFNYAMNYSLWNLVVQHPNFDNLTQLFSFYYKSLTPYEGLNDTAMLWGIKFYNDFLSEAGPNGNVQSELLFRKDASTFTFEKGWAFPRRIYFNGDNCVMPPPDAYPWLPNASSRPVISLLRSAIIILASWVFLLAYA

SEQ ID NO: 8344 - protein, 455 aa, Cucumis sativus
MRSRRFASTGSVADLTVIAVLVLFLLSSFSFTSTEAYDALDPNGNITIKWDVMSWTPDGYVAVVTMYNFQQYRHIQAPGWTLGWTWAKKEVIWSMMGSQTTEQGDCSRFKGNTPHCCKKDPTVVDLLPGTPYNQQIANCCKGGVINSWAQDPANAASSFQVSVGSAGTSNKTVKLPKNFTLKAPGPGYTCGPAKIVRPTKFVSGDKRRVTQALMTWNVTCTYSQFLAQKTPTCCVSLSSFYNDTIVNCPTCTCGCQNNTAGSGSCVDPDSPFLASVVSAPDKSGNNPPLVQCTSHMCPIRVHWHVKLNYKDYWRVKITITNFNYRMNYTLWNLVVQHPNFDNITKLFSFNYKSLSPYGDLNDTAMLWGVKFYNDLLNQAGPLGNVQSELLFQKDQNTFTFDKGWAFPRRVYFNGDNCVMPPPEAYPYLPNASSRPAISLLVTILISLALLLNFAQ

SEQ ID NO: 8345 - protein, 500 aa, Coffea canephora
  misc_feature (154)..(154): Xaa can be any naturally occurring amino acid
  misc_feature (156)..(156): Xaa can be any naturally occurring amino acid
  misc_feature (188)..(188): Xaa can be any naturally occurring amino acid
  misc_feature (190)..(190): Xaa can be any naturally occurring amino acid
  misc_feature (214)..(214): Xaa can be any naturally occurring amino acid
  misc_feature (245)..(245): Xaa can be any naturally occurring amino acid
VVLVLTKDSSPPRFLYRLLFSLCFPTNIHFGAKSGAVAKQESLLLKTNMDSSCFRSLSTACAIVVLLSLSCFSFTTTEAYDALDPNGNITIKWDVITWTPDGYVAVVTMFNFQQYRRIQAPGWTLGWTWAKKEVIWNMVGAQTTEQGDCSRFKXNXPHCCKKDPTVVDLLPGTPYNQQIANCCKGGVXNXWVQDPATAVSAFQVSVGSSGTTNXTVRMPKNFTLKAPGPGYTCGPAKVGKPTKFXTADGRRTTQAMMTWNVTCTYSQFLAQKTPSCCVSLSSFYNDTIVPCPTCTCGCQNNGSHPGSCVDADAPHLASVVSDHGKSNNLAPLIQCTSHMCPIRVHWHVKVNYKEYWRVKVTITNFNYRMNYSQWNLVVQHPNFDNLTQIFSFNFKPLTPYQAINDTAMLFGIKFYNDFLMEAGPYGNVQSELLFRKDKSTFTFDKGWAFPRRIYFNGDNCVMPPPDSYPYLPNGGSRRDISIVVLVTALLSSIAFFFTCL

SEQ ID NO: 8346 - protein, 448 aa, Lotus japonicus
MGFSLSSTAASTCILFLFLLSCTCFTSTDAYDPLDPNGNITIKWDITTWTSDGYVAVVTMNNFQQYRHITAPGWSLGWTWAKKEVIWSMVGGQTTEQGDCSKFKGSIPHCCKKDPTVVDLLPGTPYNMQFSNCCKGGVLSSWAQDPTNAVASFQVSVGRAGTTNKTVKVPKNFTLKAPGPGYTCGPAKIVTPTKFIQPDKRRVTQALMTWNVTCTYSQFLAQKTPTCCVSLSSFYNDTIVPCPTCACGCQSNSSRSGSCIEADTPHLASVVAGSGKNTPLVQCTRHMCPVRIHWHVKVNYKEYWRVKVTITNFNYKMNYSEWNLVAQHPNFDNLTQLFSFNYKSLTPYGSINDTALLWGVKFYNDFLNEAGPSGNVQSEILFRKDKSTFTFEKGWAFPRRIYFNGDNCVMPSPDAYPWLPNAGSRQEVSLFALVMASLVAVVLCFAQA

SEQ ID NO: 8347 - protein, 279 aa, Cichorium intybus
MDCFRSLARLSISTVVLAILLSSFSFTCTEAYDALDPNGNITIKWDIISWTPDGYVAVVTMYNFQQYRHISPPGWTLGWTWAKKEVIWSMMGSQTTEQGDCSRYKSAPPHCCKKTPTVVDLLPGTPYNQQIANCCKGGVINSWAQDPNNYASSFQVSVGAAGTTNKTVKPPKNFTLLAPGPGYTCGPAVVGKPTKFITADGRRVTQAMMTWNVTCTYSQFLAQKTPTCCVSLSSFYNDTIVPCPTCTCGCQNNATHPGSCVNPNSLYLASVVNGPGKNS

SEQ ID NO: 8348 - protein, 241 aa, Helianthus annuus
MMTWNVTCTYSQFLAQKTPTCCVSLSSFYNETIVPCPTCTCGCQNNATHPGSCVNPNSPYLASVVNGPGKNSFTPLVQCTKHMCPIRVHWHVKLNYKEYWRVKVTITNFNYRMNYSQWNLVVQHPNFDNLTQIFSFNYKPLTPYSSINDTAMLWGVKFYNDFLNQAGPLGNVQSELLFRKDKSTFTFEKGWAFPRRIYFNGDNCVMPPPDAYPYLPNAGSRLSFSLLALLMACSAVFFVFV

SEQ ID NO: 8349 - protein, 450 aa, Helianthus annuus
MDYCFIRSLTRLSVSTIVLAILLSSLSFTCTEAYDALDPNGNITIKWDIISWTPDGYVAVVTMYNFQQYRHISPPGWTLGWTWAKKEVIWSMMGSQTTEQGDCSKYKSAQPHCCKKTPTVVDLLPGTPYNQQIANCCKGGVINSWAQDPNNYASSFQVSVGAAGTTNKTVKPPKNFTLLAPGPGYTCGPAVVGKPTKFITPDGRRVTQAMMTWNVTCTYSQFLAQKTPTCCVSLSSFYNETIVPCPTCTCGCQNNITHPGSCVDAHSPYLASVVNGPGKNTLTPLVQCTKHMCPIRVHWHVKLNYKEYWRVKVTITNFNYRMNYSQWNLVVQHPNFDNLTQIFSFNYKPLTPYSSINDTAMLWGVKFYNDFLNQAGPLGNVQSELLFRKDKSTFTFEKGWAFPRRIYFNGDNCVMPPPDAYPYLPNASSRLRFSLFTIMSTCLAVFFVFV

SEQ ID NO: 8350 - protein, 449 aa, Artemisia annua
MDYCFRSLTRLSLSTIVVAILLSSFSFTSTEAYDALDPNGNITIKWDIISWTPDGYVAVVTMYNFQQYRHVSPPGWTLGWTWAKKEVIWSMMGAQTTEQGDCSRYKSAPPHCCKKTPTVVDLLPGTPYNQQIANCCKGGVINSWAQSPDNYASSFQVSVGAAGTTNKTVKPPKNFTLLAPGPGYTCGPGVVGKPTKFITADGRRVTQAMMTWNVTCTYSQFLAQKTPTCCVSLSSFYNETIVPCPTCTCGCQNNITHPGSCVNPNSPYLASVVNGPGKNSLTPLVQCTKHMCPIRVHWHVKLNYKEYWRVKVTITNFNYRMNYSQWNLVAQHPNFDNLTQIFSFNYKPLTPYSSINDTAMLWGVKFYNDFLNQAGPLGNVQSELLFRKDKSTFTFEKGWAFPRRIYFNGDNCVMPPPDAYPYLPNASSRLSFSLLTLLATSLAFFFAFV

SEQ ID NO: 8351 - protein, 208 aa, Artemisia annua
  misc_feature (205)..(205): Xaa can be any naturally occurring amino acid
MDYCFRSLTRLSLSTIVVAILLSSFSFTSTEAYDALDPNGNITIKWDIISWTPDGYVAVVTMYNFQQYRHVSPPGWTLGWTWAKKEVIWSMMGAQTTEQGDCSRYKSAPPHCCKKTPTVVDLLPGTPYNQQIANCCKGGVINSWAQSPDNYASSFQVSVGAAGTTNKTVKPPKNFTLLAPGPGYTCGPGVVGKPQSSLLQMEEEXLKL

SEQ ID NO: 8352 - protein, 264 aa, Solanum tuberosum
MAREPLLNKREEKHYYENCPGCKMDLHKAGQTGLPIKELFTIWVVVLGTALPISSLFPFIYFMVRDFHIAKREEDIGSYAGYVGSAYMFGRTLTSAFWGVVADRYGRKPVIIFGTSIVVVFNTLFGLSTNFWMAVITRFLLGSLNGLLAPIKAYAAEIFREEYQALGMSTISTAWGIGLIIGPALGGFLAQPAEKYPDLFSKDSLFGRFSLFSCPCLCISVFALVVAVGSFWIPETLHNHDSERPCQDSLQGLLEAAIRYKRRK

SEQ ID NO: 8353 - protein, 379 aa, Capsicum annuum
MASIAQNGHVNGDVVAIDFCKKSIHDPLNWEMAAESLKGSHLDEVKKMVDEFRKPIVKLGGETLTVAQVASIANADNKTCGAKVELSERARAGVKASSDWVMDSMCKGTDSYGVTTGFGATSHRRTKNGGALQKELIRFLNAGVFGNGTESCHTLPHSATRAAMLVRINTLLQGYSGIRFEILEAITKLINSNITPCLPLRGTITASGDLVPLSYIAGLLTGRPNSKAVGPNGEKLNAEEAFRVAGVSGGFFELQPKEGLALVNGTAVGSGMASMVLFESNILAVMSEVLSAIFAEVMNGKPEFTDHLTHKLKHHPGQIEAAAIMEHILDGSSYVKAAQKLHEMDPLQKPKQDRYALRTSPQWLGPQIEVIRAATKMIE

SEQ ID NO: 8354 - protein, 436 aa, Solanum phureja
MELCKKSINVHDPLNWEMAADSLRGSHLDEVKKMVDEFRKPIVKLGGETLTVAQVASIANADNKSNGVKVELSESSRAGVKASSDWVMDSMSKGTDSYGVTTGFGATSHRRTKNGGALQKELIRFLNAGVFGNGTESSHTLPHSATRAAMLVRINTLLQGYSGIRFEILEAITKLINSNITPCLPLRGTVTASGDLVPLSYIAGLLTGRPNSKAVGPNGEKLDADEAFRVAGVSGGFFELQPKEGLALVNGTAVGSGMASIVLYDSNILAVMSEVLSAIFAEVMNGKPEFTDYLTHKLKHHPGQIEAAAIMEHILDGSSYVKAAQKLHEMDPLQKPKQDRYALRTSPQWLGPQIEVIRAATKMIEREINSVNDNPLIDVSRNKALHGGNFQGTPIGVSMDNTRLALASIGKLMFAQFSELVNDYYNNGLPSNLTAG

SEQ ID NO: 8355 - protein, 280 aa, Solanum tuberosum
MASIAQNGHVNGEVVAMELCKKSINVDDPLNWEMAADSLRGSHLDEVKKMVDEFRKPIVKLGGETLTVAQVASIANADNKSNGVKVELSESARAGVKASSDWVMDSMSKGTDSYGVTTGFGATSHRRTKNGGALQKELIRFLNAGVFGNGTESSHTLPHSATRAAMLVRINTLLQGYSGIRFEILEAITKLINSNITPCLPLRGTITASGDLVPLSYIAGLLTGRPNSKAVGPNGEKLNAEEAFRVAGVTGGFFELQPKEGLALVNGTAVGSGMASMVLF

SEQ ID NO: 8356 - protein, 343 aa, Petunia hybrida
MAPTTQNGHANGHVNGHEDMELCKTSADPLNWEMAAESLKGSHLDEVKKMVNEFRKPIVKLGGETLTVAQVAAIASIARENDIKVELSEEARAGVKASSDWVMDSMGKGTDSYGVTTGFGATSHRRTKNGGALQKELIRFLNAGVFGNGTESSHTLPHSATRAAMVVRINTLLQGYSGIRFEILEAITKLINSNITPCLPLRGTITASGDLVPLSYIAGLLTGRPNSKAVGPNGEKLNAEEAFRVAGVTGGFFELQPKEGLALVNGTAVGSGMASMVLFESNVLAVMSEVLSAIFAEVMNGKPEFTDHLTHKLKHHPGQIEAAAIMEHILDGSAYVTAAHKLL

SEQ ID NO: 8357 - protein, 327 aa, Artemisia annua
MENGHANGVAKELCIKDPLNWGVAAEALTGSHLDEVKKMVAEFRKPVVKLGGETLTVSQVAGIAASENTGVKVELSESARAGVKASSDWVMESMGKGTDSYGVTTGFGATSHRRTKNGGALQKELIRFLNAGIFGNGTESNHTLPHSATRAAMLVRINTLLQGYSGIRFEILEAITKFLNTNVTPCLPLRGTITASGDLVPLSYIAGLLTGRPNSKAVGPDGQILNAEKAFSLAGVDGGFFELQPKEGLALVNGTAVGSGMASMVLFEANVLALLSEVLSAIFAEVMQGKPEFTDHLTHKLKHHPGQIEAAAIMEYILDGSDYVKAA

SEQ ID NO: 8358 - protein, 318 aa, Artemisia annua
MGPKQVTLSHIQQHERQCLLELTLSSRVTQASVLRSWKQSPSSSTTMLLLVYHFVGPSPLLVTWSHCPTLQDFRPNSKAVGPTGEILTAEKAFAQAGVEGGFFELQPKEGLALVNGTAVGSGMASMVLFEANVLALLSEVLSAIFAEVMQGKPEFTDHLTHKLKHHPGQIEAAAIMEYILDGSDYVKAAQKVHEMDPLQKPKQDRYALRTSPQWLGPQIEVIRSATKMIEREINSVNDNPLIDVSRNKALHGGNFQGTPIGVSMDNTRLAIAAIGKLMFAQFSELVNDFYNNGLPSNLSGGRNPSLDYGFKGGEIAMF

SEQ ID NO: 8359 - protein, 283 aa, Lactuca sativa
MENGHVNGVATEFCIKDPLNWGVAAEALKGSHLDEVKRMVKEFRKPVVKLGGETLTVSQVAGIAAAGDSSTVKVELSETARAGVKASSDWVMESMNKGTDSYGVTTGFGATSHRRTKQGGALQKELIRFLNAGIFGNGTESSHTLPHSATRAAMLVRINTLLQGYSGIRFEILEAITKFLNTNVTPCLPLRGTITASGDLVPLSYIAGLLTGRPNSKAVGPNGEILNAEKAFNLAGVTGGFFELQPKEGLALVNGTAVGSGMASMVLFEANVLALLSEVCRLS

SEQ ID NO: 8360 - protein, 255 aa, Papaver somniferum
VHVVVGTPGRVFDMLRRQALRADCIKMFVLDEADEMLSRGFKDQIYDIFQLLPSKVQVGVFSATMPPEALEITRKFMDKPVRILVKRDELTLEGIKQFYVNVEKEEWKLETLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTKDDERMLFDIQKFYNVVIEELPSNVADLL

SEQ ID NO: 8361 - protein, 291 aa, Brassica napus
QIEKVMRALGDYLGVKVHACVGGTSVREDQRILQAGVHVVVGTPGRVFDMLKRQSLRADHIKMFVLDEADEMLSRGFKDQIYDIFQLLPPKIQVGVFSATMPPEALEITRKFMSKPVRILVKRDELTLEGIKQFYVNVEKEDWKLETLCDLYETLAITQSVIFVNTRRKVDWLTDKMRGRDHTVSATHGDMDQNTRDIIMREFRSGSSRVLITTDLLARGIDVQQVSLVINYDLPTQPENYLHRIGRSGRFGRKGVAINFVTKDDERMLFDIQKFYNVVVEELPSNVADLL

SEQ ID NO: 8362 - protein, 150 aa, Solanum melongena
EWKLETLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTRDDERMLFDIQKFYNVVIEELPANVADLL

SEQ ID NO: 8363 - protein, 127 aa, Solanum melongena
NTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTKDDERMLFDIQKFYNVVIEELPANVADLL

SEQ ID NO: 8364 - protein, 166 aa, Sorghum bicolor
MQVVLWLGGKIIVDDQGHLLNINTTSKQVGGDEHTRGTRPELPHDDVSSVLVHVTVSGRDSVVPAPHLVSEPVHLAAGVDEDDTLGDGQGLVQVTQCVQLPVFLLHIHIELLDTLKSQLISLHKDSDRLVHELAGDLKGLRGHGSREDSNLNLGWKKLEDKSLPDP

SEQ ID NO: 8365 - protein, 54 aa, Solanum lycopersicum
MNTALKDALILTDTGTPNTSMNLHTQVVTKCSHNLLNLLCKLTGWCKNQSLTLN

SEQ ID NO: 8366 - protein, 73 aa, Solanum lycopersicum
VQINNSKQPPNPKLFGHFQKQNNTKTRQNLQLFTLNKYIRLLLVGKEQFPLTEPKPPQRRSATLAGSSSITTL

SEQ ID NO: 8367 - protein, 172 aa, Brassica juncea
LVKRDELTLEGIKQFYVNVEKEEWKLETLCDLYETLAITQSVIFVNTRRKVDWLTDKMRGRDHTVSATHGDMDQNTRDIIMREFRSGSSRVLITTDLLARGIDVQQVSLVINYDLPTQPENYLHRIGRSGRFGRKGVAINFVTKDDERMLFDIQKFYNVVVEELPSNVADLL

SEQ ID NO: 8368 - protein, 195 aa, Brassica oleracea
FSATMPPEALEITRKFMSKPVRILVKRDELTLEGIKQFYVNVEKEEWKLETLCDLYETLAITQSVIFVNTRRKVDWLTDKMRGRDHTVSATHGDMDQNTRDIIMREFRSGSSRVLITTDLLARGIDVQQVSLVINYDLPTQPENYLHRIGRSGRFGRKGVAINFVTKDDERMLFDIQKFYNVVVEELPSNVADLL

SEQ ID NO: 8369 - protein, 213 aa, Brassica napus
DQIYDIFQLLPPKIQVGVFSATMPPEALEITRKFMSKPVRILVKRDELTLEGIKQFYVNVEKEDWKLETLCDLYETLAITQSVIFVNTRRKVDWLTDKMRGRDHTVSATHGDMDQNTRDIIMREFRSGSSRVLITTDLLARGIDVQQVSLVINYDLPTQPENYLHRIGRSGRFGRKGVAINFVTKDDERMLFDIQKFYNVVVEELPSNVADLL

SEQ ID NO: 8370 - protein, 164 aa, Brassica napus
LEGIKQFYVNVEKEEWKLETLCDLYETLAITQSVIFVNTRRKVDWLTDKMRGRDHTVSATHGDMDQNTRDIIMREFRSGSSRVLITTDLLARGIDVQQVSLVINYDLPTQPENYLHRIGRSGRFGRKGVAINFVTKDDERMLFDIQKFYNVVVEELPSNVADLL

SEQ ID NO: 8371 - protein, 216 aa, Brassica napus
GFKDQIYDIFQLLPPKIQVGVFSATMPPEALEITRKFMSKPVRILVKRDELTLEGIKQFYVNVEKEEWKLETLCDLYETLAITQSVIFVNTRRKVDWLTDKMRGRDHTVSATHGDMDQNTRDIIMREFRSGSSRVLITTDLLARGIDVQQVSLVINYDLPTQPENYLHRIGRSGRFGRKGVAINFVTKDDERMLFDIQKFYNVVVEELPSNVADLL

SEQ ID NO: 8372 - protein, 263 aa, Brassica napus
DQRILQAGVHVVVGTPGRVFDMLKRQSLRADNIKMFVLDEADEMLSRGFKDQIYDIFQLLPPKIQVGVFSATMPPEALEITRKFMSKPVRILVKRDELTLEGIKQFYVNVEKEDWKLETLCDLYETLAITQSVIFVNTRRKVDWLTDKMRGRDHTVSATHGDMDQNTRDIIMREFRSGSSRVLITTDLLARGIDVQQVSLVINYDLPTQPENYLHRIGRSGRFGRKGVAINFVTKDDERMLFDIQKFYNVVVEELPSNVADLL

SEQ ID NO: 8373 - protein, 200 aa, Brassica napus
IQVGVFSATMPPEALEITRKFMSKPVRILVKRDELTLEGIKQFYVNVEKEEWKLETLCDLYETLAITQSVIFVNTRRKVDWLTDKMRGRDHTVSATHGDMDQNTRDIIMREFRSGSSRVLITTDLLARGIDVQQVSLVINYDLPTQPENYLHRIGRSGRFGRKGVAINFVTKDDERMLFDIQKFYNVVVEELPSNVADLL

SEQ ID NO: 8374 - protein, 332 aa, Manihot esculenta
QQAQSGTGKTATFCSGILQQLDYGLVQCQALVLAPTRELAQQIEKVMRALGDYLGVKVHACVGGTSVREDQRILQAGVHVVVGTPGRVFDMLRRQSLRPDYIRMFVLDEADEMLSRGFKDQIYDIFQLLPAKVQVGVFSATMPPEALEITRKFMNKPVRILVKRDELTLEGIKQFYVNVEKEEWKLETLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRGGRFGRKGVAINFVTRDDERMLFDIQKFYNVVIEELPSNVADLL

SEQ ID NO: 8375 - protein, 260 aa, Manihot esculenta
  misc_feature (95)..(95): Xaa can be any naturally occurring amino acid
ILQAGVHVVVGTPGRVFDMLRRQSLRPDYIRMFVLDEADEMLSRGFKDQIYDIFQLLPAKVQVGVFSATMPPEALEITRKFMNKPVRILVKRDEXTLEGIKQFYVNVEKEEWKLETLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRGGRFGRKGVAINFVTRDDERMLFDIQKFYNVVIEELPSNVADLL

SEQ ID NO: 8376 - protein, 199 aa, Gossypium hirsutum
QVGVFSATMPPEALEITRKFMNKPVRILVKRDELTLEGIKQFYVNVEKEEWKLETLCDLYETLAITQSVIFVNTRRKVDWLTDKMRSRDHTVSATHGDMDQNTRDVIMREFRSGSSRVLITTDLLARGIDVQQVSLVINYDLPTQPENYLHRIGRSGRFGRKGVAINFVTLDDERMLFDIQKFYNVVIEELPSNVADLL

SEQ ID NO: 8377 - protein, 220 aa, Petunia hybrida
MLSRGFKDQIYDIFQLLPPKIQVGVFSATMPPEALEITRKFMNKPVRILVKRDELTLEGIKQFYVNVEKEEWKLETLCDLYETLAITQSVIFVNTRRKVDWLTDKMRGRDHTVSATHGDMDQNTRDIIMREFRSGSSRVLITTDLLARGIDVQQVSLVINYDLPTQPENYLHRIGRSGRFGRKGVAINFVTKDDERMLFDIQKFYNVVIEELPANVADLL

SEQ ID NO: 8378 - protein, 201 aa, Solanum tuberosum
KNPSGCFSATMPPEALEITRKFMNKPVRILVKRDELTLEGIKQFYVNVDKEEWKLETLCDLYETLAITQSVIFVNTRRKVDWLTDKMRGRDHTVSATHGDMDQNTRDIIMREFRSGSSRVLITTDLLARGIDVQQVSLVINYDLPTQPENYLHRIGRSGRFGRKGVAINFVTKDDERMLFDIQKFYNVVIEELPANVADLL

SEQ ID NO: 8379 - protein, 214 aa, Raphanus sativus
KDQIYDIFQLLPPKIQVGVFSATMPPEALEITRKFMSKPVRILVKRDELTLEGIKQFYVNVEKEDWKLETLCDLYETLAITQSVIFVNTRRKVDWLTDKMRGRDHTVSATHGDMDQNTRDIIMREFRSGSSRVLITTDLLARGIDVQQVSLVINYDLPTQPENYLHRIGRSGRFGRKGVAINFVTKDDERMLFDIQKFYNVVVEELPSNVADLL

SEQ ID NO: 8380 - protein, 201 aa, Raphanus sativus
KIQVGVFSATMPPEALEITRKFMSKPVRILVKRDELTLEGIKQFYVNVEKEDWKLETLCDLYETLAITQSVIFVNTRRKVDWLTDKMRGRDHTVSATHGDMDQNTRDIIMREFRSGSSRVLITTDLLARGIDVQQVSLVINYDLPTQPENYLHRIGRSGRFGRKGVAINFVTKDDERMLFDIQKFYNVVVEELPSNVADLL

SEQ ID NO: 8381 - protein, 180 aa, Juglans hindsii x Juglans regia
FMNKPVRILVKRDELTLEGIKQFYVNVDKEEWKLETLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTKDDERMLFDIQKFYNVVVEELPSNVADLL

SEQ ID NO: 8382 - protein, 101 aa, Brassica rapa
MDQNTRDIIMREFRSGSSRVLITTDLLARGIDVQQVSLVINYDLPTQPENYLHRIGRSGRFGRKGVAINFVTKDDERMLFDIQKFYNVVVEELPSNVADLL

SEQ ID NO: 8383 - protein, 101 aa, Nicotiana benthamiana
MDQNTRDIIMREFRSGSSRVLITTDLLARGIDVQQVSLVINYDLPTQPENYLHRIGRSGRFGRKGVAINFVTKDDERMLFDIQKFYNVVIEELPANVADLL

SEQ ID NO: 8384 - protein, 296 aa, Cleome spinosa
RELAQQIEKVMRALGDYLGVKVHACVGGTSVREDQRILQAGVHVVVGTPGRVFDMLRRQSLRPDYIKMFVLDEADEMLSRGFKDQIYDIFQLLPPKIQVGVFSATMPPEALEITRKFMNKPVRILVKRDELTLEGIKQFYVNVEKEEWKLETLCDLYETLAITQSVIFVNTRRKVDWLTDKMRSRDHTVSATHGDMDQNTRDIIMREFRSGSSRVLITTDLLARGIDVQQVSLVINFDLPTQPENYLHRIGRSGRFGRKGVAINFVTRDDERMLFDIQKFYNVVVEELPSNVADLL

SEQ ID NO: 8385 - protein, 73 aa, Cucumis sativus
EICNIGWQLLNDHIIELLNIKKHSLIIICNKIDGNTLSSKTPTSTNSMEVIFRLGRQIIIYDKGHLLNIDTTS

SEQ ID NO: 8386 - protein, 194 aa, Solanum melongena
SATMPPEALEITRKFMNKPVRILVKRDELTLEGIKQFYVNVDKEEWKLETLCDLYETLAITQSVIFVNTRRKVDWLTDKMRSRDHTVSATHGDMDQNTRDIIMREFRSGSSRVLITADLLARGIDVQQVSLVINYDLPTQPENYLHRIGRSGRFGRKGVAINFVTKDDERMLFDIQKFYNVVIEELPANVADLL

SEQ ID NO: 8387 - protein, 143 aa, Eschscholzia californica
CDLYETLAITQSVIFVNTRRKVDWLTDKMRSRDHTVSATHGDMDQNTRDIIMREFRSGSSRVLITTDLLARGIDVQQVSLVINFDLPTQPENYLHRIGRSGRFGRKGVAINFVTKDDERMLFDIQKFYNVVVEELPSNVADLL

SEQ ID NO: 8388 - protein, 195 aa, Unknown
  Sequence found in Organisms: Ipomoea nil, Ipomoea nil
FSATMPPEALEITRKFMNKPVRILVKRDELTLEGIKQFHVNVDKEEWKLETLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTKDDERMLFDIQKFYNVMIEELPANVADLL

SEQ ID NO: 8389 - protein, 208 aa, Rhizophora mangle
IFQLLPPKIQVGVFSATMPPEALEITRKFMNKPVRILVKRDELTLEGIKQFYVNVEKEEWKLETLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTKDDERMLFDIQRFYNVIIEELPSNVADLL

SEQ ID NO: 8390 - protein, 161 aa, Rhizophora mangle
IKQFYVNVDKEEWKLETLCDPYETLAITQSVIFVNTRRKVDWLTDKMRSRDHTVSATHGDMDQNTRDIIMREFRSGSSRVLITTDLLARGIDVQQVSLVINYDLPTQPENYLHRIGRGGRFGRKGVAINFVTKDDERMLFDIQKFYNVVIEELPANVADLL

SEQ ID NO: 8391 - protein, 86 aa, Solanum phureja
SSNKQNSNNQIQSYLDTSKNKITKTRQNLQLFTLNKYIRLLPVGKEQFPSQSQNHLKGDQQHWLGAPQLQRCKTFECQKASFRHPW

SEQ ID NO: 8392 - protein, 89 aa, Solanum phureja
MRHYFFIQNKHLDVVGAKRLPAQHVKYTTRSTNNHMNTTLKDTLILTDTGTSYTGMNLHTKIVTKCSHNLLNLLGKLTGWSQNQSLTFD

SEQ ID NO: 8393 - protein, 89 aa, Solanum lycopersicum
MRHYIFIQNKHLDVVRAKRLPTQHIKYTTRSTNNHMNTTLKDTLILTDTGTSYTGMNLHTKIVTKCSHNLLNLLGKLTGWSQNQSLTFD

SEQ ID NO: 8394 - protein, 254 aa, Brassica juncea
YVVVGTPGRVFDMLRRQSLRSDSIKMFVLDEADEMLSRGFKDQIYDIFQLLPPKIQVGVFSATMPPEALEITRKFMSKPVRILVKRDELTLEGIKQFYVNVEKEEWKLETLCDLYETLAITQSVIFVNTRRKVDWLTDKMRSRDHTVSATHGDMDQNTRDIIMREFRSGSSRVLITTDLLARGIDVQQVSLVINFDLPTQPENYLHRIGRSGRFGRKGVAINFVTRDDERMLFDIQKFYNVVVEELPSNVADLL

SEQ ID NO: 8395 - protein, 179 aa, Musa acuminata
MNKPVRILVKRDELTLEGIKQFHVNVEKEEWKLETLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTRDDERMLFDIQRFYNVVIEELPSNVADLI

SEQ ID NO: 8396 - protein, 124 aa, Hordeum vulgare
RKVDWLTDKMRGRDHTVSATHGDMDQNTRDIIMREFRSGSSRVLITTDLLARGIDVQQVSLVINYDLPTQPENYLHRIGRSGRFGRKGVAINFVTREDERMLFDIQKFYNVVIEELPANVADLL

SEQ ID NO: 8397 - protein, 165 aa, Eucalyptus gunnii
AGEGIKQFYVNVDKEEWKLDTLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVNKDDERMLFDIQKFYNVVVEELPSNVADLL

SEQ ID NO: 8398 - protein, 157 aa, Zingiber officinale
MVNVEKDEWKLDTLCDLYETLAITQSVIFVNTRRKVDWLTDQMRGRDHTVSATHGDMDQNTRDIIMREFRSGSSRVLITTDLLARGIDVQQVSLVINYDLPTQPENYLHRIGRSGRFGRKGVAINFVSHDDERMLFDIQKFYNVVIEELPSNVADLI

SEQ ID NO: 8399 - protein, 253 aa, Leymus cinereus x Leymus triticoides
VVVGTPGRVFDMLRRQSLRPDNIKMFVLDEADEMLSRGFKDQIYDIFQLLPSKIQVGVFSATMPPEALEITRKFMNKPVRILVKRDELTLEGIKQFYVNVEKEEWKLDTLCDLYETLAITQSVIFVNTRRKVDWLTDKMRGRDHTVSATHGDMDQNTRDIIMREFRSGSSRVLITTDLLARGIDVQQVSLVINYDLPTQPENYLHRIGRSGRFGRKGVAINFVTREDERMLFDIQKFYNVVIEELPANVADLL

SEQ ID NO: 8400 - protein, 166 aa, Zea mays
MQVVLWLGGKIIVDDQGHLLNINTTSKQVSGDEHTGGARPELPHDDVSSVLVHVTMSGRNGVVPAPHLVSEPVHLAAGVDKDDTLGNGQGLIQVTQCVQLPVFLVHIHIELLDTLKGQLISLHKNSHWFVHELAGNLKGFRWHGSREDSNLNLGWQKLEDKCLPDP

SEQ ID NO: 8401 - protein, 191 aa, Elaeis guineensis
  misc_feature (15)..(15): Xaa can be any naturally occurring amino acid
MPPEALEITRKFMNXPVRILVKRDELTLEGIKQFYVNIEREEWKLETLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTRDDERMLFDIQRFYNVVIEELPSNVADLI

SEQ ID NO: 8402 - protein, 159 aa, Ananas comosus
QFYVNVEKEEWKLETLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTQDDERMLFDIQRFYNAVIEELPSNVADLL

SEQ ID NO: 8403 - protein, 261 aa, Populus trichocarpa
MAGLAPEGSQYDAKQYDAKMNDLLANDGQDFFTMYEEVFETFDSMGLQENLLRGIYAYGFEKPSAIQQRGIVPFCKGLDVIQQAQSGTGKTATFCSGILQQLDYGLVQCQALVLAPTRELAQQIEKVMRALGDYLGVKVHACVGGTSVREDQRILQAGVHVVVGTPGRVFDMLRRQSLRQDYIKMFVLDEADEMLSRGFKDQIYDIFQLLPSKVQVGVFSATMPPEALEITRKFMNKPVRILVKRDELTLEGIKQFYVQCR

SEQ ID NO: 8404 - protein, 179 aa, Solanum tuberosum
MNKPVRILVKRDELTLEGIKQFYVNVDKEEWKLETLCDLYETLAITQSVIFVNTRRKVDWLTDKMRGRDHTVSATHGDMDQNTRDIIMREFRSGSSRVLITTDLLARGIDVQQVSLVINYDLPTQPENYLHRIGRSGRFGRKGVAINFVTKDDERMLFDIQKFYNVVVEELPANVADLL

SEQ ID NO: 8405 - protein, 184 aa, Pseudoroegneria spicata
ITRKFMNKPVRILVKRDELTLEGIKQFYVNVEKEEWKLDTLCDLYETLAITQSVIFVNTRRKVDWLTDKMRGRDHTVSATHGDMDQNTRDIIMREFRSGSSRVLITTDLLARGIDVQQVSLVINYDLPTQPENYLHRIGRSGRFGRKGVAINFVTREDERMLFDIQKFYNVVIEELPANVADLL

SEQ ID NO: 8406 - protein, 265 aa, Raphanus sativus
REDQRILQAGVHVVVGTPGRVFDMLRRQSLRSDSIKMFVLDEADEMLSRGFKDQIYDIFQLLPPKIQVGVFSATMPPEALEITRKFMSKPVRILVKRDELTLEGIKQFYVNVEKEEWKLETLCDLYETLAITQSVIFVNTRRKVDWLTDKMRSRDHTVSATHGDMDQNTRDIIMREFRSGSSRVLITTDLLARGIDVQQVSLVINFDLPTQPENYLHRIGRSGRFGRKGVAINFVTRDDERMLFDIQKFYNVVVEELPSNVADLL

SEQ ID NO: 8407 - protein, 354 aa, Sorghum bicolor
KVSNIGRQLLNHHIVELLDVKQHPLVVAGHKVDGNTLPTETTTTTNAMQVVLWLGGKIIVDDQGHLLNINTTSKQVGGDEHTRGTRPELPHDDVSSVLVHVTVSGRDSVVPAPHLVSEPVHLAAGVDEDDTLGDGQGLVQVTQCVQLPVFLLHIHIELLDTLKSQLISLHKDSDRLVHELAGDLKGLRGHGSREDSNLNLGWKKLEDVVNLHFHQRKEHFISFIKHKHLDVIRAEGLPTQHVKNTTRCTNNNMHTTGKNPLILTDRCSSHTCMDLNTQVVTKCAHDFLNLLCKLTGGSKDQGLAFHQAIIKLLQDPRTESCCFSCTRLCLLNDIKPLAEGNNSSLLNCRRLLKT

SEQ ID NO: 8408 - protein, 212 aa, Nicotiana tabacum
QIYDIFQLLPPKIQVGVFSATMPPEALEITRKFMSKPVRILVKRDELTLEGIKQFYVNVDKEEWKLETLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTKDDERMLFDIQKFYNVVIEELPANLADLL

SEQ ID NO: 8409 - protein, 279 aa, Triticum aestivum
LGVKVHACVGGTSVREDQRILASGVHVVVGTPGRVFDMLRRQSLRPDNIKMFVLDEADEMLSRGFKDQIYDIFQLLPGKIQVGVFSATMPPEALEITRKFMNKPVRILVKRDELTLEGIKQFYVNVEKEEWKLDTLCDLYETLAITQSVIFVNTRRKVDWLTDKMRGRDHTVSATHGDMDQNTRDIIMREFRSGSSRVLITTDLLARGIDVQQVSLVINYDLPTQPENYLHRIGRSGRFGRKGVAINFVTREDERMLFDIQKFYNVVIEELPANVADLL

SEQ ID NO: 8410 - protein, 241 aa, Triticum aestivum
LRRQSLRPDNIKMFVLDEADEMLSRGFKDQIYDIFQLLPSKIQVGVFSATMPPEALEITRKFMNKPVRILVKRDELTLEGIKQFYVNVEKEEWKLDTLCDLYETLAITQSVIFVNTRRKVDWLTDKMRGRDHTVSATHGDMDQNTRDIIMREFRSGSSRVLITTDLLARGIDVQQVSLVINYDLPTQPENYLHRIGRSGRFGRKGVAINFVTREDERMLFDIQKFYNVVIEELPANVADLL

SEQ ID NO: 8411 - protein, 75 aa, Triticum aestivum
MCCCGGSLVSRGRRCWRWSVFLFISTLFKTMYDRMMVFICVILDSYSAATRCIVPCVCSTFFAALSKPFYSVELV

SEQ ID NO: 8412 - protein, 100 aa, Musa acuminata
DQNTRDIIMREFRSGSSRVLITTDLLARGIDVQQVSLVINYDLPTQPENYLHRIGRSGRFGRKGVAINFVTRDDERMLFDIQKFYNVVIEELPSNVADLI

SEQ ID NO: 8413 - protein, 190 aa, Arabidopsis lyrata
MPPEALEITRKFMSKPVRILVKRDELTLEGIKQFYVNVEKEEWKLETLCDLYETLAITQSVIFVNTRRKVDWLTDKMRSRDHTVSATHGDMDQNTRDIIMREFRSGSSRVLITTDLLARGIDVQQVSLVINFDLPTQPENYLHRIGRSGRFGRKGVAINFVTHDDERMLFDIQKFYNVVVEELPSNVADL

SEQ ID NO: 8414 - protein, 130 aa, Cicer arietinum
IFVNTRRKVDWLTDKMRSNDHTVSATHGDMDQNTRDIIMREFRSGSSRVLITTDLLARGIDVQQVSLVINYDLPTQPENYLHRIGRSGRFGRKGVAINFVTMDDTRMLADIQKFYNVSIEELPSNVADLL

SEQ ID NO: 8415 - protein, 280 aa, Cleome spinosa
YLGVKVHACVGGTSVREDQRILQAGVHVVVGTPGRVFDMLRRQSLRPDHIKMFVLDEADEMLSRGFKDQIYDIFQLLPPKIQVGVFSATMPPEALEITRKFMNKPVRILVKRDELTLEGIKQFYVNVEKEEWKLETLCDLYETLAITQSVIFVNTRRKVDWLTDKMRSRDHTVSATHGDMDQNTRDIIMREFRSGSSRVLITTDLLARGIDVQQVSLVINFDLPTQPENYLHRIGRSGRFGRKGVAINFVTRDDERMLYDIQKFYNVVVEELPSNVADLL

SEQ ID NO: 8416 - protein, 137 aa, Cleome spinosa
LAITQSVIFVNTRRKVDWLTDQMRARDHTVSATHGDMDQNTRDIIMREFRSGSSRVLITTDLLARGIDVQQVSLVINYDLPTQPENYLHRIGRSGRFGRKGVAINFVTRDDERMLADIQKFYNVVIEELPANVADLI

SEQ ID NO: 8417 - protein, 194 aa, Unknown
  Sequence found in Organisms: Ipomoea nil, Ipomoea nil
SATMPPEALEITRKFMNKPVRILVKRDELTLEGIKQFYVNVDKEEWKLDTLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTKDDERMLFDIQKFYNVLVEELPANVADLL

SEQ ID NO: 8418 - protein, 197 aa, Lactuca sativa
GVFSATMPPEALEITRKFMNKPVRILVKRDELTLEGIKQFYVNVEKEEWKLETLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTLDDERMLADIQKFYNVVVEELPSNVADLI

SEQ ID NO: 8419 - protein, 126 aa, Pennisetum glaucum
TRRKVDWLTDKMRSRDHTVSATHGDMDQNTRDIIMREFRSGSSRVLITTDLLARGIDVQQVSLVINYDLPTQPENYLHRIGRSGRFGRKGVAINFVTRDDDRMLFDIQRFYNVVIEELPANVADLL

SEQ ID NO: 8420 - protein, 130 aa, Cajanus cajan
IFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTKDDERMLGDIQKFYNVIIEELPSNVAELL

SEQ ID NO: 8421 - protein, 186 aa, Cajanus cajan
AGITRKFMNKPVRILVKRDELTLEGIKQFFVNVDKEEWKLETLCDLYETLAITQSVIFVNTRRKVDWLTDKMRGRDHTVSATHGDMDQNTRDIIMREFRSGSSRVLITTDLLARGIDVQQVSLVINYDLPTQPENYLHRIGRSGRFGRKGVAINFVTKDDERMLLDIQKFYNVVIEELPANVADLI

SEQ ID NO: 8422 - protein, 137 aa, Salvia sclarea
TRITQSVIFVNTRRKVDWLTDKMRGRDHTVSATHGDMDQNTRDIIMREFRSGSSRVLITTDLLARGIDVQQVSLVINYDLPTQPENYLHRIGRSGRFGRKGVAINFVTKDDERMLFDIQKFYNVTVEELPANVADLL

SEQ ID NO: 8423 - protein, 192 aa, Salvia sclarea
TMPPEALEITRKFMNKPVRILVKRDELTLEGIKQFYVNVDKEEWKLETLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRLGRKGVAINFVTKDDERMLFDIQKFYNVVVEELPANVADLL

SEQ ID NO: 8424 - protein, 219 aa, Solanum phureja
CTCILCLQIYDIFQLLPPKIQVGVFSATMPPEALEITRKFMNKPVRILVKRDELTLEGIKQFYVNVDKEEWKLETLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTKDDERMLSDIQRFYNVVIEELPANVADLL

SEQ ID NO: 8425 - protein, 174 aa, Musa acuminata
RILVKRDELTLEGIKQFYVNVEKEEWKLETLCDLYETLAITQSVIFVNTRRKVDWLTDKMRSRDHTVSATHGDMDQNTRDIIMREFRSGSSRVLITTDLLARGIDVQQVSLVINYDLPTQPEDYLHRIGRSGRFGRKGVAINFVTVDDERMLFDIQRFYNVVIEELPSNVADLI

SEQ ID NO: 8426 - protein, 227 aa, Ocimum basilicum
CWMRLMKCSPGVFEDQIYDIFQLLPPKIQVGVFSATMPPEALEITRKFMNKPVRILVKRDELTLEGIKQFYVNVDKEEWKLETLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTKDDERMLFDIQKFYNVLVEELPANVADLL

SEQ ID NO: 8427 - protein, 233 aa, Centaurea maculosa
  misc_feature (36)..(36): Xaa can be any naturally occurring amino acid
  misc_feature (174)..(174): Xaa can be any naturally occurring amino acid
MAGVAPEGSQFDTRQFDSKMNELLSTDGQDFFTSYXEVYESFDAMGLQENLLRGIYAYGFEKPSAIQQRGIVPFCKGLDVIQQAQSGTGKTATFCSGILQQLDYNVVECQALVLAPTRELAQQIEKVMRALGDYLGVKVHACVGGTSVREDQRILSAGVHVVVGTPGRVFDMLXSSHFVLITLRCLCWMKPMKCFPEVSRIRSTISSNCCHQRSKSECSPPPCLPSPRDHPQS

SEQ ID NO: 8428 - protein, 58 aa, Cichorium intybus
QRILSAGVHVVVGTPGRVFDMLRRQSLRPDYINMFVLDEADEMLSRGFKDQVIFHTQF

SEQ ID NO: 8429 - protein, 198 aa, Cucumis melo
  misc_feature (87)..(87): Xaa can be any naturally occurring amino acid
  misc_feature (118)..(118): Xaa can be any naturally occurring amino acid
  misc_feature (123)..(123): Xaa can be any naturally occurring amino acid
  misc_feature (152)..(152): Xaa can be any naturally occurring amino acid
MAGLAPEGSQFDARQYDTKMNELLSADGQDFFTSYDEVYDSFDSMGLQENLLRGIYAYGFEKPSAIQQRGIVPFCKGLDVIQQAQSXTGKTATFCSGILQQLDYGLVQCQALVLAPTXELAQXIEKVMRALGDYLGVKVHACVGGTSVREDXRILQAGVHVVVGTPGRVFDMLRRQSLRPDYIRMFVLDEADEMLSRI

SEQ ID NO: 8430 - protein, 239 aa, Arachis hypogaea
RQSLQPDHIKMFVLDEADEMLSRGFKDQIYDIFQLLPSKIQVGVFSATMPPEALEITRKFMNKPVRILVKRDELTLEGIKQFYVNCEREEWKLDTLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTKDDERMLFDIQKFYNVQIEELPANVAELL

SEQ ID NO: 8431 - protein, 201 aa, Saccharum officinarum
KIQVGVFSATMPPEALEITRKFMNKPVRILVKRDELTLEGIKQFYVNVEKEDWKLDTLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTRDDERMLFDIQRFYNVTIEELPANVADLL

SEQ ID NO: 8432 - protein, 156 aa, Panicum virgatum
VNVEKEDWKLDTLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTRDDERMLFDIQRFYNVLIEELPANVADLL

SEQ ID NO: 8433 - protein, 211 aa, Zamia vazquezii
IYDIFQLLPTKIQVGVFSATMPPEALEITRKFMHKPVRILVKRDELTLEGIKQFYVNVDKEDWKLDTLCDLYETLAITQSVIFVNTRRKVDWLTDKMRARDHTVSATHGDMDQNTRDIIMREFRSGSSRVLITTDLLARGIDVQQVSLVINYDLPTQPENYLHRIGRSGRFGRKGVAINFVTRDDERMLQDIQRFYNVTIEELPSNVADLL

SEQ ID NO: 8434 - protein, 101 aa, Eschscholzia californica
MDQNTRDIIMREFRSGSSRVLITTDLLARGIDVQQVSLVINYDLPTQPENYLHRIGRSGRFGRKGVAINFVTNDDERMLSDIQRFYNVVVEELPSNVADLL

SEQ ID NO: 8435 - protein, 101 aa, Ocimum basilicum
MDQNTRDIIMREFRSGSSRVLITTDLLARGIDVQQVSLVINYDLPTQPENYLHRIGRSGRFGRKGVAINFVTKDDERMLFDIQKFYNVLVEELPANVADLL

SEQ ID NO: 8436 - protein, 361 aa, Brachypodium distachyon
MLFDIQKFYNVGWELFNHHVVELLDVKQHPLIFTGHKVDGNTLPTKTTTTTDAMEVVLWLGRKIIVDDQGHLLHINTTSKQVGGNEHTGRTRSELPHDDVPSVLVHVTMSGRNCVVPAPHLISEPVHLAAGVHKDDTLGDGKGLVQVTECVELPLFLLHIDIELLDTLKGKLIPLHKDPHRLVHELTSDLKGLRGHCSREDSNLNLSGEQLEDSVYLILETSGKHLISFIQDKHLDVIRAQRLPTQHVEDTTRCSNNNMHPTCKNSLILTNRSSSNTCMNFHTQVVTKCTHNLLNLLRKLTGGSKYQGLALNQTIVKLLQDSRAEGSSLSCSRLCLLNNIKPLAERNNSPLLDGRRLLKTY

SEQ ID NO: 8437 - protein, 137 aa, Cicer arietinum
VVSTQSVIFVNTRRKVDWLTDKMRGNDHTVSATHGDMDQNTRDIIMREFRSGSSRVLITTDLLARGIDVQQVSLVINYDLPTQPENYLHRIGRSGRFGRKGVAINFVTLDDARMLSDIQKFYNVTVEELPSNVADLL

SEQ ID NO: 8438 - protein, 245 aa, Gerbera hybrid cultivar
SVREDQRILSAGVHVVVGTPGRVFDMLSRGFKDQIYDIFQLLPSKVQVGVFSATMPPEALEITRKFMNKPVRILVKRDELTLEGIKQFYVNVEKEEWKLETLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTADDERMLADIQKFYNVMVEELPSNVADLI

SEQ ID NO: 8439 - protein, 304 aa, Lotus japonicus
QALVLAPTRELAQQIEKVMRALGDYLGVKVHACVGGTSVREDQRILQAGVHTVVGTPGRVFDMLRRQSLRPDSIKMFVLDEADEMLSRGFKDQIYDIFQLLPGKIQVGVFSATMPPEALEITRKFMNKPVRILVKRDELTLEGIKQFYVNVEKEEWKLETLCDLYETLAITQSVIFVNTRRKVDWLTDKMRSNDHTVSATHGDMDQNTRDIIMREFRSGSSRVLITTDLLARGIDVQQVSLVINYDLPTQPENYLHRIGRSGRFGRKGVAINFVTLDDSRMLSDIQKFYNVTVEELPSNVADLL

SEQ ID NO: 8440 - protein, 146 aa, Tropaeolum majus
ETLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVSINFVTTEDDRMLADIQKFYNVIIEELPSNVADLL

SEQ ID NO: 8441 - protein, 159 aa, Avena sativa
QFYVNVDKEEWKLETLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVSINFVTLDDARMLADIQKFYNVTIEELPSNVADLL

SEQ ID NO: 8442 - protein, 346 aa, Orobanche aegyptiaca
QRGIVPFCKGLDVIQQAQSGTGKTATFCSGILQQLDYNVVECQALVLAPTRELAQQIEKVMRALGDYLGVKVHACVGGTSVREDQRILSSGVHVVVGTPGRVFDMLRRQSLRPDYIKMFVLDEADEMLSRGFKDQIYDIFQLLPPKIQVGVFSATMPPEALEITRKFMNKPVRILVKRDELTLEGIKQFYVNVDKEEWKLETLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTKDDDRMLFDIQKFYNVMVEELPANVADLL

SEQ ID NO: 8443 - protein, 124 aa, Pisum sativum
RKVDWLTDYMRSRDHTVSATHGDMDQNTRDIIMREFRSGSSRVLITTDLLARGIDVQQVSLVINYDLPTQPENYLHRIGRSGRFGRKGVSINFVTLDDARMLADIQKFYNVTIEELPSNVADLL

SEQ ID NO: 8444 - protein, 91 aa, Physcomitrella patens
MPRANRSVVINTREDPERNSRMMISRVFWSMSPTSFTNNQHVIRCCLPRILSVNQSTFRRVLMKITLWVIAKVSYRSHRVSNFHSSRSTFT

SEQ ID NO: 8445 - protein, 157 aa, Cajanus cajan
YVNVDKEDWKLDTLCDLYETLAITQSVIFVNTRRKVDWLTDKMRSRDHTVSATHGDMDQNTRDIIMREFRFGSSRVLITTDLLARGIDVQQVSLVINYDLPTQPENYLHRIGRSGRFGRKGVAINFVTKDDEKMLYDIQKFYNVVIEELPSNVAELL

SEQ ID NO: 8446 - protein, 190 aa, Phaseolus coccineus
PPEALEITRKFMNRPVRILVKRDELTLEGIKQFYVNVDKEEWKLETLCDLYETLAITQSVIFVNTRRKVDWLTDKMRSNDHTVSATHGDMDQNTRDIIMREFRSGSSRVLITTDLLARGIDVQQVSLVINYDLPTQPENYLHRIGRSGRFGRKGVAINFVTFDDSRMLSDIQKFYNVTVEELPSNVADLL

SEQ ID NO: 8447 - protein, 219 aa, Trifolium pratense
LSRGFKDQIYDIFQLLPPKIQVGVFSATMPPEALEITRKFMNKPVRILVKRDELTLEGIKQFYVNVDKEEWKLETLCDLYETLAITQSVIFVNTRRKVDWLTDKMRGRDHTVSATHGDMDQNTRDIIMREFRSGSSRVLITTDLLARGIDVQQVSLVINYDLPTQPENYLHRIGRSGRFGRKGVAINFVTLDDARMLSDIQKFYNVIVEELPSNVADLL

SEQ ID NO: 8448 - protein, 219 aa, Cynara scolymus
  misc_feature (198)..(198): Xaa can be any naturally occurring amino acid
  misc_feature (217)..(218): Xaa can be any naturally occurring amino acid
YDRFDAMRLQENPLRGIYAYGFEKPSAIQQRGIVPFCKGLDVIQQAQSVTGKTATFCSGILQQLDYNVVECQALVLAPTRELAQQIEKVMRALGDYLGVKVHACVGGTSVREDQRILSAGVHVVVGTPGRVFDMLRRQSLRADYIKMFVLDEADEMLSRGFKDQIYDIFQLLPSKVQVGVFSATMPPEALEITRKFMXQPVRILVSAMNSLSKVSNXXT

SEQ ID NO: 8449 - protein, 436 aa, Allium cepa
MAGMAEEGSQFDAKKFDSKMNDLLTADGQDFFTSYDEVYDSFDSMGLQENLLRGIYAYGFEKPSAIQQRGIVPFCKGLDVIQQAQSGTGKTATFCSGILQQLDYSLIECQALVLAPTRELAQQIEKVMRALGDYLGVKVHACVGGTSVREDQRILSSGVHVVVGTPGRVFDMLRRQSLRPDYIKMFVLDEADEMLSRGFKDQIYDIFQLLPAKVQVGVFSATMPPEALEITRKFMNKPVRILVKRDELTLEGIKQFYVNVEKEEWKLETLCDLYETLAITQSVIFVNTRRKVDWLTDKMRSRDHTVSATHGDMDQNTRDIIMREFRSGSSRVLITTDLLAEGIDVQQVSLVINYDLPTQPENTCTVSDVVVGLGGRVWLSILLRLTMRECFLIFRSFTTLSWRSCLVMVPISFEYWFLPFPSFYKPGLFADICKFL

SEQ ID NO: 8450 - protein, 216 aa, Ananas comosus
MFVLDEADEMLSRGFKDQIYDIFQLLPSKIQVGVFSATTPPEALEITRKFMNKPVRILVKRDELTLEGIKQFHVNVEKEDWKLETLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINLVTRDDERMLFDIQRFYNV

SEQ ID NO: 8451 - protein, 216 aa, Ananas comosus
  misc_feature (38)..(39): Xaa can be any naturally occurring amino acid
  misc_feature (198)..(198): Xaa can be any naturally occurring amino acid
MFVLDEADEMLSRGFKDQIYDIFQLLPSKIQVGVFSAXXPPEALEITRKFMNKPVRILVKRDELTLEGIKQFHVNVEKEDWKLETLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINXVTRDDERMLFDIQRFYNV

SEQ ID NO: 8452 - protein, 242 aa, Helianthus annuus
MLRRQSLRSDNIKMFVLDEADEMLSRGFKDQIYDIFQLLPSKVQVGVFSATMPPEALEITRKFMNKPVRILVKRDELTLEGIKQFYVNVEKEEWKLETLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTLDDEKMLGDIQKFYNVVVEELPSNVADLI

SEQ ID NO: 8453 - protein, 170 aa, Ocimum basilicum
HPVELTLEGIKQFYVPFDKEEWKLETLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFMTMEDEKMLADIQKFYNVVIEELPANVADLL

SEQ ID NO: 8454 - protein, 202 aa, Solanum melongena
PKIQVGVFSATMPPEALEITRKFMNKPVRILVKRDELTLEGIKQFYVNVDKEEWKLETLCDLYETLAITQSVIFVNTRRKVDWLTDKMRSRDHTVSATHGDMDQTTRDIIMREFRSGSSRVLITTDLLARGIDVQQVSLVINYDLPTQPENYLHRIGRSGRFGRKGVAINFVTRDDERMLSDIQRFYNVLIEELPANVADLL

SEQ ID NO: 8455 - protein, 120 aa, Ipomoea batatas
WLTDKMGSRDHTVFATHGDMTQDTRDIIMREFRSGSSRVLITTDLLARGIDVQQLSLVINYDLPTQPENYLHRIGRSGRFGRKGVAINFVTKDDERMLFDIQKFYNVVVEELPANVADLL

SEQ ID NO: 8456 - protein, 74 aa, Medicago truncatula
MDTSLENTLILTNTSATNTSMNLNTKVVTKCSHNLLNLLCQLPCWGQNQSLALNQTIIKLLQNSRTERRCLSGS

SEQ ID NO: 8457 - protein, 330 aa, Physcomitrella patens
TIPDLQKIRDIRRELLNHGVVEPLDVLEHALVLLRHKVYRYSLAPEPPTATDTVKVVLRLSWQVVVDHQRHLLHVDTPRQQVRCDQNSGRPRTELSHDDVPGVLIHVSVSGRHGVVTGFHLPPGVDEDHALGDRQCLVQVAQGVQLPLLAVHVHVELLDTLQRQLVPLHQDLHRLVHELPRDLEGFRGHGGGEHAHLKLLGQQLEDVVNLHVMDTAPATTTTPHLVLETPRKHLIGLVQHEALDGIRAQRIPAQHVVHTPGCSHHHVHTRLQNPLVLPHTGSSHARVHLHLKVVAQCAHHLLDLLGQLTGGCQHQGLALQKLVVQLLQDA

SEQ ID NO: 8458 - protein, 174 aa, Tragopogon dubius
FDAMGLQENLLRGIYAYGFEKPSAIQQRGIVPFTKGLDVIQQAQSGTGKTATFCSGILQQLDYNVVECQALVLAPTRELAQQIEKVMRALGDYLGVKVHACVGGTSVREDQRILSAGVHVVVGTLGVCLTCCADSLYGLITSKCLCLMKLMKCSLVVLRIRFTISSSYYHQKFK

SEQ ID NO: 8459 - protein, 192 aa, Amborella trichopoda
  misc_feature (88)..(88): Xaa can be any naturally occurring amino acid
  misc_feature (98)..(98): Xaa can be any naturally occurring amino acid
  misc_feature (104)..(104): Xaa can be any naturally occurring amino acid
TMPPEALEITRKFMNKPVRILVKRDELTLEGIKQFYVNVEREEWKLDTLCDRNETLAISQSVIFVNTRRKVDWLTDKMRSRDHTVSAXHGDMDQNTRXVIMREXRSGSSRVLITTDLLARGIDVQQVSLVINYDLPTQPENYLHRIGRSGRFGRKGVAINFVTRDDERMLLDIQRFYNVVIEELPSNVADLL

SEQ ID NO: 8460 - protein, 234 aa, Beta vulgaris
  misc_feature (208)..(209): Xaa can be any naturally occurring amino acid
  misc_feature (217)..(217): Xaa can be any naturally occurring amino acid
  misc_feature (226)..(226): Xaa can be any naturally occurring amino acid
  misc_feature (233)..(233): Xaa can be any naturally occurring amino acid
MAGVAPEGSQYDARQYDNKMSELLSEEGSDFFTSYDEVYESFDKMGLLENLLRGIYAYGFEKPSAIQQRGIVPFCKGLDVIQQAQSGTGKTATFCSGILQQLDYENLECQALVLAPTRELAQQIEKVMRALGDYLGVKVHACVGGTSVREDQRILAAGVHVVVGTPGRVFDMLRRQSLRANSIKMFVLDEADEMLSRGFKDQIYDIFXXLPQRSRWXYFLLQCHLXPLKLLEXS

SEQ ID NO: 8461 - protein, 185 aa, Brassica napus
EITRKFMSKPVRILVKRDELTLEGIKQFYVNVDKEEWKLETLCDLYETLAITQSVIFVNTRRKVDWLTDKMRSRDHTVSATHGDMDQNTRDIIMREFRSGSSRVLITTDLLARGIDVQQVSLVINFDLPTQPENYLHRIGRSGRFGRKGVAINFMTTDDERMMSDIQKFYNVVVEELPNNVADLL

SEQ ID NO: 8462 - protein, 185 aa, Brassica napus
EITRKFMSKPVRILVKRDELTLEGIKQFYVNVDKEEWKLETLCDLYETLAITQSVIFVNTRRKVDWLTDKMRSRDHMVSATHGDMDQNTRDIIMREFRSGSSRVLITTDLLARGIDVQQVSLVINFDLPTQPENYLHRIGRSGRFGRKGVAINFMTTDDERMMSDIQKFYNVVVEELPNNVADLL

SEQ ID NO: 8463 - protein, 286 aa, Cichorium intybus
MRALGDYLGVKVHACVGGTSVREDQRILSAGVHVVVGTPGRVFDMLRRQSLRSDYIKMFVLDEADEMLSRGFKDQIYDIFQLLPPKVQVGVFSATMPPEALEITRKFMNKPVRILVKRDELTLEGIKQFYVNVEKEDWKLETLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTLEDEKMLSDIQKFYNVVVEELPSNVADLI

SEQ ID NO: 8464 - protein, 78 aa, Taraxacum officinale
GVSRGLFCTMPPEALEITRKFMNKPVRILVKRDELTLEGIKQFYVNVEKEDWKLETLCDLLNFGNHSKCHFCQHSPES

SEQ ID NO: 8465 - protein, 267 aa, Petunia hybrida
SVREDQRILSSGVHVVVGTPGRVFDMLRRQSLRPDHIKMFVLDEADEMLSRGFKDQIYDIFQLLPPKIQVGVFSATMPPEALEITRKFMNKPVRILVKRDELTLEGIKQFYVNVEKEEWKLETLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFATKDDERMLSDIQRFYNVVVEELPANVADLL

SEQ ID NO: 8466 - protein, 343 aa, Helianthus annuus
  misc_feature (312)..(312): Xaa can be any naturally occurring amino acid
MASEGNQFDAGQFDSKMNELLSSDGQDFFTSYDEVYDSFDAMGLQENLLRGIYAYGFEKPSAIQQRGIVPFTKGLDVIQQAQSGTGKTATFCSGILQQLDYKTVECQALVLAPTRELAQQIEKVMRALGDYLGVKVHACVGGTSVREDQRILSAGVHVVVGTPGRVFDMLRRQSLRSDYIKMFVLDEADEMLSRGFKDQIYDIFQLLPSKVQVGVFSATMPPEALEITRKFMNKPVRILVKRDELTLEGIKQFYVNVEKEEWKLETLCDLYETLAITQSVIFVNTRRKVDWLTDKMRSRDHTVSATHGDMDXNTRDIIMREFRSGSSRVLITTDLLARGIDVQ

SEQ ID NO: 8467 - protein, 346 aa, Triphysaria pusilla
QRGIVPFCKGLDVIQQAQSGTGKTATFCSGILQQLDYGLTQCQALVLAPTRELAQQIEKVMRALGDYLGVKVHACVGGTSVREDQRILSAGVHVVVGTPGRVFDMLRRQSLRSDSIKMFVLDEADEMLSRGFKDQIYDIFQLLPAKVQVGVFSATMPPEALEITRKFMNKPVRILVKRDELTLEGIKQFYVNVEKEEWKLETLCDLYETLAITQSVIFVNTRRKVDWLTDNMRTRDHTVSATHGDMDQNTRDIIMREFRSGSSRVLITTDLLARGIDVQQVSLVINFDLPTQPENYLHRIGRSGRFGRKGVAINFMTTQDEKMLQDIQKFYNVVVEELPSNVADLL

SEQ ID NO: 8468 - protein, 178 aa, Juglans hindsii x Juglans regia
  misc_feature (170)..(170): Xaa can be any naturally occurring amino acid
GKPVRILVKRDELTLEGIKQFYVNVDKEEWKLETLCDLYETLAITQSVIFVNTRRKVDWLTDKMRSRDHTVSATHGDMDQNTRDIIMREFRSGSSRVLITTDLLARGIDVQQVSLVINFDLPTQPENYLHRIGRSGRFGRKGVAINFVTKDDERMLYDIQKFYNVVIEEXPNNIADLL

SEQ ID NO: 8469 - protein, 97 aa, Solanum lycopersicum
TRDIIMREFRSGSSRVLITTDLLARGIDVQQVSLVINYDLPTQPENYLHRIGRSGRFGRKGVAINFVTRDDERMLFDIQKFYNVLIEELPANVADLL

SEQ ID NO: 8470 - protein, 280 aa, Solanum phureja
MAGAAPDGSQFDARQFDSKMTELLNAEGQEFFTSYDEAYDTFDAMELKEKLLRGIYAYGFEKPSAIQQRGIVPFCKGLDVIQQAQSGTGKTATFCSGVLQQLDYELLDCQALVLAPTRELAQQIEKVMQALGDYLKVKVHACVGGTSVREDQRILSSGVHVVVGTPGRVFDMLRRQSLRPDHIKMFVLDEADEMLSRGFKDQIYDIFQLLPPKIQVGVFSATMPPEALEITRKFMNKPVRILVKRDELTLEGIKQFYVNVEKEEWKLETLCDLYETLAIT

SEQ ID NO: 8471 - protein, 125 aa, Antirrhinum majus
TKESRLAYRQNEEQRPTVSATHGDMDQNTRDIIMREFRSGSSRVLITTDLLARGIDVQQVSLVINYDLPTQPENYLHRIGRSGRFGRKGVSINFLTKEDEKMLQDIQKFYNVVVEELPSNVADLL

SEQ ID NO: 8472 - protein, 250 aa, Trifolium pratense
  misc_feature (209)..(209): Xaa can be any naturally occurring amino acid
GTPGRVFDMLRRQSLHPDNIKMFVLDEADEMLSRGFKDQIYDIFQLLPNKIQVGVFSATMPPEALEITRKFMNKPVRILVKRDELTLEGIKQFYVNVDKEEWKLDTLCDLYETLAITQSVIFVNTRRKVDWLTDKMRSRDHTVSATHGDMDQNTRDIIMREFRSGSSRVLITTDLLARGIDVQQVSLVINFDLPTQPENYLHRIGRSGXFGRKGVAINFVTKDDETMLHDIQKFYNVIVEELPSNVAELL

SEQ ID NO: 8473 - protein, 203 aa, Cynara scolymus
CRQGSGWSFLCPMPPEALEITRKFMNKPVRILVKRDELTLEGIKQFYVNVEKEEWKLETLCDLYETLAITQSVIFVNTRRKVDWLTDNMRSRDHTVSATHGDMDQNTRDIIMREFRSGSSRVLITTDLLARGIDVQQVSLVINYDLPTQPENYLHRIGRSGRFGRKGVAINFVKLDDEKMLADIQKFYNVTVEELPSNVADLI

SEQ ID NO: 8474 - protein, 150 aa, Adiantum capillus-veneris
DWKLDTLCDLYETLAITQSVIFVNTRRMGDWLTDKMRARDHTVAATHGDMDQNTRDIIMREFRSGSSRVLITTDLLARGIDVQQVSLVINYDLPTQPENYLHRIGRGGRFGRKGVAINFVTKEDERMLKDIQRFYNVVVEELPSNVADLI

SEQ ID NO: 8475 - protein, 211 aa, Raphanus sativus
IYDIFQLLPSKVQVGVFSATMPPEALEITRKFMNKPVRILVKRDELTLEGIKQFYVNVDKEEWKLETLCDLYETLAITQSVIFVNTRRKVDWLTDKMRSRDHTVSATHGDMDQNTRDIIMREFRSGSSRVLITTDLLARGIDVQQVSLVINFDLPTQPENYLHRIGRSGRFGRKGVAINFMTSDDERMMSDIQKFYNVVVEELPNNVADLL

SEQ ID NO: 8476 - protein, 181 aa, Raphanus sativus
KFMNKPVRILVKRDELTLEGIKQFYVNVDKEEWKLETLCDLYETLAITQSVIFVNTRRKVDWLTDKMRSRDHTVSATHGDMDQNTRDIIMREFRSGSSRVLITTDLLARGIDVQQVSLVINFDLPTQPENYLHRIGRSGRFGRKGVAINFMTSDDERMMSDIQKFYNVVVEELPNNVADLL

SEQ ID NO: 8477 - protein, 106 aa, Thellungiella halophila
ATHGDMDQNTRDVIMREFRSGSSRVLITTDLLARGIDVQQVSLVINYDLPTQPENYLHRIGRSGRFGRKGVAINFVTRDDERMLFDIQKFYNVVVEELPSNVADLL

SEQ ID NO: 8478 - protein, 149 aa, Persea americana
FMNRPVRILVKRDELTLEGIKQFYVQVDKEEWKLETLCDLYETLAITQSVIFVNTRRKVDWLTDKMRSRDHTVSATHGDMDQNTRDIIMREFRSGSSRVLITTDLLARGIDVQQVSLVINFDLPTQPENYLHRIGRSGRFGRKGVAINF

SEQ ID NO: 8479 - protein, 203 aa, Medicago truncatula
MAGLAPEGSQFDAGKFDQKMNDLIAADGDEFWTSYDEVYDSFDAMGLAENLLRGIYAYGFEKPSAIQQRGIVPFCKGLDVIQQAQSGTGKTATFCSGVLQQLDYNVTQCQALVLAPTRELAQQIEKVMRALGDYLGVKVHACVGGTSVREDQRILSTGVHVVVGTPGRVFDMLRRQSLHPDYIKMFVLDELMKCFLEVSRSDL

SEQ ID NO: 8480 - protein, 210 aa, Unknown
  Sequence found in Organisms: Solanum lycopersicum, Solanum phureja
SMCLYWQIYDIFQMLPTKVQVGVFSATMPPEALDITRKFMNKPVRILVKRDELTLEGIKQFYVNVDKEEWKLETLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTTDDERMLFDIQKFYNVVIEEL

SEQ ID NO: 8481 - protein, 898 aa, Brachypodium distachyon
MSPPENPNGGAAAAPSEPAQPPKPSSSSTSKGKGKKDEKKDDDLSEEDLALKEQLELYVVRAQDTDPGVQKLALESMRQEIRSATSSMTSVPKPLKFLRPHYGTLKSYFESMQEPELKKYMADILSVLALTMAVEGERESLKYRLLGSEGDIGSWGHEYVRNLAGEIAQEFQKRQGDEMPIDALMELVQQIASFHMKHNAEPEAVDLLMEVEDLDLLVEHVDSTNYKRACLYLTSSFKYLPGPDDALALDIAYTIYMKFRDLTNALRIALLLDNKSAQYVKQVYTATDDLSLKKQFSYIIARHGLAMEIDDEIAADENDKEILQEIVNNSKLSEGYLTLARDIEVMEAKSPEDIYKVHLIDGRGASSSLDSARQNLAATFVNAFVNAGFGQDKLMTAPSDSSSSGSSGNWLFKNKEHGKASAAASLGMILLWDTDSGLAQLDKYLHSNDTHVVAGALLGIGVVSCGVKNECDPALAILLEYINKDDPNIRIGAILGLGIAYAGSQKDELRVQLSMVLGEPQATLEVLVFTAVALGLVFVGSCNEEIAQSIIFFLMERSEAELAEPIIRLLPVALGLLFLGKQENVEATAEVAKTFDEKIRKYCDVTLMSLAYAGTGNVLKVQKLLGICSQHLEKGETHQGPAVLGIALIAMSEELGAEMAVRSLERLLQYGEQNIRRAVPLALGILCISNPKVNVMDTLSRLSHDADADVSMAAIISLGLIGAGTNNARIAGMLRNLSSYYYKEAAHLFCVRIAQGLVHLGKGLLTLSPYHSDRFLLSPMALGGIVTVLHACLDMKSTILGKYHYILYIIVLAMQPRMLLTVDEDLKPLPVPVRVGQAVDVVGQAGRPKTITGFQTHTTPVLLAAGERAELATEKYLPLTSTLEGFVILRKNPEYHEE

SEQ ID NO: 8482 - protein, 257 aa, Lactuca sativa
MAGIAPEGSQFDARQFDSKMSELLSADGQDFFTSYDEVYDSFDAMGLQENLLRGIYAYGFEKPSAIQQRGIVPFTKGLDVIQQAQSGTGKTATFCSGILQQLDYNVVECQALVLAPTRELAQQIEKVMRALGDYLGVKVHACVGGTSVREDQRILSAGVHVVVGTPGRVFDMLRRQSLRADYIKMFVLDEADEMLSRGFKDQIYDIFQLLPSKVQVGVFSATMPPEALEITRKFMNKPVRILVKRDELTLEESNSFM

SEQ ID NO: 8483 - protein, 305 aa, Nuphar advena
CQALVLAPTRELAQQIEKVMRALGDYLGVKVHACVGGTSVREDQRILSSGVHVVVGTPGRVYDMLRRQSLRPDNIRMFVLDEADEMLSRGFKDQIYDIFQLLPSKVQVGVFSATMPPEALEITRKFMNKPVRILVKRDELTLEGIKQFYVNVDKEEWKLDTLCDLYETLAITQSVIFVNTRRKVDWLTDNMRSRDHTVSATHGDMDQNTRDIIMREFRSGSSRVLITTDLLARGIDVQQVSLVINYDLPTQPENYLHRIGRSGRFGRKGVAINFITHDDDRMLADIQRFYNVIIEELPANVADLI

SEQ ID NO: 8484 - protein, 335 aa, Triphysaria pusilla
DVIQQAQSGTGKTATFCSGILQQLDYSLTQCQALVLAPTRELAQQIEKVMRALGDFLGVKVHACVGGTSVREDQRILSAGVHVVVGTPGRVFDMLRRQSLRSDNIKMFVLDEADEMLSRGFKDQIYDIFQLLPAKVQVGVFSATMPPEALDITRKFMNKPVRILVKRDELTLEGIKQFYVNVEKEEWKLETLCDLYETLAITQSVIFVNTRRKVDWLTDNMRTRDHTVSATHGDMDQNTRDIIMREFRSGSSRVLITTDLLARGIDVQQVSLVINFDLPTQPENYLHRIGRSGRFGRKGVAINFMTVEDQKMLQDIQKFYNVVVEELPSNVADLL

SEQ ID NO: 8485 - protein, 107 aa, Zinnia violacea
QPHTVTWTRTHVTSSCVSFVLVLLVFSSPLICMARGIDVQQVSLVINYDLPTQPENYLHRIGRSGRFGRKGMAINFVTHDDEKMLGVIQKFYNVVVEELPSNVADLI

SEQ ID NO: 8486 - protein, 106 aa, Ocimum basilicum
ATHGDMDQNTRDIIMREFRSGSSRVLITTDLLARGIDVQQVSLVINYDLPTQPENYLHRIGRSGRFGRKGVAINFVTKDDERMLFDIQKFYNVLVEELPANVADLL

SEQ ID NO: 8487 - protein, 95 aa, Panax ginseng
DIIMREFRSGSSRVLITTDLLARGIDVQQVSLVINYDLPTQPENYLHRIGRSGRFGRKGVAINFVTKDDERMLFDIQKFYNVVVEELPSNVAELL

SEQ ID NO: 8488 - protein, 175 aa, Cicer arietinum
AGILVKRDELTLEGIKQFYVNVEKEEWKLDTLRDLYETLAITQSVIFVNTRRKVDWLTDKMRSRDHTVSATHGDMDQNTRDIIMREFRSGSSRVLITTDLLARGIDVQQVSLVINFDLPTQPENYLHRIGRSGRFGRKGVAINFITKEDEKMLSDIQKFYNVIVEELPSNVAELL

SEQ ID NO: 8489 - protein, 102 aa, Gerbera hybrid cultivar
QNTRDIIMREFRSGSSRVVITTDLLARGIDVQQVSLVINYDLPTQPENYLHRIGRSGRFVRKGVAINFVTLDDERMLADIQKLYNVVCRGAAIQCCRSHLKH

SEQ ID NO: 8490 - protein, 155 aa, Brassica oleracea
DVDKEEWKFETLCDLYETLAITQSVIFVNTRRKVDWLTEKMRSRDHTVSATHGDMDQNTRDIIMREFRSGSSRVLITTDLLARGIDVQQVSLVINFDLPTQPANYLHRIGRSGRFGRKGAAINFVTRDDEKMLADIQKFYNMVVEELPSNLADLL

SEQ ID NO: 8491 - protein, 97 aa, Jatropha curcas
SRDIIMREFRSGSSRVLITTDLLARGIDVQQVSLVINYDLPTQPENYLHRIGRGGRFGRKGVAINFVTKDDDRMLFDIQRFYNVVIEELPSHVADLL

SEQ ID NO: 8492 - protein, 115 aa, Brassica napus
  misc_feature (111)..(111): Xaa can be any naturally occurring amino acid
  misc_feature (115)..(115): Xaa can be any naturally occurring amino acid
MRSRDHTVSATHGDMDQNTRDIIMREFRSGSSRVLITTDLLARGIDVQQVSLVINFDLPTQPENYLHRIGRSGRFGRKGTAINFVTRDDERMLTDIQKFYNVAVEELPSKXDDLX

SEQ ID NO: 8493 - protein, 96 aa, Manihot esculenta
  misc_feature (18)..(18): Xaa can be any naturally occurring amino acid
RDIIMREFRSGSSRVLIXTDLLARGIDVQQVSLVINYDLPTQPENYLHRIGRGGRFGRKGVAINFVTKDDDRMLFDIQRFYNVVIEELPSNVADLL

SEQ ID NO: 8494 - protein, 189 aa, Mesostigma viride
PEALEITRKFMSKPVKILVKRDELTLEGIKQFYVNVDREDWKLDTLCDLYETLAITQSVIFCNTRRKVDWLTDKMRVRDHTVSATHGDMDQNTRDIIMREFRSGSSRVLITTDLLARGIDVQQVSLVINYDLPLQPENYLHRIGRSGRFGRKGVAINFVTKDDERLVQDIQRFYNTTIEELPNNVADLI

SEQ ID NO: 8495 - protein, 107 aa, Antirrhinum majus
SATHGDMDQNTRDIIMREFRSGSSRVLITTDLLARGIDVQQVSLVINYDLPTQPENYLHRIGRSGRFGRKGVAINFVTKDDDRMLVDIQKFYNVVVEELPANVADLL

SEQ ID NO: 8496 - protein, 73 aa, Arabidopsis lyrata
GKLLNNNIVEFLNIKQHSLIITSNEVNGHTLSPEPSTSSDTVKVILWLSWEVKVYDQRDLLHIDTTSQEISRD

SEQ ID NO: 8497 - protein, 135 aa, Glycine max
QLLYSHIVELLNIRQHPGIICRDKVYSNSFSSKSTTTSYAVEIVFRLGWQIIVYDQRHLLHIDTTGQKVRGNENSRRAGPEFTHDNITCVLVHVTMGGRDCVVIASHLVSEPVHLAPGIHKNDTLSDSQSLIKVT

SEQ ID NO: 8498 - protein, 102 aa, Rhizophora mangle
ATHGDMDQNTRDIIMREFRSGSSRVLITTDLLARGIDVQQVSLVINYDLPTQPENYLHRIGRGGRFGRKGVAINFMTKDDERMLFDIQKFYNVVVEELPSNV

SEQ ID NO: 8499 - protein, 129 aa, Theobroma cacao
  misc_feature (13)..(13): Xaa can be any naturally occurring amino acid
  misc_feature (37)..(38): Xaa can be any naturally occurring amino acid
  misc_feature (43)..(43): Xaa can be any naturally occurring amino acid
  misc_feature (51)..(51): Xaa can be any naturally occurring amino acid
  misc_feature (54)..(54): Xaa can be any naturally occurring amino acid
  misc_feature (79)..(79): Xaa can be any naturally occurring amino acid
  misc_feature (81)..(81): Xaa can be any naturally occurring amino acid
  misc_feature (114)..(114): Xaa can be any naturally occurring amino acid
  misc_feature (120)..(120): Xaa can be any naturally occurring amino acid
FVNTRPKVDWLTXKMRSRDHTVSATHGDMDQNTRDIXXREFRXGSSRVLIXTDXLARGIDVQQVSLVINYDLPTQPENXLXRIGRSGRFGRKGVAINFVIRDDERMLFDIQKFXNVIIEXLPANVADLL

SEQ ID NO: 8500 - protein, 167 aa, Senecio madagascariensis
RAAARAGLTLEGIKQFYVNVEKEEWKLETLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTLDDEKMLGDIQKFYNVVVEETSA

SEQ ID NO: 8501 - protein, 135 aa, Glycine max
QLLYSHIVELLNIRQHSGIIRRDKVYRNSFSSKPTTTPYAVEIVFRLGWQIIIYDQRHLLYINSTGKKVSGNENSGRAGPEFTHDDITGILVHVTVGGRDCVIIASHLVSEPVHLAPGIHKNDTLGDSQSLIKVA

SEQ ID NO: 8502 - protein, 102 aa, Salvia sclarea
TRPWLSLNIIMREFRSGSSRVLITTDLLARGIDVQQVSLVINYDLPTQPENYLHRIGRSGRFGRKGVAINFVTKDDERMLFDIQKFYNVTVEELPANVADLL

SEQ ID NO: 8503 - protein, 112 aa, Actinidia deliciosa
RDHTVSATHGDMDQNTRDIIMREFRSGSSRVLITTDLLARGIDVQQVSLVINFDLPTQPENYLHRIGRSGRFGRKGVAINFVTKDDERMLFDIQKFYNVVVEELPANVADLL

SEQ ID NO: 8504 - protein, 110 aa, Lactuca sativa
HTVSATHGDMDQNTRDIIMREFRSGSSRVLITTDLLARGIDVQQVSLVINYDLPTQPENYLHRIGRSGRFGRKGVAINFVTLEDEKMLSDIQKFYNVVVEELPSNVADLI

SEQ ID NO: 8505 - protein, 219 aa, Ricinus communis
SSSSGCQIYDIFQFLPAKVQVGVFSATMPPEALDITRKFMNKPVRILVKRDELTLEGIKQYYVHVDKDEWKLETLCDLYETLPIAQSVIFVNTRRKVDWLTDKMRSRDHTVSATHGDMDQNASDVIMREFRSGSSRVLIATDLLARGIDVQQVSLVINYDLTTQPENYLHRIGRGGRFGRKGVAINFVTKEDDRMLFEIQKFYNMVIQELPANVADLQL

SEQ ID NO: 8506 - protein, 179 aa, Adiantum capillus-veneris
EMTRKFMNKPVRILVKRDESTLEGIKQFYVDVNKEDWKLDTLCDLYETLAITQSVIFVNTRRKVDWLTDKMRARDHTVSATHGDMDQNTRDVIVREFRSGSSRVLITTDLLARGIDVQQVSLVISYDLPTQPENYLHRIGRGGRFGRKGVAINFVTKDDERMLQDIQRFYNVVVEELPS

SEQ ID NO: 8507 - protein, 105 aa, Cryptomeria japonica
MVTLDPDYPGPFIMREFRSGSSRVLITTDLLARGIDVQQVSLVINYDLPTQPENYLHRIGRSGRFGRKGVAINFVTRDDERMLADIQRFYNVTIEELPSNVADLL

SEQ ID NO: 8508 - protein, 110 aa, Lactuca sativa
HTVSATHGDMDQNTRDIIMREFRSGSSRVLITTDLLARGIDVQQVSLVINYDLPTQPENYLHRIGRSGRFGRKGVAINFVTLDDAKMLSDVQKFYNVVVEELPSNVADLI

SEQ ID NO: 8509 - protein, 115 aa, Festuca arundinacea
MRGRDHTVSATHGDMDQNTRDIIMREFRSGSSRVLITTDLLARGIDVQQVSLVINYDLPTQPENYLHRIGRSGRFGRKGVAINFVTREDERMLFDIQKFYNVVIEELPANVADLL

SEQ ID NO: 8510 - protein, 115 aa, Zingiber officinale
MRSRDHTVSATHGDMDQNTRDIIMREFRSGSSRVLITTDLLARGIDVQQVSLVINYDLPTQPENYLHRIGRSGRFGRKGVAINFVTRDDERMLFDIQRFYNVVIEELPSNVADLI

SEQ ID NO: 8511 - protein, 89 aa, Zingiber officinale
FRSGSSRVLITTDLLARGIDVQQVSLVINYDLPTQPENYLHRIGRSGRFGRKGVAINFVSRDDERMLFDIQKFYNVVIEELPSNVADLI

SEQ ID NO: 8512 - protein, 112 aa, Lactuca sativa
RDHTVSATHGDMDQNTRDIIMREFRSGSSRVLITTDLLARGIDVQQVSLVINYDLPTQPENYLHRIGRSGRFGRKGVAINFVTLEDEKMLSDIQKFYNVVVEELPSNVADLI

SEQ ID NO: 8513 - protein, 115 aa, Cicer arietinum
MRSRDHTVSATHGDMDQNTRDIIMREFRSGSSRVLITTDLLARGIDVQQVSLVINYDLPTQPENYLHRIGRSGRFGRKGVAINFVTKDDERMLGDIQKFYNVIIEELPSNVAELL

SEQ ID NO: 8514 - protein, 115 aa, Beta vulgaris
MRARDHTVSPTHGDMDQNTRDIIMREFRSGSSRVLITTDLLARGIDVQQVSLVINYDLPTQPENYLHRIGRSGRFGRKGVAINFVTADDEKMLFDIQKFYNVVIEELPANVADLI

SEQ ID NO: 8515 - protein, 333 aa, Ricinus communis
MAGLAPQGSQYDARHYDSKIIEVLGAKGQDFFTSYDEVYDSFDAMGLKENLLRGFEKPSPIQQRGILPLCEGFDVIQQAQQGTGKTATFCSGILQQLDYDLVECQALILTPTRELAQQIGFSSRIYWCPGRVFDMLRRQSLCSDNIKMFVLDEADEMLSRGLTDQMYDIFQLLPAKIQVRVFSATMLPEALEITRKVAITQSVIFVNTRRKVDRLTDKMQSHDHTLSATHGYMIKTEGTLSCRTFALVPLVCSLLLTSWHVVLMSSKSHLLSIMISRHSQRTASIELTVVDGLGGRVLLSTLSPRMMKECFLDIQKFYHVVIEELASNVADLL

SEQ ID NO: 8516 - protein, 115 aa, Cryptomeria japonica
MRARDHTVSATHGDMDQNTRDIIMREFRSGSSRVLITTDLLARGIDVQQVSLVINYDLPTQPENYLHRIGRSGRFGRKGVAINFVTRDDERMLQDIQRFYNVVVEELPSNVADLI

SEQ ID NO: 8517 - protein, 115 aa, Lotus japonicus
MRSNDHTVSATHGDMDQNTRDIIMREFRSGSSRVLITTDLLARGIDVQQVSLVINYDLPTQPENYLHRIGRSGRFGRKGVAINFVTLDDSRMLSDIQKFYNVTVEELPSNVADLL

SEQ ID NO: 8518 - protein, 181 aa, Triphysaria pusilla
FMNKAVDILVKRDKLILEGIKQFYVNVDKEQWKLDTLSDLYEIVRSRTQCVIFVNTRRKVDWLTDKMSERDYSVSATHGDMKLNTRDINMQEFRSGSSRVLITTDLFSRGIDVQQVSLVINYDLPTKPENYLHRIGRSGRFGRKGVVLNFVTKDDEHMLFDIQKFYNVQILEMPGNLPDLL

SEQ ID NO: 8519 - protein, 154 aa, Triphysaria pusilla
DKEQWKLDTLSDLYEIVRSRTQCVIFVNTRRKVDWLTDKMSERDYSVSATHGDMKLNTRDINMQEFRSGSSRVLITTDLFSRGIDVQQVSLVINYDLPTKPENYLHRIGRSGRFGRKGVVLNFVTKDDEHMLFDIQKFYNVQILEMPGNLPDLL

SEQ ID NO: 8520 - protein, 115 aa, Triticum aestivum
MRGGDHTVFATHGDMDQNIRDIIMREFRFGFFGVVITTDLLARGINVQQVSLVIKYDLPTQPENYLHRIGCSGRFGRKGVPINFVTRENERMLFDIQKFYNVVIEELPANVGALF

SEQ ID NO: 8521 - protein, 115 aa, Ipomoea batatas
MRARDLTVSATHGDMDQNTRDIIMREFRSGSSRVLITTDLLARGIDVQQVSLVISYDLPTQPENYLPRIGRSGRFGRKGVAINFVTKDDDRMLFDIQKFYNVVVEELPANVADLL

SEQ ID NO: 8522 - protein, 115 aa, Zingiber officinale
  misc_feature (47)..(47): Xaa can be any naturally occurring amino acid
  misc_feature (107)..(107): Xaa can be any naturally occurring amino acid
MRSRDHTVSATHGDMDQNTRDIIMREFRSGSSRVLITTDLLARGIDXQQVSLVINYDLPTQPENYLHRIGRSGRFGRKGVAINFVVRDDERMLYDIQKFYNVVIEEXPSNVADLI

SEQ ID NO: 8523 - protein, 115 aa, Solanum tuberosum
MRSRDHTVSATHGDMDQNTRDIIMPEFRSGSSRVLITTDLLARGIDVQQVSLVINYDLPTQPENYLHRIGRSGRFGRKGVAINFVTKHDERMLSDIQRFYNVVIEELPANVADLL

SEQ ID NO: 8524 - protein, 86 aa, Eucalyptus gunnii
GSSRVLITTDLLARGIDVQQVSLVINYDLPTQPENYLHRIGRGGRFGRKGVAINFVTRDDERMLFDIQKFYNVVVEELPSNVADLL

SEQ ID NO: 8525 - protein, 86 aa, Thellungiella halophila
GSSRVLITTDLLARGIDVQQVSLVINFDLPTQPENYLHRIGRSGRFGRKGVAINFVTRDDERMLFDIQKFYNVVVEELPSNVADLL

SEQ ID NO: 8526 - protein, 117 aa, Pisum sativum
DKMRGRDHTVSATHGDMDQNTRDIIMREFRSGSSRVLITTDLLARGIDVQQVSLVINYDLPTQPENYLHRIGRSGRFGRKGVAINFVTVDDARMLSDIQKFYNVTVEELPSNVADLL

SEQ ID NO: 8527 - protein, 116 aa, Solanum tuberosum
KMRSRDHTVSATHGDMDQNTRDIIMPEFRSGSSRVLITTDLLARGIDVQQVSLVINYDLPTQPENYLHRIGRSGRFGRKGVAINFVTKHDERMLSDIQRFYNVVIEELPANVADLL

SEQ ID NO: 8528 - protein, 87 aa, Zea mays
YKTLAITQRVIFVNTRRTVDWLTDKMRSKDHTVSATHGDMDHITRDIIMREFRSGSFRGLITTDLLARGIDGQHVSLVIIYDLPTHP

SEQ ID NO: 8529 - protein, 89 aa, Avena sativa
GDMDQNTRDIIMREFRFGSSRVLITTDLLARGIDVQQVSLVINYDLPTQPENYLHRIGRSGRFGRKGVAINFVTREDERMLFDVQKFYN

SEQ ID NO: 8530 - protein, 308 aa, Tragopogon dubius
TGKTATFCSGILQQLDYSVVECQALVLAPTRELAQQIEKVMRALGDYLGVKVHACVGGTSVREDQRILSAGVHVVVGTPGRVFDMLRRQSLRADYIKMFVLDEADEMLSRGFKDQIYDIFQLLPSKVQVGVFSATMPPEALEITRKFMNKPVRILVKRDELTLEGIKQFYVNVEKEEWKLETLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTLDDERMLADIQ

SEQ ID NO: 8531 - protein, 83 aa, Brassica juncea
RVLITTDLLARGIDVQQVSLVINYDLPTQPENYLHRIGRSGRFGRKGVAINFVTKDDERMLFDIQKFYNVVVEELPSNVADLL

SEQ ID NO: 8532 - protein, 50 aa, Helianthus annuus
MLADIQKFYNVSVEELPSNVADLIEKMILGCWACLSKKEQRLERVVLNLS

SEQ ID NO: 8533 - protein, 115 aa, Brassica napus
MRSRDHTVSATHGDMDQNTRDIIMREFRSGSSRVLITTDLLARGIDVQQVSLVINFDLPTQPENYLHRIGRSGRFGRKGTAINFVTRDDERMLTDIQKFYNVAVEELPSKIDDLL

SEQ ID NO: 8534 - protein, 115 aa, Ipomoea nil
  misc_feature (70)..(70): Xaa can be any naturally occurring amino acid
  misc_feature (74)..(74): Xaa can be any naturally occurring amino acid
  misc_feature (88)..(88): Xaa can be any naturally occurring amino acid
MRARDLTVSATHGDMDQNTRDIIMREFRSGSSRVLITTDLLARGIDVQQVSLVISYDLPTQPENYLPRIXRSGXFGRKGVAINFVTKXDDRMLFDIQKFYNVVVEELPANVADLL

SEQ ID NO: 8535 - protein, 434 aa, Zea mays
MEIDLHAVRAVRVLGRGAMGTVFLAVNGAGGEAYALKVFDKRSPAVASRPSAGTDAARRARWEVSVLSRLAHPHLPSLLGCAETPDLLAWALPYCPGGDLNELRHAQPDRVFSPAAIRFYVAEVVSALAELHAAGIAYRDLKPENVLLRADGHVTLTDFDLSRQLPPRSPSAASTSTSSSCSATSSPPPQAQSHGRSQHRHVKNIFKRSESAVTASTSGQEEPRNLAWYLSKRIDGGADQIKKAKSARVSPMDRGKKLSSFCSAAAAGERSFSFVGTEEYVAPEVVRGDGHEFAVDWWALGVLVYEMSHGRTPFRGRGRKETFRNVLLREPEFTADARRRWPELTDLIARLLEKDPARRLGFAGGADEVRAHPFFAGVAWDLLGEVSRPPYIPAPADDTVSCEGFSVVEYFDRLHQPPLSPAEYSPEEELLPEF

SEQ ID NO: 8536 - protein, 432 aa, Zea mays
MEIDLHVVRAARVLGRGAMGTVFLAVDGGTGEAYALKVFDKRSAAAASRPAAGADAARRAQWEVSVLSRLAHPHLPSLLGCAETPDLLGWALPYCPGGDLNELRHAQPDRVFSPAAIRFYVAEVVSALAELHAAGIAYRDLKPENVLLRADGHVMLTDFDLSRQLPPPRSPSASTSTSSSSCSATSSPLPQTQTTHMKNIFKRSESAVTAPTSGQEEPRNLAWYLSKSIDGGSDQVKKAKSARVTPVDRGKELPSFCPAAAAAAGERSFSFVGTEEYVAPEVVRGDGHEFAVDWWALGVLVYEMSHGRTPFRGRSRKETFRNVLLREPGFTADARRRWPELTDLVSRLLEKNPARRLGFAGGADEVRAHPFFAGVAWDLLGDVSRPPYIPAPPDDSIASCEGFSVAEYFDRLHQPPLSPAKHSPEEELLPEF

SEQ ID NO: 8537 - protein, 176 aa, Populus trichocarpa
MADNPTSPAAGSHESGGEQSPRSGVREQDRYLPIANISRIMKKALPANGKIAKDAKDTVQECVSEFISFVTSEASDKCQKEKRKTINGDDLLWAMATLGFEDYIEPLKVYLARYREQLWQGDAKGSARGGDGSSKRDAVGGLPGQNAQFAFQGSMNYTSPQVQGQHMILPSMPGNE

SEQ ID NO: 8538 - protein, 172 aa, Manihot esculenta
MADNPTSPAGGSHESGGEQSPHSGVREQDRYLPIANISRIMKKALPANGKIAKDAKDTVQECVSEFISFITSEASDKCQKEKRKTINGDDLLWAMATLGFEDYIEPLKVYLARYREGDTKGSARGGDGSAKRDAIGGLPVQNPQFAIQGSMNYISSQAQGQHMIVPSMQGNE

SEQ ID NO: 8539 - protein, 173 aa, Cucumis sativus
MADPPTSPPGCSHESGGEQSPNTAAAVREQDRFLPIANISRIMKKALPANGKIAKDAKDTVQECVSEFISFVTSEASDKCQKEKRKTINGDDLLWAMATLGFEEYIDPLKSYLNRYRECDAKGSSRGGDESAKRDAVGVLPGQNSQQYMQPGSLTYINTQGQHMIIPSMQNND

SEQ ID NO: 8540 - protein, 189 aa, Hordeum vulgare
MAARALTAAAGRRVAGRTGTTPLLASCRNGASMSHSSATAGARREEEPYKDVHGPAAAAAMTGAQVEAALNRKNVEVLQGEEEEEEHVATVLPDETVSIPAGDGEEDASWVPDQDTGVFGPAHVRRHPQATGGASAFPPPPYLFGRRHGPWSTPRTGSGPQPGGVSTAQEELGEVVKALPPSELPNPKR

SEQ ID NO: 8541 - protein, 320 aa, Manihot esculenta
MASGDPERGTKNRGYNDTSLYYVETSDKQWTSWLIPMFVVANIAVFIVAMYVNNCPKNNLGFEGSCVAKFLGRLSFQPLKENPLFGPSSSTLEKMGALEWNKVVHGHQGWRLITCMWLHAGVIHLLANMLSLIFIGIRLEQQFGFVRVGIVYLLSGFGGSILSSLFIQRNISVGASGALFGLLGAMLSELLTNWTIYSNKIAALLTLVVIIAINLAVGILPHVDNFAHIGGFLAGFLLGFVILLRPQFGWYESQHLPADARVKSRHKAYQYVFLLVAAVLLIVGFTVGLVMLFRGVNGNDHCSWCHYLSCVPTSKWKCDN

SEQ ID NO: 8542 - protein, 329 aa, Theobroma cacao
  misc_feature (190)..(190): Xaa can be any naturally occurring amino acid
  misc_feature (226)..(226): Xaa can be any naturally occurring amino acid
  misc_feature (229)..(230): Xaa can be any naturally occurring amino acid
  misc_feature (234)..(234): Xaa can be any naturally occurring amino acid
  misc_feature (246)..(246): Xaa can be any naturally occurring amino acid
  misc_feature (252)..(252): Xaa can be any naturally occurring amino acid
  misc_feature (273)..(273): Xaa can be any naturally occurring amino acid
  misc_feature (275)..(275): Xaa can be any naturally occurring amino acid
MASGDLERGGGSNGKNRANNYYQSASTGPYYMESAEKQWTSWLVPMFVVANVAVFVVVMYINNCPKNNLGIEGSCVAKFLGRLSFQPLKENPLFGPSSNTLEKLGALEWNKVVHGDQGWRLITCIWLHAGVIHLLANMLSLVFIGIRLEQQFGFVRVGLIYLLSGFGGSILSSLFIQRNISVGASGALFXLLGAMLSELLTNWTIYTNKAAALITLVIIIAINLAXGIXXHVDXFAHIGGFFAGFXLGFVLXLRPQFGWVERQHLPAGARVKXKXKAYQYVFWVIAVVLLIVGFTVGLVMLFRGENGNDHCSWCHYLSCVPTSKWRCGN

SEQ ID NO: 8543 - protein, 326 aa, Gossypium hirsutum
MASGDLERGGRNGKNRANSYHQSSSPFYVENTDKQWTSWLVPMFVVANVAVFFVVMYINDCPNNNLGFEGSCVAKFLGKLSFQPLKENPLFGPSSHTLDKLGALNWSKVAHGKQGWRLITCIWLHAGVIHLLANMLSLVFIGIRLEQQFGFLRIGLIYLLSGFGGSILSSLFIQDNISVGASGALFGLLGAMLSELLTNWTIYTNKAAALITLVVIIAINLAVGILPHVDNFAHIGGFLTGFLLGFVLLLRPQFGWVQRQHVPAGAPVKSKHRAYQYVFWVIAVVLVIVGFTVGLVMLFRGENGNDHCSWCHYLSCVPTSSWHCGK

SEQ ID NO: 8544 - protein, 321 aa, Populus trichocarpa
MASGDLERGTKNRGNNANFPSYYVETAEKQWTSWIIPMFVVANIAVFIVVMYVNDCPKKSLGIEGSCVAKFLGRFSFQPLKENPLFGPSAATLEKMGALEWNKVVHGHQGWRLITCMWLHAGVVHVLANMLSLIFIGIRLEQQFGFVRVGIIYLVSGFGGSILSSLFIQQNISVGASGALFGLLGAMLSELLTNWTIYSNKIAALLTLVVIIAINLAVGILPHVDNFAHIGGFISGFLLGFVFLLRPQFGWAKNQHSPADARVKSKHKAYQYVLMLAAAVLLIVGFTLALVMLFKGENGNDHCSWCHYLSCVPTSKWNCRS

SEQ ID NO: 8545 - protein, 322 aa, Populus trichocarpa
MTSGDLERGTKNRGNSSNFPSYYVETAEKQWTSWLIPMFVVANIVVFIVVMYVNDCPKKNLGSERSCVAKFLGRFSFQPLKENPLFGPSSATLEKMGALEWNKIVRGDQGWRLITCMWLHAGVIHVLANMLSLVFIGIRLEQQFGFVRVGLIYLVSGFGGSIFSSLFIQRNISVGASGALFGLLGAMLSELLTNWTIYSNKIAALLTLMVIIAINLAVGILPHVDNFAHIGGFFTGFLLGFVLLLRPQFGWVESQHFRADAHVKSKHKAYQYMFLLAAAVLLIVGFTFGLVMLFKGENGNDHCSWCHYLSCVPTSKWKCENR

SEQ ID NO: 8546 - protein, 557 aa, Zea mays
MDLVGSLLLSMARLLDPSGLHFVGWLVTAGSIGLAALIYALLRLQREAALYWTKATREKRAAWRRLRCPSSCHSWSEDYFHGGQPSTCCVCLSSLGSTQGVDMVHRCSVCGVAAHSNCSPRAEKDCKCVAQAGASPLLHHWSERWVELDDNPEISSSCYYCDEPCGVPFLGVSPIWRCLWCQRQIHVDCHAKLLKETGNTCDLGLLRRLIVPPQSVKEIGQGSGISGMLNSIKDGFANSTVGNRRRSRNKKRMNNHPGGKINSIPTKFSVIDSVLEGFARLKGLDGKYALAKPLSQHSVKQTYRSVIPNGRVRKYELVDLPQDSRPLLVFINGKSGGRNGPSLRRRLNMLLNPIQIFELSASQAPEVGLQLFHNVKHFRILVCGGDGTVAWVLDAIEKQNYESPPPVAILPLGTGNDLSRVMRWGGGLSSVERQGGIYALLNDVDHAAVTVLDRWNVTIKEKNGTEGECTKQIKFMTNYLGIGCDAKVAYDFHTTREEKPDKFCSQFVNKLIYAREGAKDMMDRSCSDLPWHVSLEVDGKNIEIPEDAEGVIVMNIP

SEQ ID NO: 8547 - protein, 707 aa, Oryza sativa
MDLVGSLLVNMTHLVDTSGLQFFGWLITAGSFGLAALIYALLRLQRAASLYWIKAAAREKKAAWKSLRCPSSGHTWTEDYFRGGQPSTCCVCLSSLTTAQGVGSRGADAVVVHRCSVCGVAAHSGCSRGAEKDCKCVSQHGASTLLHHWSERWVELDDNPEMSSFCYYCDEPCGVPFLGVSPIWRCLWCQRQIHVDCHAKLLKETGNTCDLGLLRRLIVPPLSVKEVAQGPAITGMLNSIKEGLVTSSVRGRIKRRGNKKRMNNHPGGKTSPVPTNSSILDSVLEGFARLQNLNGKYALANHKSSGDSVKQTHGYGSPNGGKKKYEIIDLPQDSRPLLVFINGKSGGRNGPSLRRRLNMLLNPIQIFELSASQGPEVGLQFFHNVKHFRILVCGGDGTVAWVLDAIEKQNYESPPPVSILPLGTGNDLSRVMRWGGGLSSVEGQGGICALLNDVDHAAVTVLDRWNVAIKEKNGAEDQCTKQVKFMTNYIGVGCDAKVAYDFHTTREEKPDKFCSQFVNKLIYAREGAKDIMDRSCSDLPWHVSLEVDGKNVEIPEDAEGVIVLNIPSYMGGVDLWQNDNEHDDDFGLQSMHDKMLEVVCISGTWHLGKLQVGLSRAHRLAQGKVIRLHLHSSFPVQVDGEPWIQPPGCLEISHRGQMFMLRRTSEEPTGHAAAIMSEVLMNAECNGVIDAAQKRLLLHEIALRLSS

SEQ ID NO: 8548 - protein, 705 aa, Brachypodium distachyon
MELVGSLLVNMTRWVDPSGIEFFGWLITVGSFGLAALIYGLLRLQREASLYWLKASAREKKAASKVQRCPCSSHSWTEDCFRGGQPSTCCVCLSSLGSAQGVGSKGPDADVVHRCSVCGVAAHWYCSRGADNDCKCVAQAGASTLLHHWSERWVEMDDNPEISTFCYYCEEPCGVPFLGVSPIWRCLWCQRQIHVDCHAKLLKETGNTCDLGLLRRLIVPPLSVKEVGEAQAISGVFNSFKEGFVTSRGRIKRQRNKKRMNNQPGVKTNPTPADSSILDSVLEVFAKLQNLNEKDALANPKLSRNSLKETHGSDIPNGGKKKYELVNLPQDSRPLLVFINGKSGGRNGPSLRRRLNMLLNPIQIFELSASQGPEVGLQLFHNVKHFRILVCGGDGTVAWVLDAIEKQNYESPPPVAILPLGTGNDLSRVTRWGGGLSSVEGQGGICALLNDVDHAAVTVLDRWNVAIEEKNGAQGQCTKQVKFMTNYLGVGCDAKVAYDFHTTREESPDKFSSQFVNKLLYAREGAKDMMDRSCSDLPWHVSLEVDGKNIEIPEDTEGVIVLNIASYMGGVDLWQNDNEHDDDFISQSMHDKMLEVVCISGTWHLGKLQVGLSRAHRLAQGKVIRFHLHSSFPVQVDGEPWIQPPGCLEISHRGQMFMLRRTSEEPTGHAAAIMSDVLVNAECNGVIDAAQKRLLLHEIALRLSS

SEQ ID NO: 8549 - protein, 707 aa, Hordeum vulgare
MDLVGSLLINMTRWVDPSGIEFFGWLITVGSFGLAALIYGLLRLQREASLYWLKAATREKKAASKALRCPCSSHTWTVDCFRVGQPSTCCVCLSLLGSPQGVGSRAPDADVVCRCSVCGVAAHWYCLQGADKDCKCVTQAGASTLLHHWSERWVEMDDSTEISTFCYYCDEPCGVPFLGVSPIWRCLWCQRQIHVDCHAKLLKETGNTCDLGLLSRLIVPPLSVKQVGQGPATGGVFNSIKEGFVTSSVRGRIRRPRSKKRMKNQSGVKTIPISADSSILDSVLEGFARLQNLNGKYTLANPKLSGNTLKQTRGSDITNGEEKKYELVNLPQDSRPLLVFINGKSGGRNGPSLRRRLNMLLNPIQIFELSASQGPEVGLQLFQNVKHFRILVCGGDGTVAWVLDAIEKQNYESPPPVAILPLGTGNDLSRVTRWGGGLSSVEGQGGICALLNGIDHAAVTVLDRWNVAIKETNGAQGQCTKQVKFMTNYLGIGCDAKVAYDFHTTREERPDKFSSQFVNKLIYAREGAKHMMDRSCSDLPWHVSLEVDGKNIEIPEDAEGVIILNIASYMGGVDLWQNDNNHDDDFSSQSMHDKMLEVVCISGTWHLGKLQVGLSRAHRLAQGRVIRFHLHSSFPVQVDGEPWIQPPGCLEISHRGQMFMLRRPSEEPTGHAAAVMSDVLVNAECNGVIDAAQKRLLLHEIALRLSS

SEQ ID NO: 8550 - protein, 253 aa, Solanum lycopersicum
MFDTGEFSPSSSTAAVSAECFSSSSCFSSLSSSKKKKIHSSNNARRFSDEQIKSLETMFETETKLEPRKKLQLARELGLQPRQVAIWFQNKRARWKSKQLERDYSILKSNYDNLASQYEALKKEKQSLLIQLQKLNDVMQKERGKYCCKQEIESDNRCSVIKKNEMEGMPSLSFDLSSQHGTNGVMSDDDIDSSIRADYLGLDDDAEYHLLKIVETGDSSLTSPENWGCLDDDGILNHQPNSSSYDQWWDFWS

SEQ ID NO: 8551 - protein, 698 aa, Solanum phureja
MPNVKTPHLPTIRRRLQLQLRFLYNNICHFGPAKHINDSIMDSQSSPHGSIIFSTVGRTNYGFDIFSIKSPFSFLNSPVEHRLTDGTSINYNGQFVDEDQTLVFVSERSGAPRIYLRRPSSQVQIEQLPTSIDSLFLDRPFLRNRRLYYISAHQQPKQVFTSSSALYSTNIEDGSKITRLTPYGFADYSPAISQSGHLIAVASYGDRRWPTGEFHDLTTDIVVFPESDPEKRIVVCQHGGWPTWSGDSTIFFHRQADDGWWSIFRVDLPEDKPNLCADPIRVTPPGVHCFTPAAASYNSKSMIAIATRRPGKRYRHIEIFDVESHEFYSVTELLNPTTHHYNPFFSPKSTFLSYHRFRGESSSGDATIPSLDPVISSEKGLRMLRLNGSFPSFSPSGDFIAFNHDFNANSGLEIIKSDGSKKWTLFKGRTAFCNSWSPAEPDVIFTSVGPVFDSVKATVQIARVSFNSLNLTNDDCGKIPVEIEVLTKEETGNNAFPSCSPDGKHIVFRSGRSGHKNLYIMDAVKGELEGGGIRQLTEGPWIDTMPSWSPDGKLIAFSSNRHNPDNVTCFSIYVIHPNGTGLRRIHVAGPEGSDEVDKERLNHVCFSKDCEWLLFTGNLGGVTAEPVSLPNQYQPYGDLYLVKLDGSGLRRLTCNAYENGTPAWHPSAMPMTALDIERNVIVGDKLRGEFDDVLWMNC

SEQ ID NO: 8552 - protein, 779 aa, Solanum phureja
MGKKQQKKVQNQEELLKTLGDFTSKENWDSFFTIRGSDDAFEWYAEWSQLKEPLLSNLTIPSSNDAVSAKELQILVPGCGNSKLSEYLYDEGFCNITNVDFSKVVISDMLRRNIRSRPVMKWRVMDMTNMQFAKESFGAILDKGGLDALMEPELGSKLGTQYLSEVKRLLKVGGRFICLTLAESHVLGLLFPKFRYGWKMGIHPIALKPSDRSSLQTFMVVAEKENSPALCQISSTVDQSSFGGLKNQVHGLFQALEDENKIRADYSSGSDITYALEDLKIGVEGNLAELCPSRRVQLSLGEPGVSLFCYRAVLLDAQKDFGPFAYQCAVFLVPKTRAHEWLFSSEEGQWAVVESSKAARLIMILLDSSHSDANMDDIQKDLSPLIMQLAPGDFDDEAQIPFMAASDGIKQRKIVQEITSPLTGPIIVDDVIYEKVDDNISRLFASDDVIFRRLTFQRTESLVQSEAVLSKEGSPKSVADINQKTGQSSSKSKKGNQKKSGSNVSSSDGLSSDLKVDHSYLASSYHTGIISGFTLISSHLDGLASTGGTVRSVVIGLGAGLLPMFLCKHLSFAEIEVLELDPVVVDLARDYFDFRDDERLKVHVTDGLKYVKDAAHAVTNGYENDVSEAKVPSSNGNSIPSSAPLKNTEKIDMLIVDVDSSDSSSGLSCPAADFVEESFLVAAKDSLSDQGLFVINLVTRSQAIKDSIYSKLKSVFPHLFHLQLDEDVNDVIFALKTETCITEDKFHEASQQLTRLLNLENSPWGQNITEATSKIKRLR

SEQ ID NO: 8553 - protein, 290 aa, Brachypodium distachyon
MGGTTSSTGRGGGTSLGDLPENCVAEVMLRLDPTEICGMARLSRTFRGAASGDGVWEAKLPRNYARLLAAAAAGDDSEEAAALELEAIPKKEVYARLCRRNRLDGGTKEFWLDKVGGGICMAIYSRALSITGIDDRRYWNFITNDESRFHSVAYLSQIWWFEVRGEVEFFFPEGTYSLFFRLHLGRPFKRLGRRVYSADHIHGWDVKPVRFQLSTSDGQHAQSKCYLTDPGVWINHHVGDFVVKNSNEPLNVQFAMVQIDCTHTKGGLCVDSVVIKPQYLAQKMAARTSS

SEQ ID NO: 8554 - protein, 291 aa, Brachypodium distachyon
MGGTTSSTGRGGGTSLGDLPENCVAEVMLRLDPTEICGMARLSRTFRGAASGDGVWEAKLPRNYARLLAAAAAGDDSEEAAALELEAIPKKEVYARLCRRNRLDGGTKEFWLDKVGGGICMAIYSRALSITGIDDRRYWNFITNDESRFHSVAYLSQIWWFEVRGEVEFFFPEGTYSLFFRLHLGRPFKRLGRRVYSADHIHGWDVKPVRFQLSTSDGQHAQSKCYLTDPGVWINHHVGDFVVKNSNEPLNVQFAMVQIDCTHTKGGLCVDSVVIKPQYLAQKMAARTSSV

SEQ ID NO: 8555 - protein, 287 aa, Oryza sativa
MGGVTSSSAGGGGGGETALGDLPESCVAEVLRRLDPPEICRMARLSRTFRGAASGDGVWEAKLPRNYARLLAVAADGEAAALEAIPKKEVYARLCRRNRLDGGTKEFWLDKGGGGVCMTISSRALSITGIDDRRYWNFIPNDESRFHAVAYLSQIWWFEVRGEVEFCFPEGTYSLFFRLHLGRPLKRLGRRVYSSEHIHGWDIKPVRFQLSTSDGQQAQSKCYLTDPGVWINHHVGDFVVKSSNELVKIQFAMVQIDCTHTKGGLCVDSVAVKPQYLAKKKASRIYV

SEQ ID NO: 8556 - protein, 427 aa, Zea mays
MGCGPSIPDKYTIGGKGRKRRSVIQEVAVFVPTIRIPVASDIAHPLRGIVSKDLVDRLSTLRAHVASLAEEIYHADVSAVQELQHALEEYLPVVLGLTTKESRLESSVQFRWKTLDDDQARECCLASAWYEVLSVVHMMAMLALFEANLLLIPKSSQGGGERKVAEDAKKDVVDSLLRASGCLDYSVHRILVQIPAQVKKGFPSYLQEGMLEAISIQALAQCVEIQLGLASECEKATLSVKRRLACEQVSYFSQAHYCLSGCDTSDSYGKKLLLFLKWKWMEAKAVAYYYHGLVLDKGGEPANHISAVCCLSAADDLLSDSKRACLSFCLANPVTRVPPPWGVMKNMHKKIPDVAYKKFQAHGHLFEQNKNSALQSVPDLPEFALSLRPDGYELPSTDSIWDNVDGQPQIQSLKEHMIDDEDEVGTK

SEQ ID NO: 8557 - protein, 424 aa, Oryza sativa
MGCGASIPKKCKVGGKGKKRRSVIQEVAIFVPTIRIPVDSDVAHPLRGLVSKELVDRLSKFRDRVVALSEDIYCADVSDVSELQHALEEYLPVVLGLTMKESRLESSVEFRWRTLDDDEECCLSSAWYEVLSVIHMMAMLALFEANLILIPKNGQVGGERKVSEDAKKDVVDSLLRASGCLDYCVHRILVQMPAQVKKSFPSYFQEGMLEAISIQALAQCVEIQLGLASECEKATLSVKRRLACELVSYFSQAHYCLSGCDTSDSFGKKLLLFLKWKCMEAKAVAYYYHGLVLDKGNEASSHISAVCCLSAADDLVADSKRACLSFCLANPITRVPPPWGIMRNMHKKIPDSACKRFQMYGYLFEQDNNSALQSLPDLPEFALSLRPEGYELPSTDSIWDNVDSQPQIQSLKEHLDDEDEVETK

SEQ ID NO: 8558 - protein, 423 aa, Brachypodium distachyon
MGCGASIPIKYSGKGRKRRSVIQEVAVFVPTIRVPEDTDIVNPLRGLVSKELVDRLAALRANVVSLSEEIYHGDTSAVSELQRALEEYLPIVLGLAIKESRLEASVKFSWRTLDDDQECVLASAWYEVLSVVHMMAMLALFEANLLLIPRNVQDGSERKVSEDAKKDVVDSLLRASGCLDYCVHRILVQIPAQIKKSFPSYLQEGMLEAISIQALAQCVQIQLGLASECDKATLSVKRRLACEQVSYFSQAHYCLSGCDTSDSYGKKLLLFLKWKCMDAKAVAYYYHALVLDKGSEPSNHISSVCCLSAADDLLAESKRACLSFCLANPITRVPPPWGIMKNMHKKIPDVAYKKFQIYGHLLEQNKNSALQSLPDLPEFPLSLRPEGYEFPITDSIWENVDCQPQIQSLKEHLKDDEEVAETK

SEQ ID NO: 8559 - protein, 419 aa, Triticum aestivum
MGCGASVPNGKGRKRRSVVQEVAVFIPTIRVPVATDVVQPLRGLVSKELVDRLATLRTNVVALAEDIYHGDMSAVSELQRALEEYLPVVLGLTAKESRLEASVQFSWRTIDDDQECCLASAWYEVLSVVHMMAMLALFEANLKLIPRDGQNGTEKKVSEDSKKDVVDSLLRASGCLDYSVHHVLVKIPAQIKKGFPSYLQEGMLEAISIQSLAQCVEIQLGLASECEKATLSVKRRLACEQVSYFSKAHYCLSGCDTSDSYGKKLLLFLKWKCMDAKAVAYYYHALVLDKGSEPTNHISTVCCLSAADDILAESKRACLSFCLANPITRVPPPWGIMKNMHKKIPDVAYKKFQIYGHLFEQDKKSALQSLPDLPEFPLSLRPEDYEFPGTDSIWENVDCQPQIQSLKEHLEDETEESSK

SEQ ID NO: 8560 - protein, 225 aa, Panicum virgatum
MARGKVQLRRIENPVHRQVTFCKRRAGLLKKARELSVLCDAHIGIIIFSAHGKLYDLATTGTMEELIERYKTASGEAALPGDGGGGLRMDPKQETVVLQQEINLLHKGLRYIYGNRANEHMNVEELNALERYLEIWMYNIRSAKMQMMIQEIQALKSKEGMLKAANEVLQEKIVEQSGLRDVGMMVADQQNGHFSTVPLIEEITNPLTILSGYSNCRGSEMGYSF

SEQ ID NO: 8561 - protein, 224 aa, Leymus cinereus x Leymus triticoides
MARGKVQLRRIENPVHRQVTFCKRRAGLLKKARELSVLCDADIGIIIFSAHGKLYDLATTGTMDGLIERYKSASGEGMTADGCGDQRVDPKQEAMVLKQEIDLLQKGLRYIYGNRANEHMNVDELNALERYLEIWMFNIRSAKMQIMIQEIQALKSKEGMLKAANEILQEKIVEQHGLLDVGMTIADQQNGHFSTVPLIEEITNPLTILSGYSTCRGSEMGYSF

SEQ ID NO: 8562 - protein, 222 aa, Oryza sativa
MARGKVQLRRIENPVHRQVTFCKRRAGLLKKARELSILCEADIGIIIFSAHGKLYDLATTGTMEELIERYKSASGEQANACGDQRMDPKQEAMVLKQEINLLQKGLRYIYGNRANEHMTVEELNALERYLEIWMYNIRSAKMQIMIQEIQALKSKEGMLKAANEILQEKIVEQNGLIDVGMMVADQQNGHFSTVPLLEEITNPLTILSGYSTCRGSEMGYSF

SEQ ID NO: 8563 - protein, 221 aa, Zea mays
MARGKVQLRRIENPVHRQVTFCKRRAGLLKKARELSVLCDAHVGIIVFSAHGKLYDLATSGTMEELIERYRTASSREAADGCGDNNRMDAKQETMVLQQEINLLQKGLRYIYGNRTNEHMNVEELNALERYLEIWMYNIRSAKMQIMIQEIQALKSKEGMLQAANEVLQEKIVEQSSLLDVGMVVADQQNGHFSTVPLVEEMISNPLTILSGYSNCRGYSF

SEQ ID NO: 8564 - protein, 227 aa, Zea mays
MARGKVQLRRVENPVHRQVTFCKRRAGLLKKARELSVLCDASVGIIVFSAHGKLYDLATTGTMEELIERYKAASAGEATTDGCGRHNRMDPKHETTVLQQEINLLQKGLRYIYGNRANEHMNVDELNALERYLEIWMYNTRSAKMQIMAQEIQALKSKEGMLKAANEILQEKIVEQSSLLDVGMVVADQQNGRFSTVPLVEEVISSNPLTVLSGYSSCRGSEMGYSF

SEQ ID NO: 8565 - protein, 224 aa, Triticum aestivum
MARGKVQLRRIENPVHRQVTFCKRRAGLLKKARELSVLCDADIGIIIFSAHGKLYDLATTGTMDGLIERYKSASGEGMTGDGCGDQRVDPKQEAMVLKQEIDLLQKGLRYIYGNRANEHMNVDELNALERYLEIWMFNIRSAKMQIMIQEIQALKSKEGMLKAANEILQEKIVEQHGLIDVGMTIADQQNGHFSTVPMLEEITNPLTILSGYSTCRGSEMGYSF

SEQ ID NO: 8566 - protein, 232 aa, Brachypodium distachyon
MARGKVQLRRIENPVHRQVTFCKRRAGLLKKARELSVLCDADIGIIVFSAHGKLYDLATTGTMDGLIERYKSASGGEGSMQADGFGDHRMDPKQEAMVLKQEIDLLQKGLRYIYGNRANEQMSVEELNSLERYLEIWMFNIRSAKMQIMIQEIQALKSKEDMLKAANEILQEKIVEQHGLVGHHGLIDVGMTIADQQNGHFSTDPLIEEITNPLTILSGYSTCRGSEMGYSF

SEQ ID NO: 8567 - protein, 463 aa, Arabidopsis lyrata
MDSSLKIIDEAQVPPSNSDSSESLTLPLTFFDLLWYKLHAVERVIFYKLTDATRPFFDSVIVPNLKTSLSSSLSHYLPLAGKLVWEPLDPKPKIIYTPNDAVSFTVAESNADFSRLSGNEPYPTAELYPLVPELQVADDSAAAVSFQVTLFPNQGFCICVNAHHAVLDGKTTTMFLKSWAHTCKNQDSSLPDDLIPIYDRTVVKDPTDLDTKVLNAWHKVGKVFTGGKEPENPKSLKLLWSPEVGPDVFRYTLSLTKENIQKLRERLKKESSSSVSSSPKELRLSTFVIVYSYALTCLIKARGGDPNRPVGYGFAVDCRSLMVPPVPSNYFGNCVSACFKMPIKAESFMSEEGFLAAARLVSDSVEALDENVAWKIPELLEGFATLSPGAQVLSVAGSTRFGVYGLDFGWGRPEKVVVVSIDQGEAISMAESRDGNGGVEIGFSLKKHEMDVLVELLHKGLEN

SEQ ID NO: 8568 - protein, 150 aa, Triticum aestivum
MEVVTGSNGGRLNPWAEPFVPGSWCRPAPVQAAAAEVEDFSPEWWRLVASSPSFRDSWLRDYGDLGLLDADEGPDDSDAFFPPPRHNDGEERKGEAAVKKSGGEVAPWGIEKWWRAHVASPPEVPKYAEKAPAKVLGGGRFSPRTIQQPR

SEQ ID NO: 8569 - protein, 151 aa, Triticum aestivum
MEVVTGSNGGRLNPWAEPFVPGSWCRPAPVQAAAAAEVEDFSPEWWRLVASSPSFRDSWLRDYGDLGLLDADEGPDDSDAFFPPPRHNDGEERKGEAAVKKSGGEVAPWGIEKWWRAHVASPPEVPKYAEKAPAKVQGGGRFSPRTIQQPR

SEQ ID NO: 8570 - protein, 151 aa, Triticum aestivum
MEVVTGSNGGRLNPWAEPFVPGSWCRPAPVQAAAAAEVEDFSTEWWRLVASSPSFRDSWLRDYGDLGLLDADEGPDDSDAFFPPPRHNDGEERKGEAAVKKSGGEVAPWGIEKWWRAHVASPPEVPKYAEKAPAKVLGGGRFSPRTIQQPR

SEQ ID NO: 8571 - protein, 150 aa, Avena sativa
MEVVTGSNGGKLNPWAEPFVPGSWCRPVEVVAEVEDFSPEWWRLVASSPSFRDSWLRDYGDLGLLDADQGPDDGDAFFPPRTPRNEGGEGRKGEAAVKKSGGDVAPWGIEKWWRAHVASPPEIPKYAEKAPAKLAGGGGRFSPRTIQQPR

SEQ ID NO: 8572 - protein, 179 aa, Hordeum vulgare
MGTMKRCMVPGILLMLALQAAMLVAGDEVGSILLPSQGQGEAAAMAAGKKRPWKCCDQAVCTRSIPPICTCMDQVFECPKTCKSCGPSMGDPSRRICQDQYVGDPGPICRPWECCDKAICTRSNPPTCRCVDEVKKCAPTCKTCLPSRSRPSRRVCIDSYFGPVPPRCTPREDVAAGGN

SEQ ID NO: 8573 - protein, 179 aa, Hordeum vulgare
MGTMKRCMVPGILLMLALQAALLVAGDEVGSILLPSQGQGEAAAMAAGKKRPWKCCDQAVCTRSIPPICTCMDQVFECPKTCKSCGPSMGDPSRRICQDQYVGDPGPICRPWECCDKAICTRSNPPTCRCVDEVKKCAPTCKTCLPSRSRPSRRVCIDSYFGPVPPLCTPREDVATGGN

SEQ ID NO: 8574 - protein, 179 aa, Triticum aestivum
HAMGMKRCIVPTILLMLALQSAALLVAGDVGAILLPSQGQVADEAAMAAKKRPWKCCDQAVCTRSIPPICRCMDQVFECPSTCKACGPSVGDPSRRVCQDQYVGDPGPICRPWECCDSPTCTKSNPPTCRCGDEVDKCAPTCKTCLPSRPRPSRRVCLDSYFGPFPPACTPKAVAAGGN

SEQ ID NO: 8575 - protein, 187 aa, Triticum aestivum
GTSKLSKHAMGMMKRCIVPSILLMLALHAALLVAGDVGAILLPSQGEVADEAAMAAKKRPWKCCDKAFCTRSKPPTCRCMDQVFECPSTCKACGPSMGDPSRRVCQDQYVGDPGPICRPWDCCDSPVCTKSNPPTCRCADEVDKCAPTCKTCLPSRPRPSRRVCLDSYFGAFPPACTPSEAVAAGGN

SEQ ID NO: 8576 - protein, 194 aa, Triticum aestivum
MLPAAMAAGLAWSRPRSHAMGMKRCIVPSILLMLALQAALLVAGDVGDILLPSQGQVADEAAMAAKKRPWKCCDQAVCTRSEPPICRCMDQVFECPSTCKSCGPSMADPSRLVCQDQYVGLPGPICRPWECCDSPTCTKSNPPTCRCGDEVDECAPTCKTCLPARSHPSRRVCIDSYFGAFPPACTPSEAVPPV

SEQ ID NO: 8577 - protein, 183 aa, Triticum aestivum
TSKLSKHAMGMKRCVVPSILLMLALQAALLVAGDVDAILLPSQGQDEAAMAAKKRPWKCCDQAVCTRSIPPICRCMDQVFECPSTCKACGPSVGDPSRRVCQDQYVGDPGPICRPWDCCDLPLCTRSNPPTCQCMDEVDKCAPTCKTCLPSRSRPSLRVCIDRYFGPFPPACTPSEAVAAGGN

SEQ ID NO: 8578 - protein, 204 aa, Triticum aestivum
ARGRGYIYYVWLLATNAQASSIKHAMGTKKRCIVPSILLMLALQSAALLVAGDVGAILLPSKGQVADEAAMAAAKKRPWKCCDKAFCTRSIPPICRCMDELFECPSTCKSCGPSMADPSRLVCQDQYVGDPGPICRPWECCDLPRGTRSNPPTCQCLDEVDKCSPTCKTCLPSRSRPSRRVCIDSYFGPFPPACTPKAVAAGGN

SEQ ID NO: 8579 - protein, 184 aa, Triticum aestivum
RKLSKHAMGMKRCIVPSILLMLAVHAALLVAGDVGAILLPSQGQVADEAAMAAKKRPWKCCDLAVCTRSIPPICRCMDQVFECPSTCKACGPSMGDPSRRICQDQYVGDPGPICRPWECCDSPVCTKSNPPTCRCGDEVDKCAPTCKTCLPSRPRPSRRVCIDSYFGPFPPACTPSEAVAAGGN

SEQ ID NO: 8580 - protein, 188 aa, Triticum aestivum
IRHEDAMKMKRCIVPSILLMFSLEAALLVAGRTSAADEVGAILLPSQGQEEAAMAAAKKRPWKCCDQAVCTRSIPPICSCMDQVFDCPSTCKSCGPSMADPSRHVCQDQYVGDPGPICRPWECCDSPTCTRSNPPTCRCGDEVDKCAPTCKTCLPSRSRPSRRVCIDSYFGPFPPACTPSEAVAAGGN

SEQ ID NO: 8581 - protein, 190 aa, Triticum aestivum
GTSTSKLSKQAMGMKRCILPSIMLMLALQSAALLVAGDVGAILLPSQGKVADQAAMAAAKKRPWKCCDQAVCTRSIPPICRCMDQVFECPSTCKACGPSMGDPSRRVCQDQYVGDPGPICRPWDCCDSPVCTKSNPPTCRCADEVDKCAPTCKTCLPSRPRPSRRVCLDSYFGAFPPACTPSEAVAAGGN

SEQ ID NO: 8582 - protein, 422 aa, Leymus cinereus x Leymus triticoides
  misc_feature (63)..(63): Xaa can be any naturally occurring amino acid
  misc_feature (79)..(79): Xaa can be any naturally occurring amino acid
  misc_feature (171)..(171): Xaa can be any naturally occurring amino acid
  misc_feature (173)..(173): Xaa can be any naturally occurring amino acid
  misc_feature (177)..(177): Xaa can be any naturally occurring amino acid
  misc_feature (187)..(187): Xaa can be any naturally occurring amino acid
  misc_feature (194)..(194): Xaa can be any naturally occurring amino acid
MGVDAYRFSIAWPRLIPDGRGAVNPKGLEYYNNLINELLSHGIQPHVTIYHFDFPQALQDEYXGMLSRKFIDDYTAYAXVCFKNFGDRVKYWSTVNEPNIEPIGGYDVGFLPPRRCSFPFGTLSCDNGNSTTEPYIVAHHLLLAHASAASLYKEKYQAKQGGNIGLTLLGXWXEPAXQTPEDIAAAXRMNDFHXGWYMHPLVHGDYPPVMRKNVGSRLPSFTNEELKRVLGSFDFVGFNHYIAAYVKADLSKLDDELRDYMGDAAVKYDMPFLNSKNQLLFGLKSDFMSSTPWALKKMLEHLQLKYKNPVVMIHENGAASIADPSGGNAPDDEFRSQYLQDYIEATLESSRNGSNVQGYFVWSFLDVFEYLFGYRLGFGLYGVDFNSEERTRYQRHSAKWFASFLRGGELRPVALPGQAYSQ

SEQ ID NO: 8583 - protein, 514 aa, Triticum aestivum
MMAALSSVLLLLFVAVATPKAAATITRRDFPPGFIFGTGSSAYQIEGAVAEDGRKPSIWDTFTHSGHSVDGSNADVTADQYHKYKEDVKLLSDMGVDAYRFSIAWPRLIPDGRGAVNPKGLEYYNNLIDELLAHGIQPHVTIYHFDFPQALQDEYNGMLSPKFIDDYTAYAEVCFKNFGDRVKYWSTVNEPNIEPIGGYDQGILPPRRCSFPFGALSCDNGNSTTEPYIVAHHLLLAHASAASLYKEKYQAKQGGNIGLTLLGWWYEPATQTPEDIAAAERMNDFHIGWYMHPLVHGDYPPVMKKNVGSRLPSFTDEELKRVLGSFDFVGFNHYIAVYVKADLSKLDDELRDYMGDAAVKYDMPFLKKNQLLFGLKSDFMTSTPWALKKMLEHLQLKYKNPIVMIHENGAASIADPSAGNAPDDEFRSQYLQDYIEATLESSRNGSNVQGYFVWSFLDVFEYLFGYRMGFGLYGVDFNSEERTRYQRHSAKWFAGFLRGGELRPVALPGQAYSQ

SEQ ID NO: 8584 - protein, 518 aa, Triticum aestivum
MMAPAKALSSVLLLLLVAVATPEAAAATITKRDFPPGFIFGTGSSAYQIEGAVAEDGRKPSIWDTFTHSGHSVDGSNADVTADQYHKYKEDVKLLSDMGVDAYRFSIAWPRLIPDGRGAVNPKGLEYYNNLIDELLAHGIQPHVTIYHFDFPQALQDEYNGMLSRKFIDDYTAYAEVCFKNFGDRVKYWSTVNEPNIEPIGGYDQGILPPRRCSFPFGALSCDNGNSTTEPYIVAHHLLLAHASAASLYKEKYQAKQGGKIGLTLLGWWYEPATQTPEDIAAAERMNDFHVGWYMHPLVHGDYPPVMRKNVGSRLPSFTGEELKRVLGSFDFVGFNHYIAVYVKADLSMLDDELRDYMGDAAVQYDMPFLKKNQLLFGLKSDFMTSTPWALKKMLEHLQLKYKNPIVMIHENGAASIADPSAGNAPDDEFRSQYLQDYIEATLESSRNGSNVQGYFVWSFLDVFEYLFGYRMGFGLYGVDFNSEERTRYQRHSAKWFTSFLRGGELRPVALPGQAYSQ

SEQ ID NO: 8585 - protein, 505 aa, Triticum aestivum
MMAALSSLVLVLLLAVASQEAAATITRGDFPPGFIFGTGSSSYQVEGAVAEDGRKPSIWDTFTHSGHFVDGATADVTADQYHKYKEDVKLLSDMGVDAYRFSIAWPRLIPDGRGAVNPKGLEYYNNLIDELLAHGIQPHVTIYHFDFPQALQDEYDGMLSRRFIDDYTAYAEVCFKNFGDRVKYWSTVNEPNIEPVGGYDTGINPPRRCSFPFGALSCDNGNSTTEPYIVAHHLLLAHASAASLYKDKYQAKQGGNIGLTLLGWWYEPATQTPEDIAAAERMNDFHIGWYMHPLVHGDYPPVMRKNVGSRLPSFTDEELKRVLGSFDFVGFNHYIALYVKDDLSKLDDELRDYIGDAAVKYDMPFLNPKNQSSTPWALKKMLGHLQLKYKNPVVMIHENGAASIADPSAGNAPDDEFRSQYLQDYIEATLESSRNGSNVQGYFVWSFLDMFEYIFGYRMGFGLYGVDFNSEERTRYQRHSAKWFTGFLRGGDLRPVALPGKVYSQ

SEQ ID NO: 8586 - protein, 517 aa, Triticum aestivum
MMAAAKALSSLVLVLLLAVASQEAAATITKRDFPPGFIFGTGSSAYQIEGAVAEDGRKPSIWDTFTHSGHSVDGSNADVTADQYHKYKEDVKLLSDMGVDAYRFSIAWPRLIPDGRGAVNPKGLEYYNNLIDQLLAHGIQPHVTIYHFDFPQALQDEYNGMLSRKFIDDYTAYAEVCFKNFGDRVKYWSTVNEPNIEPIGGYDQGILPPRRCSFPFGFLSCDNGNSTTEPYIVAHHLLLAHASAASLYKEKYQAKQGGNIGLTLLGWWYEPATQTPEDIAAAERMNDFHIGWYMHPLVHGDYPPVMRKNVGSRLPSFTDEELKRLLGSFDFVGFNHYIAVYVKADLSKLDDELRDYMGDAAVKYDMPFLKKNQLLFGLKSDFMTSTPWALKKMLEHLQLKYKNPIVMIHENGAASIADPSAGNAPDDEFRSQYLQDYIEATLESSRNGSNVQGYFVWSFLDVFEYLFGYRMGFGLYGVDFNSEERTRYQRHSAKWFTGFLRGGELRPVALPGQAYSQ

SEQ ID NO: 8587 - protein, 513 aa, Hordeum vulgare
MMAAAKALFLLLLAVASPAAAAITKRDFPPGFIFGTGSSAYQIEGAVAEDGRKPSIWDTFTHSGYSVDGSNADVTADQYHKYKEDVKLLSDMGVDAYRFSIAWPRLIPDGRGAVNPKGLEYYNNLIDELLAHGIQPHVTIYHFDFPQALQDEYNGMLSRKFVDDYTAYAEVCFKNFGDRVKYWSTVNEPNIEPIGGYDQGILPPRRCSFPFGVLSCDNGNSTTEPYIVAHHLLLAHASAASLYKEKYQAKQGGNIGLTLLGWWYEPATQTPDDIAAAERMNDFHIGWYMHPLVHGDYPPVMRKNVGSRLPSFTDEELKTVLGSFDFVGFNHYIAVYVKADLSKLNDELRDYMGDAAVKYDMPFLNSKNQLLFGLKKDFTPSTPWALNKMLGHLQLKYKNPVVMIHENGAASIADPSAGNAPDDEFRSQYLQDYIEATLESSRNGSNVRGYFVWSFLDVFEYLFGYRMGFGLYGVDFNSEERTRYQRHSAKWFTSFLRGGELRPVALPGNAYSQ

SEQ ID NO: 8588 - protein, 501 aa, Brachypodium distachyon
MAQTAAAFVFLLLAAAASAAAGKITKDDFPPGFVFGTGSSAYQIEGAVAEDGRKPSIWDTFTHSGYSIDGATADVTANQYHKYKEDVKLLSEMGVDAYRFSIAWPRLIPDGRGAVNPKGLEYYNNLIDELLSYGIQPHVTIYHFDFPQALQDEYKGMLSRRFIEDYTAYAEVCFKNFGDRVKYWSTVNEPNVEPIGGYDQGILPPRRCSFPFGTLSCDQGNSTTEPYIVAHHLLLAHASAASLYKEKYQAKQGGHIGLTLLGWWYEPATQTPEDIAAAGRMNDFHIGWYMHPLVHGDYPPVMRKNVGSRLPSFTAEELKRVHGSFDFVGFNHYIAIYVKADLSKLDQPLRDYMGDAAVAYDSKDDIMTSTPWALKKMLGHLQLKYKNPVVMIHENGAASMPDPSGGNTYDDEFRSQYLQDYIEAALESIRDGSNLQGYFVWSFLDVFEYLFGYRMGFGLYGVDFGSEARTRYQRHSAKWFASFLRGGELRPVALPGKAYSQ

SEQ ID NO: 8589 - protein, 302 aa, Oryza sativa
MAMRRWREDAVALSLRGCGFGDGDDDRPEKPRRYGVTEMRSPFYAFRPAHHALQEILDSLGPFVDGLKFTGGSHSLMGKELVREITDLAHKHDIYVSTGDWAEHLLRQGPSFFKQYVEECKALGFDTIELNAGSLKLPEEALLRLVRLIKTSGLQAKPLFSVKFDSSDIPPSGDRAFGAYIVPVKQNSERVEDVDLLIRRAERCLEAGADMIMIDADDICQRADSLRADIVAKIVGRLGLEKTMFEASNPNTSEWFVRRYGPRVNLFVDHSDVMNLERLRGFNMRGVCNSPLFGIGSPFFLM

SEQ ID NO: 8590 - protein, 228 aa, Triticum aestivum
MMRSCLPLALLVALSAVGCAAAQAADYDFFYLVLQWPGSYCDTKQSCCYPRSGKPAADFGIHGLWPNRDDGTYPQNCNPANAFDPSKVSDLLSTLRREWPTLACPTSDGLQFWAHEWEKHGTCAQNLFNEHGYFQTALHLRDQLRVLDALTSAGVSPDGGYYTLSAIKGAIQQGTGFEPFVECNRDESGNSQLYQLYFCVDANASGFVECPVQPGGRPCGNRIEFPTF

SEQ ID NO: 8591 - protein, 228 aa, Triticum aestivum
MMRSCLSLALLVALSAAGCAAAQAADYDFFYLVLQWPGSYCDTKQSCCYPRSGKPAADFGIHGLWPNRDDGSYPQNCNPANAFDPSKVSDLLSSLRTEWPTLACPTSDGLQFWAHEWEKHGTCAQNLFNEHGYFQTALHLRDQLRVLDALTAAGVSPDGGYYTLSAIKGAIQQGTGFEPFVECNRDESGNSQLYQLYFCVDANASGFVECPVQPGGRPCGNRVEFPTF

SEQ ID NO: 8592 - protein, 228 aa, Triticum aestivum
MMRSCLPLALLVALSAAGCAAAQAADYDFFYLVLQWPGSYCDTKQSCCYPRSGKPAADFGIHGLWPNRDDGSYPQNCNPANAFDPSKVSDLLSSLRREWPTLACPTSDGLQFWAHEWEKHGTCAQNLFNEHGYFQTALHLRDQLRVLDALTSAGVSPDGGYYTLSAIKGAIQQGTGFEPFVECNRDESGNSQLYQLYFCVDANASGFVECPVQPGGRPCGNRVEFPTF

SEQ ID NO: 8593 - protein, 228 aa, Leymus cinereus x Leymus triticoides
  misc_feature (16)..(16): Xaa can be any naturally occurring amino acid
  misc_feature (20)..(20): Xaa can be any naturally occurring amino acid
  misc_feature (151)..(151): Xaa can be any naturally occurring amino acid
  misc_feature (177)..(177): Xaa can be any naturally occurring amino acid
  misc_feature (181)..(181): Xaa can be any naturally occurring amino acid
MMRSCFSLALLVALSXVGCXAAQAADYDFFYLVLQWPGSYCDTKQSCCYPRSGKPAADFGIHGLWPNRDDGSYPQNCNPANAFDPSKVSDLLSSLRTEWPTLACPTSDGLQFWAHEWEKHGTCAQNLFNEHGYFQTALRLRDQLRVLDALXSAGVSPDGGYYTLSAIKGAIQQGTGXEPYXECNRDESGNSQLYQLYFCVDAGASGFVECPVQPGGRPCGNRIEFPAF

SEQ ID NO: 8594 - protein, 227 aa, Avena sativa
MRTHLSLAFLLVLAAGCAASAAAQDYDFFYLVLQWPGSYCDTKQSCCYPRSGKPAADFGIHGLWPNRDDGSYPQNCNPNSAFDPSKVSDLLSSLRSNWPTLACPTSDGLKFWAHEWEKHGTCAQNLFNEHGYFQTALSLRDELKVLDALAAAGISPDGGYYTQAAIKSAIQQGTGYAPYVDCNRDESGNTQLYQLYFCVTADASGFVECPVSPGGRPCGNRVEFPAF

SEQ ID NO: 8595 - protein, 230 aa, Triticum aestivum
MRLQCSLVLLIALSVGCAAAQESGKQAGYDFFYLVLQWPGSYCDTKQSCCYPRSGKPAADFGIHGLWPNRDDGSYPQNCNPDSAFDPSKVSDILSSLRSSWPTLACPTNDGLRFWAHEWEKHGTCAQNLFNEHGYFQAALRLRGQLRVLDALATAGISPDGGYYTMGAIKGAIQEGTGFAPHVDCNRDESGNSQLFQLYFCVHADASRFVECPVQPGGRPCGNRIEFPAF

SEQ ID NO: 8596 - protein, 229 aa, Brachypodium distachyon
MRAHLSLAVLLVLTIGCAAPALAAAQDYDFFFLVLQWPGSYCDTKKSCCYPKSGKPAADFGIHGLWPNRDDGTYPQDCNPDNAFDPSKVSDLLGSMRKNWPTLACPTNDGVRFWGHEWEKHGTCAENLFDEHGYFSTALRLRDQLRVLDALRSGGISPDGGYYTLSAIKGAIQQGTGFEPFVECNRDESGNSQLYQLYFCVDAGATKFVECPVSPGGRPCGNRIEFPAF

SEQ ID NO: 8597 - protein, 264 aa, Sorghum bicolor
MFLFLSISLLCNSFGNTVNDHMRSTLSFDNKQSPFASQNIDYGQTIACISYPYNHSGSGGVWAAYESGTTATTVFHSQISGGGARIPLPLELAENEPIYVNPKQYHGILRRRQLRAKLEAQNKLVKARKPYLHESRHLHAMKRARGSGGRFLNTKQFQQQQQSHTASTRSTTNGTSSSGSTHLRLGGGAAGDRSMLAPKTMASQDSSKKAVSSALAFTVTPMLHRDDAFLQHPSHYLSFSGHFGQASVQAGMHNGSQHRVPFMR

SEQ ID NO: 8598 - protein, 296 aa, Saccharum officinarum
MSGGGQDLQLPPGFRFHPTDEELVMHYLCRRCASLPIAVPIIAEIDLYKFDPWQLPRMALYGEKEWYFFSPRDRKYPNGSRPNRAAGSGYWKATGADKPVGTPKPLAIKKALVFYAGKAPKGEKTNWIMHEYRLADVDRSARKKNSLRLDDWVLCRIYNKKGGLEKPAAASSGDHKPMVFAAGAVSSPPEQKPFVATPGGLPPAAFTADLAAYYDRPSDSMPRLHADSSCSEQVLSPEQLACDREVQSQPKISEWERTFASDPVNPAGSMLVDPVVGGHAGDPLLQDILMYWGKPF

SEQ ID NO: 8599 - protein, 295 aa, Zea mays
MSGAGPDLQLPPGFRFHPTDEELVMHYLCRRCAGLPIAVPIIAEIDLYKFDPWQLPRMALYGEKEWYFFSPRDRKYPNGSRPNRAAGAGYWKATGADKPVGTPKPLAIKKALVFYAGKAPKGEKTNWIMHEYRLADVDRSARKKNSLRLDDWVLCRIYNKKGGGLEKAAAPAAGGDHKPVFATAAVSSPPEQKPFVAAAGGLPPAFPELAAYYDRPSDSMPRLHADYSSCSEQVLSPEQLACDREVQSQPKISEWERTFASDPVNPAGSMLDPVVGHAGGDPLLQDILMYWGKPF

SEQ ID NO: 8600 - protein, 303 aa, Oryza sativa
MSGGQDLQLPPGFRFHPTDEELVMHYLCRRCAGLPIAVPIIAEIDLYKFDPWQLPRMALYGEKEWYFFSPRDRKYPNGSRPNRAAGSGYWKATGADKPVGSPKPVAIKKALVFYAGKAPKGEKTNWIMHEYRLADVDRSARKKNSLRLDDWVLCRIYNKKGGLEKPPAAAVAAAGMVSSGGGVQRKPMVGVNAAVSSPPEQKPVVAGPAFPDLAAYYDRPSDSMPRLHADSSCSEQVLSPEFACEVQSQPKISEWERTFATVGPINPAASILDPAGSGGLGGLGGGGSDPLLQDILMYWGKPF

SEQ ID NO: 8601 - protein, 298 aa, Triticum aestivum
MSGGQELNLPPGFRFHPTDEELVTHYLCRRCAGAPIAVPIITEIDLYKFDPWQLPKMALYGEKEWYFFSPRDRKYPNGSRPNRAAGSGYWKATGADKPVGTPKPLAIKKALVFYAGKAPKGEKTNWIMHEYRLADVDRSARKKNSLRLDDWVLCRIYNKKGGLEKPASVDRKPAAMGGYGGPPGAMVSSPQEQKPVMGMNANGGGGVQPFPDFAAYYDRPSDSMPRLHADSSCSEQVLSPDFPAGEVQSQPKISEWERSFASGGDPVNPAAGSMLEPNGGFGGDPLLQDILMYWGKPF

SEQ ID NO: 8602 - protein, 299 aa, Triticum aestivum
MSGGQELNLPPGFRFHPTDEELVTHYLCRRCAGAPIAVPIITEIDLYKFDPWQLPKMALYGEKEWYFFSPRDRKYPNGSRPNRAAGSGYWKATGADKPVGTPKPLAIKKALVFYAGKAPKGEKTNWIMHEYRLADVDRSARKKNSLRLDDWVLCRIYNKKGGMEKPAAVDRKPAAMGGYGGGPGAMASSPPEQKPVMGMNANGGGGGAQPFRDFAAYYDRPSDSMPRLHADSSCSEQVLSPEFPAGEVQSQPKISEWERSFASGGDPVNPAAGSMLEPNGGFGGDPLLQDILMYWGKPF

SEQ ID NO: 8603 - protein, 292 aa, Brachypodium distachyon
MSGGQDLQLPPGFRFHPTDEELVMHYLCRRCAGAPIAVPIIAEIDLYKFDPWQLPKMALYGEKEWYFFSPRDRKYPNGSRPNRAAGSGYWKATGADKPVGSPKPVAIKKALVFYAGKAPKGEKTNWIMHEYRLADVDRSARKKNSLRLDDWVLCRIYNKKGGLEKPAAADQKPPLMGGYGAAAMASSPPEQKPLVGSGMAPPAFPDYAAYYDRPSDSMPRLHADSSCSEQAAVLSPDQFPGGGEVQSQPKISEWERSFSTTTADNPASAGGGLGLGGDPLLQDILMYWGKPF

SEQ ID NO: 8604 - protein, 294 aa, Avena sativa
MSGGGQELQLPPGFRFHPTDEELVTHYLCRRCDGAPIAVPIIAEIDLYKFDPWQLPKMALYGEKEWYFFSPRDRKYPNGSRPNRAAGSGYWKATGADKPIGTPKPLAIKKALVFYAGKAPKGEKTNWIMHEYRLADVDRSARKKNSLRLDDWVLCRIYNKKGGLEKLEPAERKPVVTGNYAGPGVMVSSPPEQKPVLGMPPTNGGGVPAFPDYAAYYDRPSDSMPRLHADSSCSEQVLSGERGGGGEVQSQPKISEWERSFATVSDPVNPAAGGLGLGGDPLLQDILMYWGKPF

SEQ ID NO: 8605 - protein, 300 aa, Leymus cinereus x Leymus triticoides
  misc_feature (265)..(265): Xaa can be any naturally occurring amino acid
MSGGQELNLPPGFRFHPTDEELVMHYLCRRCAGAPIAVPIITEIDLYKFDPWHLPKMALYGEKEWYFFSPRDRKYPNGSRPNRAAGSGYWKATGADKPVGTPKPVAIKKALVFYAGKAPKGEKTNWIMHEYRLADVDRSASARKKNSLRLDDWVLCRIYNKKGGMEKPASVDRKPAAVGGYGGPVAMVSSPPEQKPVMGMNTNGGGGVQPFPDFAAYYDRPSDSMPRLHADSSCSEQVLSPGERVGGEVQSQPKIIEWERSFASXGDPVNPAAGSILEPNGGFGGDPLLQDILMYWGKPF

SEQ ID NO: 8606 - protein, 304 aa, Hordeum vulgare
MSGGQELNLPPGFRFHPTDEELVMHYLCRRCAGAPIAVPIITEIDLYKFDPWQLPKMAMYGEKEWYFFSPRDRKYPNGSRPNRAAGSGYWKATGADKPVGTPKPLAIKKALVFYAGKAPKGEKTNWIMHEYRLADVDRSARKKNSLRLDDWVLCRIYNKKGGMEKPASVDRKPVTMGGYGVGPGAMASSPQEQKPVMGMNANGGGSGGVQPFPDFAAYYDRPSDSMPRLHADSSCSEQVLSPDFPGERGGGEVQSQPKISEWERSFASGGDPVNPAAGSILEPHGGFGGDPLLQDILMYWGKPF

SEQ ID NO: 8607 - protein, 631 aa, Zea mays
MENLRRFLNPLVLNLQKMELELTCPVCLKLLTSPTTLPCYHTSCSKCALTPTSKGYSCAICKSGYCSQDLRPASHLESIVSIHRSLSSTVSTMIEQQDSQINIHVAKAASHGTPESGNRSGVEEKSDQMKSYNPVASKLVYNQPTGPAFGNIDSVQAKDPAFENNAGAAAVAPMAFVRKGHSGSQSSDGPGDLDCDSNDLEGELMTSLSPLQTALKREANAMDDHTRELKKQKSNDQVQRQTNMASAWKCEFCHSSQVTECTGPLSHYLNGEPVEADQAWKSSVQHVHEKCIEWAPQAFFTGDTANNLGPELARASKIKCSVCGLKGAALGCLVKSCRKSFHVPCAYNIKGCKWDQENFVMLCPTHSSKKLPCERLKPKKKAKLQQPSSDIDGPISPSPMQRAELWTASPFLTSEWVICGSALVGHEKEILDQFECHTGITVTNTWSSDVTHVIANTDERGACARTLKVLMAILAGKWVLNVNWLKACMEAREPVPEEPYEIRCDVHGSVDGPRSGRLRAMQQAPGLFAGLTFYFSGHFMPGYRANLEDLIAAAGGSVLEKAELSSTSLILYSMEAPPPHNNLDALETINKRLAEAQELATTAGCKAIPHTWLLDCIASCAVELNVSCSTA

SEQ ID NO: 8608 - protein, 1088 aa, Zea mays
MEPPSPPATHSAAVRVLSRTPPPTSPNPSSTGPAAPSPASRDGVVAVGFVGAAGTARLADRILDAHVFSPGGSAGSLAGRVRYHRDAGKRMVFLHLTPPPPAPLEAVAGCCDDGELPEMLFMFSVCHVIIFLQQGFRFNTQTLKKFRLLQSSKHALAPFVKPLVAAAMPARTVASDTPTRATHRASSVSPPTRRGGHAGRQSSAISLMSGTSSTPSVLPGQCIPVLLFVFEDDAVDVSSAAASPDDIGDASSSNQGSTPDGLPKQSLASKSSGSVIMLSRAANKSEGSSGKKLHSSLEGQIRVLIKKCRVLAGMEPGHIGPRGVSNMSHHLPLFSLDTSRVVALLERYINKKQEPLDTIAGLFEDSLCSKSPLDILSLENNYHPTNHDDFQLIKDFIFRQSDALRGKGGYSSNASAGSVAGVGMVAAAAAAAAASAASGKPVNAPDLPTFDKWLSISTSILTALLSGRNVLRCQSESKTHTSPTEKNGQLPVGSNAIEIALSCLESNNGLNMKFSSSWCQRVLPAAKEIYLKGLPAFYPTRMHEVQLQKALRSFGSMVKGPAVRVFSKKLEDECRAIWESGRQQCDAVSLTGRPCKHRRHGDFFSSDAMEQHSSGYVFLHACSCGRSRRLRDDPFDFQTANVSFNCFQNCDDLLPTLALPRGSNDGSFSVSSWCLVRLGGARYYKPTKGLLQSGFSSKERYLLRWIVSVHKGQVRNDIRSNTITSSARSGMNPQTPPIVTGEVKSAITQVTAQIKYAKLENSGKQAEVEPVSNLGINFGKGLPNFTMKKPFSEVVAGTTSKDTEFPALQQTRPPKPGGRKDEQRQMNIVDQTNGRGHVAVSQGSVAETESAKASRNKSSENADGKPFLQIGSNIVPVIAGNETRETSQPVQQFVVYIGFEHECPYGHRFLLSEKHMKEIESSCLQYQRPHLNKEAEVKHAQKLLQNASGLIASAVDINSARKNSKPLESSGRNSQQQSLQLRIDAETSQPSPRLSDPQNAKRWEHYFRSVTIDDGGEAFSLMNRNLPIYMRCPHCKVSERKEHQDVKFAGVVSQLQRIFIVTPDFPVLLASCPLVQFEARVMFAIKCL

SEQ ID NO: 8609 - protein, 318 aa, Zea mays
MASISEPAAREKPIVVRVKRKPSQNRPDAFWLEINERPAKKAAIDFSRLSISEPSSSSASVKASEEPRVKKILVQHIETVHHSEAVEDVLQSLLLVDSNSKETKSKTKEWNDRIKQDKKPEQLRSAARQRHEDMGRNARFAQIWKSRKGEKADAGDSLREICHLYDAVQVDPDDEKHPAEPRITSFEEGAVLCNFLPLIREYLPSTAEEIEADIISLAQSEDSEVYDIYTVKEVDDTMEATSAASYPRLQVDDGEDECYEDCPYDTDDSNAEDNPLFDYPDESSEDEDDGRNDEDPFGDKEGSDSDYEKEEVEVEEDE

SEQ ID NO: 8610 - protein, 502 aa, Zea mays
MAPWPRRPVLTLVLLLLLALLCSHVALCSSAEPGKPKPKPKVSGSRKALLADNDGDEVPAAKPGKSAAAGKTKKKLLAGDATSKNQTKVAKAKKPESAAAAKGAAKKPAGKAAAAAGGDAAIAKVSKAPKTPKADKAKVPKPDKAATAAAAGAKTKGADSAKPAKVSKTGAKAVKPPKTAKSEAATAVGKAKKPPPANSTVDAGAKTAKSGKKAPVVVDAEVKANATVVSKEKSAATETVEMEDEEEVVLAKEAGEGTDDLISEFRDLPSRLQETLMPDLARLSHHSKAYLSAANAGIADGVRPILGGRWAAVAASAASVAVLLLPLFMLTALVRRMGPYLPLLHRALLLAQAYLAIYFATLALAAAATGLEPLRFFHAASPAAYAWTQAAQSLGFMGYLVLQMVDLVAVFSDAASPEDEGNGDAAKALGLAQMVVGLAVGLHYYAAVFHRAAAGEAPRANWRVYAVYAACFAIVCACARAERRKKAYLAGTDGAAEEWKKS

SEQ ID NO: 8611 - protein, 479 aa, Saccharum officinarum
MADGGEATTPLLEGKPKVYFDGCPGCANDRRKAENPGIPYGQFFHIWIIILVSCLPISLLFPFIYFMIRDLHIAERVEDIGFYAGFVGASYMLGRALTSTAWGMIADRIGRKPVIILAIISTLLFNTLFGLSVKYWMAIATRFLLGSLNGLLGPIRAYAVEVCRTEHQAIGLTLVSTSWAIGLIIGPAIGGYLAQPVEKYPKLFPANSIFGRFPYFLPCLCVSFFCLVILISCIWLPETLHKHKLHKTEDQGIEEFPEQQNSSTTNKSLLKNWPLMSSIILFCVTAFDDMAYTEIFSLWAESDKKYGGLGFSSEDVGQVLAVTGASILLYQTFVYPRIVKVLGPVNASRIAAILAMVLLFTYPPMTRLSKPWLSVVVNIASVLKNNLVVTIVTCSFILQNNSVPQEQRATANGLATTLMSFFKAFAPAGAGVVFSWAQKRQHAFLFPGDQMVFFLLDIVIFVELIWTFKPFLAIREQIS

SEQ ID NO: 8612 - protein, 479 aa, Saccharum officinarum
  misc_feature (286)..(286): Xaa can be any naturally occurring amino acid
  misc_feature (475)..(475): Xaa can be any naturally occurring amino acid
MADGGEATTPLLEGKPKVYFDGCPGCANDRRKAENPGIPYGQFFHIWIIILVSCLPISLLFPFIYFMIRDLHIAERVEDIGFYAGFVGASYMLGRALTSTAWGMIADRIGRKPVIILAIISTLLFNTLFGLSVKYWMAIATRFLLGSLNGLLGPIRAYAVEVCRTEHQAIGLTLVSTSWAIGLIIGPAIGGYLAQPVEKYPKLFPANSIFGRFPYFLPCLCVSFFCLVILISCIWLPETLHKHKLHKTEDQGIEEFPEQQNSSTTNKSLLKNWPLMSSIILFCVTXFDDMAYTEIFSLWAESDKKYGGLGFSSEDVGQVLAVTGASILLYQTFVYPRIVKVLGPVNASRIAAILAMVLLFTYPPMTRLSKPWLSVVVNIASVLKNNLVVTIVTCSFILQNNSVPQEQRATANGLATTLMSFFKAFAPAGAGVVFSWAQKRQHAFLFPGDQMVFFLLDIVIFVELIWTFKPFLAIXEQIS

SEQ ID NO: 8613 - protein, 487 aa, Glycine max
MEEENVKQPLLERKYHENCPGCKVDQAKELSEGKGVPVTNLFIIWMVVLCAALPISSLFPFLYFMVRDFNIAKTEADISSYAGYVGSAFMFGRCLTSVLWGIIADRYGRKPVIVIGIIVVVIFNTLFGLSTSFWMAVIMRFLLGSLNGLLGPVKAYATELFREEHQALGLSTVSAAWGIGLIIGPALGGYLAQPVEKYPHIFPKDSFWDKFPYLPNFIISAVAFVVVIGCIWIPETLHNHKCRNESIDNAETLKNGGNVAGKDKIIQKKENLLLNWPLMSSVIVYCVFALHDIAYQEVFSIWAVSPQRLGGLNFTTDDVGNVLSISGLALIIYQLIIYPYVEKASGPIVIGRISGMISIPLLQSYPFIALLSGLALYIVLSVASILKNLLSVTINTGLFLLQNRAVEQHQRGAANGISMTGMSLFKSIGPATGGAILTWSQKRMDASFLPGTHMVFFVLNIVEGLGILMLFKPFLVEKKKTHSNQLH

SEQ ID NO: 8614 - protein, 487 aa, Vigna unguiculata
MEEEKGKQPLLERKKYYENCPGCKVDKAKELSEGQGVPFTELFIMWMVALSAALPISSLFPFLYFMVRDFNIAKTEADISTYAGYVGSVFMLGRCLTSFLWGTIADRFGRKPAILIGVTSVVIFNTLFGLSTSFWMAIITRFLLGSFNGYLGPVRAYASELFREEHQALGLSTVSSAWGIGLIIGPSLGGYLAQPVEKYPNIFPKDSFWDKFPYFLPNLITSTFAFVVAIGCIWIPETLHNHKCGNESTEDAEALENGSGGTDNEKITKKNENLFLNWPLMSSVITYCVFSLHDMAYQEIFSLWAVSPQKLGGLNFTTNDVGNILSVSGLALIIYQLALYPFVQRKSGAIGSARISAMLSIPLLQSYPFIALFSGLALYVGLSTASILKNILSITIVTGLFLQQNRLVEQHQRGAANGISMTGMSLFKAIGPATGGAVLAWSEKRMDSSFLPGTHMVFFVLNIVEAVGLLMMFKPFLGEKKKPDQLQ

SEQ ID NO: 8615 - protein, 455 aa, Solanum phureja
MYSCYNTKMGLFRFFASTILVLFLLSSFSFHSTDAFDPLDPNGNITIKWDVISWAPDGYVAVVTMYNFQQYRHIQAPGWSLGWTWAKKEVIWTMMGGQTTEQGDCSKYKGNIPHCCKKDPTVVDMLPGTPYNQQIANCCKGGVINSWGQDPANAVSSFQISVGAAGTTNKTVRVPKNFTLKAPGPGYTCGPAKIVKPTKFVSADGRRVTQAMMTWNVTCTYSQFLAQKTPTCCVSLSSFYNDTIVPCPTCTCGCQSNGTQRGSCVDPETPHLASVVSDHGKNNYVPLVQCTKHMCPIRIHWHVKLNYKEYWRVKITITNFNYRMNYTQWNLVVQHPNFDNLTTLFSFNYKSLTPYGSINDTAMLWGVKFYNDLLMQAGPSGNVQSELLFRKDASTFTFEKGWAFPHRIYFNGDNCVMPPPDAYPYLPNAGSRWEVSLITLVVTLIASMAVVLTYI

SEQ ID NO: 8616 - protein, 444 aa, Solanum lycopersicum
MEFFRSTILLVFLLSCFSFSATDAFDALDPNGNITIKWDVISWTPDGYVAVVTMFNFQQYRHIQAPGWTLGWTWAKKEVIWGMMGAQTTEQGDCSKFKGNIPHCCKRDPTVVDLLPGTPYNQQIANCCKGGVINSWGQDPETAVSSFQVSVGAAGTTNKTVRVPKNFTLKAPGPGYTCGPAKVVKPTKFSSGDGRRITQAMMTWNVTCTYSQFLAQKTPTCCVSLSSFYNDTIVPCPTCTCGCQKNGTQHGNCVDQDEPHLASVVSGLGKNNYAPLVQCTSHMCPIRIHWHVKLNYKEYWRVKVTITNFNYNMNYTQWNLVVQHPNFDNLTQLFSFHYKSLTPYGAINDTAMLWGMKFYNDLLMQAGPLGNVQSELLFRKDMSTFTFEKGWAFPHRVYFNGDNCVMPQPDSYPYMPNAGTVWKVSSLKLVVTLILSMAFFFATV

SEQ ID NO: 8617 - protein, 452 aa, Nicotiana tabacum
  misc_feature (26)..(26): Xaa can be any naturally occurring amino acid
MEFFRSLPRFTATAVLLVFLLSCFSXKSTDAFDPLDPNGNITIKWDVISWTPDGYVAVVTMFNFQQYRHIQAPGWTLGWTWAKKEVIWNMMGAQTTEQGDCSKFKGNIPHCCKKDPTIVDLLPGTPYNQQIANCCKGGVINSWGQDTATAVSSFQVSVGAAGTTNKTVRVPKNFTLKAPGPGYTCGPAKIVKPTKFVTQDGRRVTQAMMTWNVTCTYSQFLAQKTPTCCVSISSFYNDTIVPCPTCTCGCQKNGTQHGNCVDQDEPHLASVVSDHGKKNTYAPLVQCTNHMCPIRIHWHVKLNYKEYWRVKVTITNFNYNMNYTQWNLVVQHPNFDNLTQLFSFNYKSLTPYGAINDTAMLWGMKFYNDLLMQAGPLGNVQSELLFRKDLSTFTFDKGWAFPRRVYFNGDNCVMPPPDSYPYMPNVGTVWKVSSLKLVVTLMLSTAFFFASI

SEQ ID NO: 8618 - protein, 444 aa, Solanum tuberosum
MEFFRSTILLGFLLSCFSFSATDAFDALDPNGNITIKWDVISWTPDGYVAVVTMFNFQQYRHIQAPGWTLGWTWAKKEVIWGMVGAQTTEQGDCSKFKGNIPHCCKRDPTVIDLLPGTPYNQQIANCCKGGVINSWGQDPETAVSSFQVSVGSAGTTNKTVRVPKNFTLKAPGPGYTCGPAKVVKPTKFLTNDGRRVTQAMMTWNVTCTYSQFLAQKTPTCCVSLSSFYNDTIVPCPTCTCGCQKNGTQHGNCVDQDEPHLASVVSGLGKNNYAPLVQCTSHMCPIRIHWHVKLNYKEYWRVKVTITNFNYNMNYTQWNLVVQHPNFDNLTQLFSFHYKSLTPYGAINDTAMLWGMKFYNDLLMQAGPLGNVQSELLFRKDMSTFTFEKGWAFPHRVYFNGDNCVMPQPDSYPYMPNTGTVWKFSSLKLVVTLMLSMAFFFATV

SEQ ID NO: 8619 - protein, 444 aa, Solanum tuberosum
MEFFRSTILLGFLLSCFSFSATDAFDALDPNGNITIKWDVISWSPDGYVAVVTMFNFQQYRHIQAPGWTLGWTWAKKEVIWGMVGAQTTEQGDCSKFKGNIPHCCKRDPTVIDLLPGTPYNQQIANCCKGGVINSWGQDPETAVSSFQVSVGSAGTTNKTVRVPKNFTLKAPGPGYTCGPAKVVKPTKFLTNDGRRVTQAMMTWNVTCTYSQFLAQKTPTCCVSLSSFYNDTIVPCPTCTCGCQKNGTQHGNCVDQDEPHLASVVSGLGKNNYAPLVQCTSHMCPIRIHWHVKLNYKEYWRVKVTITNFNYNMNYTQWNLVVQHPNFDNLTQLFSFHYKSLTPYGAINDTAMLWGMKFYNDLLMQAGPLGNVQSELLFRKDMSTFTFEKGWAFPHRVYFNGDNCVMPQPDSYPYMPNTGTVWKFSSLKLVVTLMLSMAFFFATV

SEQ ID NO: 8620 - protein, 444 aa, Solanum phureja
MEFFRSTILLVFLLSCFSFSATDAFDALDPNGNITIKWDVISWSPDGYVAVVTMFNFQQYRHIQAPGWTLGWTWAKKEVIWGMVGAQTTEQGDCSKFKGNIPHCCKRDPTVIDLLPGTPYNQQIANCCKGGVINSWGQDPETAVSSFQVSVGSAGTTNKTVRVPKNFTLKAPGPGYTCGPAKVVKPTKFFTNDGRRVTQAMMTWNITCTYSQFLAQKTPTCCVSLSSFYNDTIVPCPTCTCGCQKNGTQHGNCVDQDEPHLASVVSGLGKNNYAPLVQCTSHMCPIRIHWHVKLNYKEYWRVKVTITNFNYNMNYTQWNLVVQHPNFDNLTQLFSFHYKSLTPYGAINDTAMLWGMKFYNDLLMQAGPLGNVQSELLFRKDMSTFTFEKGWAFPHRVYFNGDNCVMPQPDSYPYMPNTGTVWKFSSLKLVVMLMLSTAFFFATV

SEQ ID NO: 8621 - protein, 453 aa, Triphysaria pusilla
MEMCFRSLLRVTYTTILLFFLVSCFSITSTDAYDALDPNGNITIKWDVISWTADGYVATVTMFNFQQYRHIQAPGWTLGWTWAKKEVIWSMMGAQTTEQGDCSKFKGNIPHCCKKDPTVVDLLPGTPYNQQIANCCKGGVINSFAQDPDNSASSFQVSVGSAGTTNKTVRVPKNFTLNAPGPGYTCGPAKIVKPTKFVTQDGRRVTQAMMTWNITCTYSQFLAQKTPTCCVSLSSFYNDTIVPCPTCTCGCQNNITHPGSCVNPDSPYIASVVSDHGKANSFAPLVQCTSHMCPIRVHWHVKVNYKEYWRVKVTITNFNYRMNYTQWNLVAQHPNFDNLTQLFSFNYKPLNPYQNINDTAMLWGVKFYNDFLNQAGPLGNVQSELLFRKDKSTFTFEKGWAFPRRIYFNGDNCVMPPPDAYPYLPNIGLREKMSMFMLTITLLSSTIFYFGCI

SEQ ID NO: 8622 - protein, 453 aa, Triphysaria pusilla
MEMCFRSLLRVTYTTILLFFLVSCFSITSTDAYDALDPNGNITIKWDVISWTADGYVATVTMFNFQQYRHIQAPGWTLGWTWAKKEVIWSMMGAQTTEQGDCSKFKGNIPHCCKKDPTVVDLLPGTPYNQQIANCCKGGVINSFAQDPDNSASSFQVSVGSAGTTNKTVRVPKNFTLNAPGPGYTCGPAKIVKPTKFVTQDGRRVTQAMMTWNITCTYSQFLAQKTPTCCVSLSSFYNDTIVPCPTCTCGCQNNLTQPGSCVNPDSPYLSSVVSDHGKKNSFTPLVQCTSHMCPIRVHWHVKVNYKEYWRVKVTITNFNYRMNYSQWNLVAQHPNFDNLTQLFSFNYKPLNPYQNINDTAMLWGVKFYNDFLSQAGPLGNVQSELLFQKEKSTFTFEKGWAFPRRIYFNGDNCVMPPPDAYPYLPNAGIRENASLVMLMITLFLSVMFHFACV

SEQ ID NO: 8623 - protein, 457 aa, Populus trichocarpa
MEPSSSLVTVSVTKISAFTILLLFLISCSTLTSTEAYDALDPNGNITIKWDVIQWTPDGYVAVVTMYNFQQYRHIQAPGWTLGWTWAKKEVIWNMMGAQTTEQGDCSKFKGNIPHCCKKDPTVVDLLPGTPYNQQIANCCKGGVINSWAQDPANAVSSFQISVGAAGTTNKTVRVPKNITLKAPGPGYTCGPAKIVRPTKFISADKRRITQALMTWNITCTYSQFLAQKTPTCCVSLSSFYNDTIVSCPTCACGCQNTTGAGSGTCVHPDTPHLASVISPPGKSDNTPLVQCTSHMCPIRVHWHVKLNYKEYWRVKVTVTNFNYRMNYSLWNMVVQHPNFDNLTKIFSFQYKSLTPYEGLNDTAMLWGVKFYNDFLSQAGPLGNVQSELLFRKDKSTFTFEKGWAFPRRIYFNGDNCVMPPPDAYPWLPNDSSRPVISLLLPVMTLFLSMAFLFAHV

SEQ ID NO: 8624 - protein, 454 aa, Manihot esculenta
MDSHFSSLTGSITKLCSFTILLLFLLSCSTFTPTDAYDALDPNGNITIKWDVISWTPDGYVAVVTMYNFQQYRHIQAPGWTLGWTWAKKEVIWSMMGAQTTEQGDCSKYKGNVPHCCKKDPTVVDLLPGTPYNQQIANCCKGGVINSWAQDPATAVSSFQVSVGAAGTSNKTVRLPKNFTLKAPGPGYTCGPAKIVRPTKFISADKRRVTQALMTWNVTCTYSQFLAQKTPTCCVSLSSFYNDTIVGCPTCACGCKNSTNGGSCVNPDTPHLASVVSSGKNDMSPLVQCTSHMCPIRVHWHVKLNYKEYWRVKVTITNFNYRMNYTQWNIVVQHPNFDNLTQIFSFHYKPLTPYDGLNDTAMLYGVKFYNDFLSQAGPFGNVQSELLFRKDKSTFTFEKGWAFPRRIYFNGDNCVMPPPDAYPWLPNDGSRLSISLLSPVMTFLVYIVFFLACM

SEQ ID NO: 8625 - protein, 453 aa, Orobanche aegyptiaca
MELCFRSLLRFTIPTILLMLLLFSSSFTSTEAYDALDPLGNITIKWDVINWTPDGYVAVVTMFNFQQYRHIQAPGWSLGWSWAKKEVIWTMMGGQTTEQGDCSKYKGNTPHCCKKDPMVVDLLPGTPYNQQIANCCKGGVINSWAQDPTNAASSFQVSVGAAGTTNKTVRVPRNFTLKAPGPGYTCGPAKIVKPTRFVTQDGRRVTQAMMTWNVTCTYSQFLAQKTPTCCVSLSSFYNDTIVPCPTCTCGCQNNLTQPGSCVNPDSPYLASVVSERGKSNNLAPLVQCTSHMCPIRVHWHVKVNYKEYWRVKVTITNFNYRMNYTQWNLVVQHPNFDNLTEIFSFNYRPLNPYQNINDTAMLWGVKFYNDFLSQAGPLGNVQSELLFRKDKNTFTFDKGWGFPRRIYFNGDNCVMPPPDAYPYLPNASWRLNVSFLALLITLLSSVAFHFACV

SEQ ID NO: 8626 - protein, 456 aa, Vitis vinifera
MGFCLSLISRSISSFCGCTILLLFLLSCSCFTSTEAYDALDPNGNITIKWDIMSWTPDGYVAVVTMYNFQQYRHIQSPGWSLQWTWAKKEVIWSMLGGQTTEQGDCSRFKGNVPHCCKKDPTVVDLLPGTPYNQQIANCCKGGVVSSWVQDPANAASSFQVSVGSAGTTNKTVRLPKNFTLKAPGPGYTCGPAKIVKPTRFVTQDGRRVTQALMTWNVTCTYSQFLSQKTPTCCVSLSSFYNDTIVPCPTCTCGCQNNITQPGSCVEEDSPYLASVVSGSGKNSYTPLVQCTKHMCPIRVHWHVKLSYKEYWRVKVTITNFNYRMNYTQWNLVVQHPNFDNLTQIFSFNYKSLTPYAAINDTAMLWGVKFYNDLLMQAGPLGNVQSELLFRKDKSTFTFEKGWAFPRRIYFNGDNCVMPPPDSYPWLPNATSRTSTSLLTLIMVLLSALLLLNAHV

SEQ ID NO: 8627 - protein, 448 aa, Lotus japonicus
MGFSLSSTAASTCILFLFLLSCTCFTSTDAYDPLDPNGNITIKWDIITWTSDGYVAVVTMNNFQQYRHIAAPGWSLGWTWAKKEVIWSMVGGQATEQGDCSKFKGSIPHCCKKDPTVVDLLPGTPYNMQFSNCCKGGVLSSWAQDPTNAVASFQVSVGRAGTTNKTVKVPKNFTLKAPGPGYTCGPAKIVKPTKFIQPDKRRVTQALMTWNVTCTYSQFLAQKTPTCCVSLSSFYNDTIVPCPTCACGCQSNSSRSGSCIEADTPHLASVVAGSGKNTPLVQCTRHMCPVRIHWHVKLNYKEYWRVKVTITNFNYKMNYSEWNLVAQHPNFDNLTQLFSFNYKSLTPYGSINDTALLWGVKFYNDFLNEAGPSGNVQSELLFRKDKSTFTFEKGWAFPRRIYFNGDNCVMPSPDAYPWLPNAGSRQEVSLFALVMASLVAVVLCFAQA

SEQ ID NO: 8628 - protein, 449 aa, Lactuca sativa
MDYCFRSLTRVSISTILLAILLSSFSFTCTEAYDALDPNGNITIKWDIISWTPDGYVAVVTMYNFQQYRHISPPGWTLGWTWAKKEVIWSMMGSQTTEQGDCSRYKSAPPHCCKKTPTVVDLLPGTPYNQQIANCCKGGVINSWAQDPNNYASSFQVSVGAAGTTNKTVKPPKNFTLLAPGPGYTCGPAVVGKPTKFITPDGRRVTQAMMTWNVTCTYSQFLAQKTPTCCVSLSSFYNDTIVPCPTCTCGCQNNITHPGSCVNPNSPYLASVVNGPGKNSLTPLVQCTKHMCPIRVHWHVKLNYKEYWRVKVTITNFNYRMNYSQWNLVVQHPNFDNLTQIFSFNYKPLTPYSSINDTAMLWGVKFYNDFLNQAGPLGNVQSELLFRKDKSTFTFEKGWAFPRRIYFNGDNCVMPPPDAYPYLPNASSRLSFSLFTLLMGSLVFFFAFV

SEQ ID NO: 8629 - protein, 410 aa, Solanum phureja
MAEVCFGVVAETDSSSPCESSSRAVRRRRMELRKIKVIAGVTQPGTENGIKRPKLKLISGSVSRICDNAVESSSTDDDEEQLRLVETKGSPPTIILTPFLGPSNSTLLVQAVAYPKFGFASVCGRRRDMEDAVAIHPSFCQMEQGNSGELHYFAVYDGHGCSHVATKCKERLHELVKEELENKEGDHEEWEHSMNRSFNRMDKEVIEWNNSVTGATCRCELHTPECDAVGSTAVVAVVTPDKIIVANCGDSRAILCRNGKAIPLSNDQKPDRPDELNRIQEAGGRVIYWDGPRVSGVLAMSRAIGDNYLKPYVICEPEVTVTDRTAEDDCLILASDGLWDVVSNDTACGVAGMCLKRNASPASTSGNGADGEMNSDQCCSDASMLLTKLALARRSYDNVSVVVIDLKHYT

SEQ ID NO: 8630 - protein, 410 aa, Solanum tuberosum
MAEVCFGVVTETDSSSPCESSSRAVRRRRMELRKIKVIAGVTQSGTENGIKRPKLKLISGSVSRICDNAVESSSTDDDEEQLRLVETKGSPPTIILTPFLGPSNSTLLVQSVAYPKFGFASVCGRRRDMEDAVAIHPSFCQMEQGNSGKLHYFAVYDGHGCSHVATKCKERLHELVKEELENKEGDHEEWEHSMNRSFNRMDKEVIEWNNSVTGATCRCELHTPECDAVGSTAVVAVVTPDKIIVANCGDSRAIFCRNGTAIPLSNDQKPDRPDELNRIQEAGGRVIYWDGPRVSGVLAMSRAIGDNYLKPYVICEPEVTVTDRTAEDDCLILASDGLWDVVSNDTACGVAGMCLKRNASPASTSGNGADGEMNSDQCCSDASMLLTKLALARRSYDNVSVVVVDLKHYT

SEQ ID NO: 8631 - protein, 722 aa, Solanum tuberosum
MASIAQNGHVNGEVVAMELCKKSINVDDPLNWEMAAESLRGSHLDEVKKMVDEFRKPIVKLGGETLTVAQVASIANADNKSNGVKVELSESARAGVKASSDWVMDSMSKGTDSYGVTTGFGATSHRRTKNGGALQKELIRFLNAGVFGNGTESSHTLPHSATRAAMLVRINTLLQGYSGIRFEILEAITKLINSNITPCLPLRGTITASGDLVPLSYIAGLLTGRPNSKAVGPNGEKLNAEEAFRVAGVSGGFFELQPKEGLALVNGTAVGSGMASMVLFDSNILAVMSEVLSAIFAEVMNGKPEFTDYLTHKLKHHPGQIEAAAIMEHILDGSSYVKAAQKLHEMDPLQKPKQDRYALRTSPQWLGPQIEVIRAATKMIEREINSVNDNPLIDVSRNKALHGGNFQGTPIGVSMDNTRLALASIGKLMFAQFSELVNDYYNNGLPSNLTAGRNPSLDYGLKGAEIAMASYCSELQFLANPVTNHVQSAEQHNQDVNSLGLISARKTAEAVDILKLMSSTYLVALCQAIDLRHLEENLRNAVKNTVSQVAKRTLTMGANGELHPARFCEKELLRVVDREYVFAYADDPCSSTYPLMQKLRQVLVDHAMNNGESEKNVNSSIFQKIVAFEDELKAMLPKEVESARAVLESGNPSIPNRITECRSYPLYKLVRQELGSELLTGEKVRSPGEEIDKVFTAMCNGQIIDPLLECLQSWNGAPLPIC

SEQ ID NO: 8632 - protein, 706 aa, Solanum lycopersicum
MDLCKKSINVNDPLNWEMAAESLRGSHLDEVKKMVDEFRKPIVKLGGETLTVAQVASIANVDNKSNGVKVELSESARAGVKASSDWVMDSMGKGTDSYGVTTGFGATSHRRTKNGGALQKELIRFLNAGVFGNGTESSHTLPHSATRAAMLVRINTLLQGYSGIRFEILEAITKLINSNITPCLPLRGTITASGDLVPLSYIAGLLTGRPNSKAVGPNGEKLNAEEAFRVAGVTSGFFELQPKEGLALVNGTAVGSGMASMVLFESNILAVMSEVLSAIFAEVMNGKPEFTDYLTHKLKHHPGQIEAAAIMEHILDGSSYVKEAQKLHEMDPLQKPKQDRYALRTSPQWLGPQIEVIRAATKMIEREINSVNDNPLIDVSRNKALHGGNFQGTPIGVSMDNTRLALASIGKLMFAQFSELVNDYYNNGLPSNLTAGRNPSLDYGLKGAEIAMASYCSELQFLANPVTNHVQSAEQHNQDVNSLGLISARKTAEAVDILKLMSSTYLVALCQAIDLRHLEENLKNAVKNTVSQVAKKTLAMGANGELHPARFCEKELLRVVDREYVFAYADDPCSSTYPLMQKLRQVLVDHAMKNGESEKNVNSSIFQKIVAFEDELKAVLPKEVESARAVVESGNPAIPNRITECRSYPLYRLVRQELGSELLTGEKVRSPGEEIDKVFTAMCNGQIIDPLLECLKSWNGAPLPIC

SEQ ID NO: 8633 - protein, 722 aa, Solanum tuberosum
MASIAQNGHVNGEVVAMELCKKSINVDDPLNWEMAAESLRGSHLDEVKKMVDEFRKPIVKLGGETLTVAQVASIANADNKSNGVKVELSESARAGVKASSDWVMDSMSKGTDSYGVTTGFGATSHRRTKNGGALQKELIRFLNAGVFGNGTESSHTLPHSATRAAMLVRINTLLQGYSGIRFEILEAITKLINSNITPCLPLRGTITASGDLVPLSYIAGLLTGRPNSKAVGPNGEKLNAEEAFRVAGVTGGFFELQPKEGLALVNGTAVGSGMASMVLFDSNILAVMSEVLSAIFAEVMNGKPEFTDYLTHKLKHHPGQIEAAAIMEHILDGSSYVKEAQKLHEMDPLQKPKQDRYALRTSPQWLGPQIEVIRAATKMIEREINSVNDNPLIDVSRNKALHGGNFQGTPIGVSMDNTRLALASIGKLMFAQFSELVNDYYNNGLPSNLTAGRNPSLDYGFKGAEIAMASYCSELQFLANPVTNHVQSAEQHNQDVNSLGLISARKTAEAVDILKLMSSTYLVALCQAIDLRHLEENLKNAVKNTVSQVAKKTLTMGANGELHPARFCEKELLQVVEREYLFAYADDPCSCTYPLMQKLRQVLVDHAMKNGESETNVNSSIFQKIVAFEEELNVVLPKEVESARAMLESGNPSIPNRITECRSYPLYRLVRQELGSELLTGEKVRSPGEEIDKVFTAMCNGQIIDPLLECLKSWNGAPLPIC

SEQ ID NO: 8634 - protein, 719 aa, Solanum phureja
MAPSIAQNGHINGEAMDLCKKSNYDPLNWEMAADSLRGSHLDEVKKMVDEFRKPIVKLGGETLTVAQVASIANVDNKSNGVKVELSESARAGVKASSDWVMDSMSKGTDSYGVTTGFGATSHRRTKNGGALQKELIRFLNAGVFGNGTETSHTLPHSATRAAMLVRINTLLQGYSGIRFEILEAITKLINSNITPCLPLRGTITASGDLVPLSYIAGLLTGRPNSKVVGPNGEKLNAEEAFRVAGVTGGFFELQPKEGLALVNGTAVGSAMASIVLFESNILAVMSEVLSAIFAEVMNGKPEFTDYLTHKLKHHPGQIEAAAIMEHILDGSSYVKAAQKLHEMDPLQKPKQDRYALRTSPQWLGPQIEVIRAATKMIEREINSVNDNPLIDVSRNKAIHGGNFQGTPIGVSMDNTRLALASIGKLMFAQFSELVNDYYNNGLPSNLTAGRNPSLDYGFKGAEIAMASYCSELQFLANPVTNHVQSAEQHNQDVNSLGLISARKTVEAVDILKLMSSTYLVALCQAIDLRHLEENLRNAVKNTVSQVAKRTLTMGANGELHPARFCEKELLRVVDREYLFAYADDPCSSNYPLMQKLRQVLVDQAMKNGESEKNINSSIFQKIGAFEDELIAVLPKEVESARALLESGNPSIPNRITECRSYPLYRLVRQELGTELLTGEKVRSPGEEIDKVFTAMCNGQIIDPLLECLKSWNGAPLPIC

SEQ ID NO: 8635 - protein, 380 aa, Solanum tuberosum
MAPSIAQNEHINGEVKEVAMDLCKKSNYDPLNWEMAADSLRGSHLDEVKKMVDEFRKPIVKLGGETLTVAQVASIANVDNKSNGVRVELSESARAGVKASSDWVMDSMSKGTDSYGVTTGFGATSHRRTKNGGALQKELIRFLNAGVFGIGTESSHTLPHSATRAAMLVRINTLLQGYSGIRFEILEAITKLINSNITPCLPLRGTITASGDLVPLSYIAGLLTGRPNSKAVGPNGEKLNAEEAFRVAGVTGGFFELQPKEGLALVNGTAVGSAMASIVLFESNILAVMSEVLSAIFAEVMNGKPEFTDYLTHKLKHHPGQIEAAAIMEHILDGSSYVKAAQKLPMKWILFKNQSKIVMLSEHLHNGLALRLKSSVLQLR

SEQ ID NO: 8636 - protein, 247 aa, Solanum phureja
MASIAQNGHVNGEVVAMELCKKSINVHDPLNWEMAAESLRGSHLDEVKKMVDEFRKPIVKLGGETLTVAQVASIANADNKSNGVKVELSESARAGVKASSDWVMDSMSKGTDSYGVTTGFGATSHRRTKNGGALQKELIRFLNAGVFGNGTESSHTLPHSATRAAMLVRINTLLQGYSGIRFEILEAITKLINSNITPCLPLRGTITASGDLVPLSYIAGLLTGRPNSKAVGPNGEKLNAEEACGWC

SEQ ID NO: 8637 - protein, 82 aa, Solanum tuberosum
MAPSIAQNEHINGEVKEVAMDLCKKSNYDPLNWEMAADSLRGSHLDEVKKMVDEFRKPIVKLGGETLTVAQVASIANVDNKN

SEQ ID NO: 8638 - protein, 720 aa, Solanum tuberosum
MAPSIAQNGHVNGEVEEVLCKKSIHDPLNWEMAADSLRGSHLDEVKKMVDEFRKPIVKLGGETLTVAQVASIANADNKTSGVKVELSESARAGVKASSDWVMDSMSKGTDSYGVTTGFGATSHRRTKNGGALQKELIRFLNAGVFGNGTESSHTLPHSATRAAMLVRINTLLQGYSGIRFEILEAITKLINSNITPCLPLRGTVTASGDLVPLSYIAGLLTGRPNSKAVGPNGEKLDADEAFRVAGVSGGFFELQPKEGLALVNGTAVGSGMASIVLYDSNILAVMSEVLSAIFAEVMNGKPEFTDYLTHKLKHHPGQIEAAAIMEHILDGSSYVKAAQKLHEMDPLQKPKQDRYALRTSPQWLGPQIEVIRAATKMIEREINSVNDNPLIDVSRNKAIHGGNFQGTPIGVSMDNTRLALASIGKLMFAQFSELVNDYYNNGLPSNLTAGRNPSLDYGFKGAEIAMASYCSELQFLANPVTNHVQSAEQHNQDVNSLGLISARKTAEAVDILKLMSSTYLVALCQAIDLRHLEENLKSVVKNTVSQVAKRTLTIGAIGELHPARFCEKELLRVVDREYLFTYADDPCSSTYPLMQKLRQVLVDHAMKNGESEKNINSSIFQKIGAFEDELNAVLPKEVESARALLESGNPSIPNRITECRSYPLYRLVRQELGTELLTGEKVRSPGEEIEKVFTAMCNGQIIDPLLECLKSWNGAPLPIC

SEQ ID NO: 8639 - protein, 167 aa, Solanum tuberosum
MGANGELHPARFCEKELLRVVDREYLFAYADDPCSSNYPLMQKLRQVLVDQAMKNGESEKHFNSSIFQKIGAFEDELIAVLPKEVESVRAVVESGNPSIPNRITECRSYPLYRLVRQELGTELLTGEKVRSPGEEIDKVFTAMCNGQIIDPLLECLKSWNGAPLPIC

SEQ ID NO: 8640 - protein, 720 aa, Solanum phureja
MASSIAQNGHVNGEVEEVLCKKSIHDPLNWEMAAESLRGSHLDEVKKMVDEFRKPIVKLEGETLTVAQVASIANADNKSNGVKVELSESARAGVKASSDWVMDSMSKGTDSYGVTTGFGDTSHRRTKNGNALQKDLIRFLNAGVFGNGTESSHTLPHSATRAAMLVRINTLLQGYSGIRFEILEAITKLINSNITPCLPLRGSITASGDLVPLSYIVGLLTGRPNSKAVGPNGEKLNAEEALRVAGVSGGFFELQPKEGLALVNGTAVASGMASIVVFESNILAVMSEVLSAIFAEVMNGKPEFTDYLTHKLKHHPGQIEAAAIMEHILDGSSYVKEAQKLHEMDPLQKPKQDRYALRTAPQWLGPQIEVIRAATKMIEREINSVNDNPLIDVSRNKALHGGNFQGTPIGVSMDNTRLALASIGKLMFAQLSELVNDYYNNGLPSNLSAGRNPSLDYGFKGAEIAMASYCSELQFLANPVTNHVQSAEQHNQDVNSLGLISARKTAEAVDILKLMSSTYLVALCQAIDLRHLEENLRNAVKNTVSQVAKRTLTMGANGELHPARFCKKELLQVVDKEYLFAYVDDPCNSNYPLMQKLRQVLVDHAMNNGESEKNVNSSIFQKIVAFEDELKVVLPKEVESARVVVESGNPAIPNRITECRSYPLYRLVREELGTEVLTGEKVRSPGEEIDKVFTAMCNGQIIDPLLECLKSWNGAPLPIC

SEQ ID NO: 8641 - protein, 710 aa, Capsicum annuum
NGDIVAIDLCNKSIHDPLNWEMAAESLKGSHLDEVKKMVDEFRKPIVKLGGETLTVAQVASIANADNKTCGVKVELSESARAGVKASSDWVMDSMCKGTDSYGVTTGFGATSHRRTKNGGALQKELIRFLNAGVFGNGTGSCHTLPHSATRAAMLVRINTLLQGYSGIRFEILEAITKLINSNITPCLPLRGTITASGDLVPLSYIAGLLTGRPNAKAVGPNGEKLNAEEAFRVAGVSGGFFELQPKEGLALVNGTAVGSGMASMVLFESNILAVMSEVLSAIFAEVMNGKPEFTDHLTHKLKHHPGQIEAAAIMEHILDGSSYVKAAQKLHEMDPLQKPKQDRYALRTSPQWLGPQIEVIRAATKMIEREINSVNDNPLIDVSRNKALHGGNFQGTPIGVSMDNTRLALASIGKLMFAQFSELVNDYYNNGLPSNLTAGRNPSLDYGFKGAEIAMASYCSELQFLANPVTNHVQSAEQHNQDVNSLGLISSRKTAEAVDILKLMSSTYLVALCQAIDLRHLEENLKNAVKNTVSQVAKRTLTMGANGELHPARFCEKELLRVVDREYLFAYADDPCSSTYPLMQKLRQVLVDHALNNGESEKNVNSSIFQKIAAFEDELKAVLPKEVESARITLESGNPSIPNRITECRSYPLYRLVRKELGTELLTGERVRSPGEEIDKVFTAMCNGQIIDPLLECLKSWNGAPLPIY

SEQ ID NO: 8642 - protein, 715 aa, Nicotiana tabacum
MASNGHVNGGENFELCKKSADPLNWEMAAESLRGSHLDEVKKMVSEFRKPMVKLGGESLTVAQVAAIAVRDKSANGVKVELSEEARAGVKASSDWVMDSMNKGTDSYGVTTGFGATSHRRTKNGGALQKELIRFLNAGVFGNGTETSHTLPHSATRAAMLVRINTLLQGYSGIRFEILEAITKLINSNITPCLPLRGTITASGDLVPLSYIAGLLTGRPNSKAVGPNGETLNAEEAFRVAGVNGGFFELQPKEGLALVNGTAVGSGMASMVLFDSNILAVMSEVLSAIFAEVMNGKPEFTDHLTHKLKHHPGQIEAAAIMEHILDGSSYVKAAQKLHEMDPLQKPKQDRYALRTSPQWLGPQIEVIRAATKMIEREINSVNDNPLIDVSRNKALHGGNFQGTPIGVSMDNARLALASIGKLMFAQFSELVNDYYNNGLPSNLTASRNPSLDYGFKGAEIAMASYCSELQFLANPVTNHVQSAEQHNQDVNSLGLISARKTAEAVDILKLMSSTYLVALCQAIDLRHLEENLKNAVKNTVSQVAKRTLTMGANGELHPARFCEKELLRIVDREYLFAYADDPCSCNYPLMQKLRQVLVDHAMNNGESEKNVNSSIFQKIGAFEDELKAVLPKEVESARAALESGNPAIPNRITECRSYPLYRFVRKELGTELLTGEKVRSPGEECDKVFTAMCNGQIIDPMLECLKSWNGAPLPIC

SEQ ID NO: 8643 - protein, 610 aa, Solanum phureja
MVLLLDFVQHLIEEPKMVVLFKRNLLSKFLNAGVFGNGTESTHTLPHSATRAAMLVRINTLLQGYSGIRFEILEAITKLINSNITPCLPLRGTVTASGDLVPLSYIAGLLTGRPNSKAVGPSGSKLDADEAFRVAAVSGGFFELQPKEGLALVNGTAVGSGMASIVLYDSNILAVMFEVLSAIFAEVMNGKPEFTDYLTHKLKHHPGQIEAAAIMEHILDGSSYVKAAQKLHEMDPLQKPKQDRYALRTSPQWLGPQIEVIRAATKMIEREINSVNDNPLIDVSRNKAIHGGNFQGTPIGVSMDNTRLALASIGKLMFAQFSELVNDYYNNGLPSNLTAGRNPSLDYGFKGAEIAMASYCSELQFLANPVTNHVQSAEQHNQDVNSLGLISARKTAEAVDILKLMSSTYLVALCQAIDLRHLEENLKSVVKNTVSQVAKRTLTIGAIGELHPARFCEKELLRVVDREYLFTYADDPCSSTYPLMQKLRQVLVDHAMKNGESEKNINSSIFQKIGAFEDELNAVLPKEVESARALLESGNPSIPNRITECRSYPLYRLVRQELGTELLTGEKVRSPGEEIEKVFTAMCNGQIIDPLLECLKSWNGAPLPIC

SEQ ID NO: 8644 - protein, 552 aa, Solanum phureja
MDLCKKSNYDPLNWEMAADSLRGSHLDEVKKMVDEFRKPIVKLGVKLSVAQVASIANVDNKSNGVKVELSESARAGVKASSDWVMDSMSKGTDSYGVTTGFGATSHRRTKNGGALQKELIRFLNAGVFGNGTESSHTLPHSATRAAMLVRINTLLQGYSGIRFEILEAITKLINSNITPCLPLRGTITASGDLVPLSYIAGLLTGRPNSKAVGPNGEKLDADEAFRVAGVSGGFFELQPKEGLALVNGTAVGSAMASIVLFESNILAVMSEVLSAIFAEVMNGKPEFTDYLTHKLKHHPGQIEAAAIMEHILDGSSYVKAAQKLHEMDPLQKPKQDRYALRTSPQWLGPQIEVIRAATKMIEREINSVNDNPLIDVSRNKAIHGGNFQGTPIGVSMDNTRLALASIGKLMFAQFSELVNDYYNNGLPSNLTAGRNPSLDYGFKGAEIAMASYCSELQFLANPVTNHVQSAEQHNQDVNSLGLISARKTAEAVDILKLMSSTYLVALCQAIDLRHLEENLKSAVKNTVSQVAKRTLTIGAIGELHPARFCEKE

SEQ ID NO: 8645 - protein, 712 aa, Nicotiana tabacum
MAGVAQNGHQEMDFCMKVDPLNWEMAADSLKGSHLDEVKKMVAEFRKPVVKLGGETLTVAQVAAIAAKDNVKTVKVELSEGARAGVKASSDWVMDSMGKGTDSYGVTTGFGATSHRRTKNGGALQKELIRFLNAGVFGNGTESCHTLPQSGTRAAMLVRINTLLQGYSGIRFEILEAITKLLNHNVTPCLPLRGTITASGDLVPLSYIAGLLTGRPNSKAVGPNGETLNAEEAFRVAGVNGGFFELQPKEGLALVNGTAVGSGLASMVLFDANVLAVFSEVLSAIFAEVMNGKPEFTDHLTHKLKHHPGQIEAAAIMEHILDGSSYVKAAQKLHETDPLQKPKQDRYALRTSPQWLGPQIEVIRSATKMIEREINSVNDNPLIDVSRNKALHGGNFQGTPIGVSMDNARLALASIGKLMFGQFSELVNDYYNNGLPSNLTAGRNPSLDYGFKGSEIAMASYCSELQFLANPVTNHVQSAEQHNQDVNSLGLISARKTAEAVDILKLMSSTYLVALCQAIDLRHLEENLRNAVKNTVSQVAKRTLTMGTNGELHPSRFCEKDLLRVVDREYVFAYADDACSANYPLMQKLRQVLVDHALQNGENEKNANSSIFQKILAFEDELKAVLPKEVESARAALESGNPAIANRIKECRSYPLYRFVRGELGAELLTGEKVRSPGEECDKVFTTMCNGQIIDSLLECLKEWNGAPLPIC

SEQ ID NO: 8646 - protein, 712 aa, Nicotiana tabacum
MAGVAQNGHQEMDFCVKVDPLNWEMAADSLKGSHLDEVKKMVAEFRKPVVKLGGETLTVAQVAAIAAKDNAKTVKVELSEGARAGVKASSDWVMDSMSKGTDSYGVTTGFGATSHRRTKNGGALQKELIRFLNAGVFGNGTESCHTLPQSGTRAAMLVRINTLLQGYSGIRFEILEAITKLLNHNVTPCLPLRGTITASGDLVPLSYIAGLLTGRPNSKAIGPNGETLNAEEAFRVAGVNSGFFELQPKEGLALVNGTAVGSGLASMVLFDANILAVFSEVLSAIFAEVMNGKPEFTDHLTHKLKHHPGQIEAAAIMEHILDGSSYVKAPQKLHETDPLQKPKQDRYALRTSPQWLGPQIEVIRSATKMIEREINSVNDNPLIDVSRNKALHGGNFQGTPIGVSMDNARLALASIGKLMFAQFSELVNDYYNNGLPSNLTAGRNPSLDYGFKGSEIAMASYCSELQFLANPVTNHVQSAEQHNQDVNSLGLISARKTAEAVDILKLMSSTYLVALCQAIDLRHLEENLRNAVKNTVSQVAKRTLTMGANGELHPSRFCEKDLLRVVDREYVFAYADDACSANYPLMQKLRQVLVDHALENGENEKNANSSIFQKILAFEGELKAVLPKEVESARISLENGNPAIANRIKECRSYPLYRFVREELGAELLTGEKVRSPGEECDKVFTAMCNGQIIDSLLECLKEWNGAPLPIC

SEQ ID NO: 8647 - protein, 711 aa, Solanum tuberosum
MAGAIDGHQDLDFCIKVDPLNWEMAAESLRGSHLDEVKKMVAEFRKPVVKLGGETLTVAQVASIAAKVNVENVKVELSEDARAGVKASSDWVMESMSKGTDSYGVTTGFGATSHRRTKNGGALQKELIRFLNAGVFGNGTESCHTLPQSSTRAAMLVRINTLLQGYSGIRFEILEAITKLINHNVTPCLPLRGTITASGDLVPLSYIAGLLTGRSNSKAVGPNGETLNAEEAFRVAGVNGGFFELQPKEGLALVNGTAVGSGLASIVLFDANVLAVFSEVLSAIFAEVMNGKPEFTDHLTHKLKHHPGQIEAAAIMEHILDGSAYVKAAQKLHEMDPLQKPKQDRYALRTSPQWLGPQIEVIRSATKMIEREINSVNDNPLIDVSRNKALHGGNFQGTPIGVSMDNARLALASIGKLMFAQFSELVNDYYNNGLPSNLTAGRNPSLDYGFKGSEIAMASYCSELQFLANPVTNHVQSAEQHNQDVNSLGLISARKTAEAVDILKLMSSTYLVALCQAIDLRHLEENLRNAVKNTVSQVAKRTLTMGANGELHPSRFCEKDLLRIVDREYLFAYADDPCSANYPLMQKLRQVLVDHALQNGENEKNANSSIFQKIVAFEEELKSVLPKEVESARVALESGNPAIANRINECRSYPLYKFVREELGTELLTGERVRSPGEECDKVFTAMCNGQIIDSLLECLKEWNGAPLPIC

SEQ ID NO: 8648 - protein, 711 aa, Solanum phureja
MAGFIDGHQDLDFCIKVDPLNWEMAAESLRGSHLDEVKKMVAEFRKPVVKLGGETLTVAQVASIAAKVNVENVKVELSEDARAGVKASSDWVMESMSKGTDSYGVTTGFGATSHRRTKNGGALQKELIRFLNAGVFGNGTESCHTLPQSSTRAAMLVRINTLLQGYSGIRFEILEAITKLINHNVTPCLPLRGTITASGDLVPLSYIAGLLTGRPNSKAVGPNGETLNAEEAFRVAGVNGGFFELQPKEGLALVNGTAVGSGLASIVLFDANVLAVFSEVLSAIFAEVMNGKPEFTDHLTHKLKHHPGQIEAAAIMEHILDGSAYVKAAQKLHEMDPLQKPKQDRYALRTSPQWLGPQIEVIRSATKMIEREINSVNDNPLIDVSRNKALHGGNFQGTPIGVSMDNARLALASIGKLMFAQFSELVNDYYNNGLPSNLTAGRNPSLDYGFKGSEIAMASYCSELQFLANPVTNHVQSAEQHNQDVNSLGLISARKTAEAVDILKLMSSTYLVALCQAIDLRHLEENLRNAVKNTVSQVAKRTLTMGANGELHPSRFCEKDLLRIVDREYLFAYADDPCSANYPLMQKLRQVLVDHALQNGENEKNSSSSIFQKIVAFEEELKSVLPKEVESARVALESGNPAIANRINECRSYPLYKFVREELGTELLTGERVRSPGEECDKVFTAMCNGQIIDSLLECLKEWNGAPLPIC

SEQ ID NO: 8649 - protein, 710 aa, Solanum phureja
PMASSIAQNVHVNVHDPLNWEMAAESLRGSHLDEVKKMVYEFRKPIVKLEGENLTIGQVASIANANNKTSGVKVELSESSRACVKASSDWIMDSVSKGRDIYGITTGFGANSKRRTKNGGGLQKELIRFLNAGVFGNGTETCHTLPHSATRAAMLVRINTLLQGYSGIRFEILEAITKLINNNITPCLPLRGTLTASGDLVPLSYIAGLLIGRPNSKAVGPNGEILNAEEAFRVAGISGGFFEFQPKEGFAITNSTAVGSGMASIVLFESNILAVMSEVLSAIFAEVMNGKPEFTDHLTHKLKYHPGQIEAAAIMEHILDGSSYVKAAQKLHEMDPLQKPKQDRYALRTSPQWLGPQIEVIRAATKMIEREINSVNDNPLIDVSRNKALHGGNFQGTPVGVSMDNTRLALASIGKLMFAQFSELVNDYYNNGLPSNLTGGRDPSLDYGFKGAEIAMASYCSELQFLANPVTTHVQSAEQHNQDVNSLGLISARKTAEAVDILKLMSSTYIVALCQSIDLRHLEENLKNAVKDTVSRVAKRTLTMDANGELHPARFCEKELLLVVDREYLFAYADDPCSSNYPLMQKLRQVLVDYAMKNGESEKNVNSSIFQKIGAFEDELKVVLPNEVENARVILESGNPSIPNRITECRSYPLYRFVRKELGTELLTGERVRSPGEDIDKVFTALCNGQIIDPLLECLKSWNGAPLPIC

SEQ ID NO: 8650 - protein, 711 aa, Ipomoea nil
MDSVKLQNNGHQNGFCVKVDPLNWEVAADSLRGSHLDEVKVMVAEFRKPAVKLGGETLTVAQVAAIASRDNAVTVELSEESRAGVKASSDWVMDSMNKGTDSYGVTTGFGATSHRRTKQGGALQKELIRFLNAGIFGNGTESCHTLPHSATRAAMLVRINTLLQGYSGIRFEILEAITKLLNHNITPCLPLRGTITASGDLVPLSYIAGLITGRPNSKAVGPNGETLNAEEALRLAGVNGGFFELQPKEGLALVNGTAVGSGMASMVLFEANVLAVLSEVLSAIFAEVMNGKPEFTDHLTHKLKHHPGQIEAAAIMEHILDGSSYVKAAQKMHEMDPLQKPKQDRYALRTSPQWLGPQIEVIRAATKMIEREINSVNDNPLIDVARSKALHGGNFQGTPIGVSMDNSRLALASIGKLLFAQFSELVNDYYNNGLPSNLTAGRNPSLDYGFKGAEIAMASYCSELQFLANPVTNHVQSAEQHNQDVNSLGLISARKTAEAVDVLKLMSSTYLVALCQAIDLRFLEENLRNAVKNAVTQVAKRTLTMGANGELHPARFCEKDLLRVVDREYVFAYADDPCSANYPLMQKLRQALVDHALQNGESEKNTGTSIFLKVAAFEDELKAVLPKEVEAARIAVESGNPAIPNRIKECRSYPLYKFVREGLGTELLTGEKVRSPGEECDKVFTAMCEGSIIDPLLECLKSWDGAPLPIC

SEQ ID NO: 8651 - protein, 711 aa, Solanum lycopersicum
MAGVINGQQDLDFCIKVDPLNWEMAAESLRGSHLDEVKKMVAEFRKPVVKLGGETLTVAQVASVAAKVNVENVKVELCEDARAGVKASSDWVMESMSKGTDSYGVTTGFGATSHRRTKNGGALQKELIRFLNAGVFGNGTESCHTLPQSSTRAAMLVRINTLLQGYSGIRFEILEAITKLINHNVTPCLPLRGTITASGDLVPLSYIAGLLTGRPNSKAVGPNGETLNAEEAFHVAGVNGGFFELQPKEGLALVNGTAVGSGLASIVLFDANVLAVFSEVLSAIFAEVMNGKPEFTDHLTHKLKHHPGQIEAAAIMEHILDGSAYVKAAQKLHEMDPLQKPKQDRYALRTSPQWLGPQIEVIRSATKMIEREINSVNDNPLIDVSRNKALHGGNFQGTPIGVSMDNARLALASIGKLMFAQFSELVNDYYNNGLPSNLTAGRNPSLDYGFKGSEIAMASYCSELQFLANPVTNHVQSAEQHNQDVNSLGLISARKTAEAVDILKLMSSTYLVALCQAIDLRHLEENLRNAVKNTVCQVAKRTLTMGANGELHPSRFCEKDLLRIVDREYLFAYADDPCSANYPLMQKLRQVLVEHALQNGENEKNASSSIFQKIVAFEEELKSVLPREVESARVALESGNPAIANRINECRSYPLYKFVREELGTELLTGERVRSPGEECDKVFTAMCNGQIIDSLLECLKEWNGAPLPIC

SEQ ID NO: 8652 - protein, 707 aa, Ipomoea nil
MEGAIENGHSNDFCIKVDPLNWEMAADSLKGSHLDEVKRMVAEFRNPAVKIGGQTLTVAQVAAIAARDNAVKVELSEGARAGVKASSDWVMNSMNNGTDSYGVTTGFGATSHRRTKNGHALQQELIRFLNAGIFGTGTGHTLPHSATRAAMLVRINTLLQGYSGIRFEILEAITKLLNHNITPCLPLRGTITASGDLVPLSYIAGLLTGRPNSKAVGPNGEALTAEEAFKLAGVQGGFFELQPKEGLALVNGTAVGSGMASMVLFEANVLAVLSEVLSAIFAEVMNGKPEFTDHLTHKLKHHPGQIEAAAIMEHILDRSYYMKAAQKLHEMDPLQKPKQDRYALRTSPQWLGPQIEVIRQATKMIEREINSVNDNPLIDVSRNKALHGGNFQGTPIGVSMDNSRLALASIGKLIFAQFSELVNDYYNNGLPSNLTAGRNPSLDYGFKGVEIAMASYCSELQFLANPVTNHVQSAEQHNQDVNSLGLISARKTAEAVDVLKLMSSTYLVALCQAIDLRHLEENLRNAVKNTVSQVAKRTLTMGVNGELHPSRFCEKDLLRVVDREYVFAYADDPCSANYPLMQKLRQVLVDHALQNGEHEKNVSTSIFQKIAAFEDELKALLPKEVEGARSALENGNPAIPNRITECRSYPLYKFIREELGTEILTGEKVQSPGEVCDKVFTAVCDGGIIDPLLECLKSWNGAPLPIC

SEQ ID NO: 8653 - protein, 716 aa, Catharanthus roseus
MKNMGSTENGHINNGEVLDFCLKDPLNWGMAADSLKGSHLDEVKRMVAEFRKPVVKLGGETLTISQVAAIAARDYNAVKVELSEDARAGVKASSDWVMESMNKGTDSYGVTTGFGATSHRRTKQGGALQKELIRFLNAGIFGNGTESSHTLPHSATRAAMLVRINTLLQGYSGIRFEILEAITKFLNHNITPCLPLRGTITASGDLVPLSYIAGLLTGRPNSKAVGPNGEIVNPEEAFKMAGVNDGFFELQPKEGLALVNGTAVGSGMASMVLFEANILAVLSEVLSAIFAEVMNGKPEFTDHLTHKLKHHPGQIEAAAIMEHILDGSGYVKAAHKLHEMDPLQKPKQDRYALRTSPQWLGPQIEVIRSATKMIEREINSVNDNPLIDVSRNKALHGGNFQGTPIGVSMDNARLAIASIGKLMFAQISELVNDFYNNGLPSNLSGGRNPSLVYGFKGAEIAMASYCSELQYLANPVTNHVQSAEQHNQDVNSLGLISSRKTAEAVEILKLMSSTYLVALCQAIDLRHLEENLKNAVKNTVSQVAKRTLTVGVNGELHPSRFCEKDLIRVVDREYVFAYVDDPCSGTYPLMEKLRQVIVDHALQNGESEKNVNTSIFQKIAAFEDELKTVLPKEVESARTALENGNPAIPNRIKECRSYPLYKFVREDVGAEFLTGEKVRSPGEEFDKVFTAMCNEKIIDPLLECLKEWNGAPLPIC

SEQ ID NO: 8654 - protein, 714 aa, Ricinus communis
MAAMAENGSKNDSLESFCNMGRDPLSWGLAAESMKGSHLDEVKKMVAEYRKPFVKLGGETLTVAQVAAIASHDCGVKVELSESARAGVKASSDWVMDSMNKGTDSYGVTTGFGATSHRRTKQGGALQKELIRFLNAGIFGNGTESCHTLPHSATRAAMLVRINTLLQGYSGIRFEILEAITKLLNHNITPCLPLRGTITASGDLVPLSYIAGLLTGRPNSKAIGPNGESMDALEAFRLAGIESGFFELQPKEGLALVNGTAVGSGLASMVLFEANILAVLSEILSAIFAEVMNGKPEFTDHLTHKLKHHPGQIEAAAIMEHILDGSSYVKAAKKLHEMDPLQKPKQDRYALRTSPQWLGPQIEVIRFSTKSIEREINSVNDNPLIDVSRNKALHGGNFQGTPIGVSMDNARLAIASIGKLMFAQFSELVNDFYNNGLPSNLTAGRNPSLDYGFKGAEIAMASYCSELQYLANPVTSHVQSAEQHNQDVNSLGLISSRKTAEAVDILKLMSTTYLVALCQAIDLRHLEENLRQAVKNTVSQVAKRVLTTGANGELHPSRFCEKDLLKVVDREYVFAYADDPCSATYPLMQKLRQILVEHALANGENEKNAGTSVFQKISAFEEELKTLLPKEVESVRIAYESGNPATANRIKECRSYPLYKFVREELGTGLLTGDKVMSPGEEFDKVFTAMCQGKIIDPMMDCLKEWNGAPLPIC

SEQ ID NO: 8655 - protein, 711 aa, Helianthus annuus
MENGTHVNGSANGFCIKDPLNWGVAAEALTGSHLDEVKKMVGEFRKPVVKLGGETLTVSQVAGIAAAGDGNMVKVELSEAARAGVKASSDWVMESMNKGTDSYGVTTGFGATSHRRTKNGGALQKELIRFLNAGIFGNGTESSHTLPHSATRAAMLVRINTLLQGYSGIRFEILEAITKFLNNNITPCLPLRGTITASGDLVPLSYIAGLLTGRPNSKAVGPAGEVLNAESAFAQAGVEGGFFELQPKEGLALVNGTAVGSGMASMVLFEANVLALLSEVLSAIFAEVMQGKPEFTDHLTHKLKHHPGQIEAAAIMEYILDGSDYVKAAQKVHEMDPLQKPKQDRYALRTSPQWLGPQIEVIRSATKMIEREINSVNDNPLIDVSRNKALHGGNFQGTPIGVSMDNTRLAIAAIGKLMFAQFSELVNDFYNNGLPSNLSGGRNPSLDYGFKGGEIAMASYCSELQFLANPVTNHVQSAEQHNQDVNSLGLISARKTAEAVDILKLMSSTYLVALCQSIDLRHLEENMKSTVKNTVSQVAKKVLTMGVNGELHPSRFCEKDLLRVVDREYVFAYADDPCLATYPLMQKLRQVLVDHALNNGETEKNANTSIFQKIATFEDELKAILPKEVESVRVAFENGTMSIPNRIKACRSYPLYRFVREELGGAYLTGEKVTSPGEEFDKVFTAMSKGLIIDPLLECVEGWNGAPLPIC

SEQ ID NO: 8656 - protein, 707 aa, Unknown
  Sequence found in Organisms: Ipomoea nil, Ipomoea batatas
MANQNGFCIKKQQVDPLNWEMAAESLRGSHLDEVKRMVAEFRKPAVKLGGETLTVAQVARIASRDNAVAVELSEEARAGVKASSDWVMDSMNKGTDSYGVTTGFGATSHRRTKQGGALQKELIRFLNAGIFGNATESCHTLPHSATRAAMLVRINTLLQGYSGIRFEILEAITKLLNHNITPCLPLRGTITASGDLVPLSYIAGLITGRPNSKAVGPNGETLNAEEALRLSRSGRRIFRVASPRKGLPSLMAPPLVLGMASMVLFEANVLAVLSEVLSAIFAEVMNGKPEFTDHLTHKLKHHPGQIEAAAIMEHILDGSSYVKAAQKLHEMDPLQKPKQDRYALRTSPQWLGPQIEVIRAATKMIEREINSVNDNPLIDVARSKALHGGNFQGTPIGVSMDNSRLALASIGKLLFAQFSELVNDYYNNGLPSNLTAGRNPSLDYGFKGAEIAMASYCSELQFLANPVTNHVQSAEQHNQDVNSLGLISARKTAEAVDVLKLMSSTYLVALCQAIDLRFLEENLRNAVKNAVTQVAKRTLTVGANGELHPARFCEKDLLRVVDREYVFAYADDPCSANYPLMQKLRQALVDHALQNGENEKNTGTSIFLKVAAFEDELKAVLPKEVEAARIAVESGNPAIPNRIKECRSYPLYKFVREGLGTELLTGEKVRSPGEECDKVFTAMCEGSIIDPLLECLKSWDGAPLPIC

SEQ ID NO: 8657 - protein, 708 aa, Ipomoea batatas
MEGAIANGHTNDFCIKVDPLNWEMAADSLKGSHLDEVKRMVAEFRNPAVKIGGQTLTSLRSPPIAARDNASKWSSPRLPARRESSSDWVMNSMNNGTDSYGVTTGFGATSHRRTKNGHALQQELIRFLNAGIFGTGTGASHTLPHSATRAAMLVRINTLLQGYSGIRFEILEAITKLLNHNITPCLPLRGTITASGDLVPLSYIAGLLTGRPNSKAVGPNGEALTAEEAFKLAGVQGGFFELQPKEGLALVNGTAVGSGMASMVLFEANVLAVLSEVLSAIFAEVMNGKPEFTDHLTHKLKHHPGQIEAAAIMEHILDRSYYMKAAQKLHEMDPLQKPKQDRYALRTSPQWLGPQIEVIRQATKMIEREINSVNDNPLIDVSRNKALHGGNFQGTPIGVSMDNSRLALASIGKLIFAQFSELVNDYYNNGLPSNLTAGRNPSLDYGFKGVEIAMASYCSELQFLANPVTNHVQSAEQHNQDVNSLGLISARKTAEAVDVLKLMSSTYLVALCQAIDLRHLEENLKNAVRNTVNQVAKRTLTMGVNGELHPSRFCEKDLLRVVDREYVFAYADDPCSANYPLFQKLRQVLVDHALQNGEHEKNVSTSIFQKIAAFEDELKAVLPKEVEGARSAIENGNPAIPNRITECRSYPLYKFVREELGTEMLTGEKVKSPGEVCDKVFTAVCDGGIIDPLLECLKSWDGAPLPIC

SEQ ID NO: 8658 - protein, 720 aa, Gossypium hirsutum
METITQNGHHKGSLESFCTASKGAGGAVDPLNWGVAAESLKGSHLDEVKRMVAEYRNPLVKLGGETLTISQVAAIATRDLGVKVELSEDARAGVKASADWVLDGMNKGTDSYGVTTGFGATSHRRTKQGAALQKELIRFLNAGVFGHGTESCHTLPHSATRAAMLVRINTLLQGYSGIRFEILEAITKLINNNITPCLPLRGTITASGDLVPLSYIAGLLTGRPNSKAVGPNGEPLDAEEAFRVAGIDSGFFVLQPKEGLALVNGTAVGSGMASMVLFEANILAVLSEVLSAIFAEVMNGKPEFTDHLTHKLKHHPGQIEAAAIMEHILEGSSYVKAAKKLHEMDPLQKPKQDRYALRTSPQWLGPQIEVIRFATKSIEREINSVNDNPLIDVSRNKALHGGNFQGTPIGVSMDNARLAIAAIGKLMFAQFSELVNDFYNNGLPSNLSGGRNPSLDYGFKGAEIAMASYCSELQYLANPVTSHVQSAEQHNQDVNSLGLISSRKTAEAVDILKLMFSTYLAALCQAIDLRHLEENLRSTVKNTVSQIAKKVLTTGANGELHPSRFCEKDLLKAVDREYVFAYIDDPCSATYPLMQKLRQVLVEHALTNGENEKNASTSIFQKIAAFEEELKAVLPKEVESARASVENGNAAIPNKIKECRSFPLYKFVREELGTGLLTGENVMSPGEEFDKVFTAMCQGKIIDPMLECLEEWNGAPLPIC

SEQ ID NO: 8659 - protein, 713 aa, Cynara scolymus
MENNNGHVNGVATDFCINKDPLNWGVAAEAMTGSHLDEVKRMVAEFRKPVVKLGGETLTVSQVAGIAAAGDSSVVKVELSEAARAGVKASSDWVMESMSKGTDSYGVTTGFGATSHRRTKQGGALQKELIRFLNAGIFGNGSESCHTLPHSATRAAMLVRINTLLQGYSGIRFEILEAITKFLNTNVTPCLPLRGTITASGDLVPLSYIAGLLTGRPNSKAVGPNGEILNAEKAFSLAGVSGGFFELQPKEGLALVNGTAVGSGMASMVLFEANVLALLSEVLSAIFAEVMQGKPEFTDHLTHKLKHHPGQIEAAAIMEYILDGSDYVKAAQKLHEMDPLQKPKQDRYALRTSPQWLGPHIEVIRSSTKMIEREINSVNDNPLIDVARNKALHGGNFQGTPIGVSMDNTRLAIASIGKLMFAQFSELVNDFYNNGLPSNLSGGRNPSLDYGFKGAEIAMASYCSELQFLANPVTNHVQSAEQHNQDVNSLGLISARKTSEAVEILKLMSTSYLVALCQSIDLRHLEENMRSTVKNTVSQVAKKVLTMGVNGELHPSRFCEKDLLRVVDREYVFAYIDDPCSATYPLMQKLRQVLVDHALNNGETEKNTSTSIFQKIGAFEDELKAILPKEVEGVRTSYEDGTLAIPNRIKACRSYPLYRFVREELGTGFLTGEKVTSPGEEFDKVFTAMCKGQIIDPLLECVEGWNGVPLPIS

SEQ ID NO: 8660 - protein, 709 aa, Artemisia annua
MENGHANGVAKELCIKDPLNWGVAAEALTGSHLDEVKKMVAEFRKPVVKLGGETLTVSQVAGIAASENAGVKVELSESARAGVKASSDWVMESMGKGTDSYGVTTGFGATSHRRTKNGGALQKELIRFLNAGIFGNGTESNHTLPHSATRAAMLVRINTLLQGYSGIRFEILEAITKFLNTNVTPCLPLRGTITASGDLVPLSYIAGLLTGRPNSKAVGPDGQILNAEKAFSLAGVDGGFFELQPKEGLALVNGTAVGSGMASMVLFEANVLALLSEVLSAIFAEVMQGKPEFTDHLTHKLKHHPGQIEAAAIMEYILDGSDYVKAAAKVHEMDPLQKPKQDRYALRTSPQWLGPHIEVIRSSTKMIEREINSVNDNPLIDVSRNKALHGGNFQGTPIGVSMDNTRLAIASIGKLMFAQFSELVNDFYNNGLPSNLSGGRNPSLDYGFKGGEIAMASYCSELQFLANPVTNHVQSAEQHNQDVNSLGLISARKTAEAVDILKLMSSTYLVALCQSIDLRHLEENMKSTIKNTVSQVAKKVLTTGVNGELHPSRFCEKDLLRVVDREYVFAYVDDVCLATYPLMQKLRQVLVDHALNNGESEKNTNTSIFQKIAAFEDELKAILPKEVEAVRVAFEDGTLAIPNRIKACRSYPLYRFVREELGGVYLTGENVTSPGEEFDKVFTAMCKGQIIDPLLECVEGWNGVPLPIS

SEQ ID NO: 8661 - protein, 712 aa, Manihot esculenta
MATISQNGHQNGSLDSLCTARDPLNWGLAAESMSGSHLDEVKKMVAEFRKPLVKLGGETLTVAQVAAIARESGVQVELAESARAGVKASSDWVMDSMSKGTDSYGVTTGFGATSHRRTKQGGALQRELIRFLNAGIFGNKTESCHTLSHSATRAAMLVRINTLLQGYSGIRFEILDAITKLLNHNITPCLPLRGTITASGDLVPLSYIAGLLTGRPNSKAVGPNGEPLDAQQAFHSAGIDSGFFELQPKEGLALVNGTAVGSGLASMVLFEANVLAVLSEVLSAIFAEVMNGKPEFTDHLTHKLKHHPGQIEAAAIMEHILDGSSYIKAAKKLHEIDPLQKPKQDRYALRTSPQWLGPQIEVIRFSTKSIEREINSVNDNPLIDVSRNKALHGGNFQGTPIGVSMDNARLAIASIGKLMFAQFSELVNDFYNNGLPSNLTASRNPSLDYGFKGAEIAMASYCSELQYLANPVTSHVQSAEQHNQDVNSLGLISSRKTEEAVDILKLMSTTFLVALCQAIDLRHLEENLKHAVKNTVSQVAKRILTTGASGELHPSRFCEKDLLKVVDREQVFSYVDDACSATYPLMQKLRQVLVDHALANGESEKNASTSIFQKIRAFEEELKALLPKEVESAREAYENGNPAIANKIKECRSYPLYKFVREEIGTGLLTGEKVRSPGEEFDKVFTAMCQGKIIDPMLDCLKEWNGAPLPIC

SEQ ID NO: 8662 - protein, 712 aa, Manihot esculenta
MATISQNGHQNGSLDSLCTARDPLNWGLAAESMSGSHLDEVKKMVAEFRKPLVKLGGETLTVAQVAAIARESCVQVELAESARAGVKASSDWVMDSMSKGTDSYGVTTGFGATSHRRTKQGGALQRELIRFLNAGIFGNKAESCHTLSHSATRAAMLVRINTLLQGYSGIRFEILEAITKLLNHNITPCLPLRGTITASGDLVPLSYIAGLLTGRPNSKAVGPNGESLDAQQAFHSAGIDSGFFELQPKEGLALVNGTAVGSGLASMVLFEANVLAVLSEVLSAIFAEVMNGKPEFTDHLTHKLKHHPGQIEAAAIMEHILDGSSYIKAAKKLHEIDPLQKPKQDRYALRTSPQWLGPQIEVIRFSTKSIEREINSVNDNPLIDVSRNKALHGGNFQGTPIGVSMDNARLAIASIGKLMFAQFSELVNDFYNNGLPSNLTASRNPSLDYGFKGAEIAMASYCSELQYLANPVTSHVQSAEQHNQDVNSLGLISSRKTEEAVDILKLMSTTFLVALCQAIDLRHLEENLKHAVKNTVSQVAKRILTTGASGELHPSRFCEKDLLKVVDREQVFSYVDDACSATYPLMQKLRQVLVDHALANGESEKNASTSIFQKIRAFEEELKALLPKEVESAREAYENGNPAIANKIKECRSYPLYKFVREEIGTGLLTGEKVRSPGEEFDKVFTAMCQGKIIDPMLDCLKEWNGAPLPIC

SEQ ID NO: 8663 - protein, 710 aa, Ocimum basilicum
MAAENGHVDSNGFCVKQSDPLNWVMAAESLKGSHLDEVKRMVEEFRKPVVKLGGETLTISQVAAIAARDNAVAVELAEAARAGVKASSDWVMESMNKGTDSYGVTTGFGATSHRRTKQGGALQKELIRFLNAGIFGNGTESNHTLPHTATRAAMLVRINTLLQGYSGIRFEILEAITKFLNHNITPCLPLRGTITASGDLVPLSYIAGLLTGRPNSKAVGPTGEALNAEEAFKLAGVNGGFFELQPKEGLALVNGTAVGSGLASIALYEANILAVLSEVMSAIFAEVMNGKPEFTDHLTHKLKHHPGQIEAAAIMEHILDGSVYVKAAQKLHEMDPLQKPKQDRYALRTSPQWLGPQIEVIRTATKMIEREINSVNDNPLIDVSRNKALHGGNFQGTPIGVSMDNARLAIASIGKLLFAQFSELVNDFYNNGLPSNLSGGRNPSLDYGFKGAEIAMASYCSELQFLANPVTNHVQSAEQHNQDVNSLGLISSRKTVEALDILKLMSSTYLIALCQAIDLRHLEENLKHAVKNTVSQVAKRTLTMGANGELHPSRFCEKDLIRVVDREYVFAYIDDPCSATYPLMQKLRQVLVDHALKNGENEKNVGTSIFHKIEAFEEELKALLPKEVESARIALESGNPAVANRIAECRSYPLYKFIREELGTSFLTGEKVISPGEECERVFTALSKGLVVDPLLECLQGWNGAPLPIC

SEQ ID NO: 8664 - protein, 606 aa, Lactuca sativa
  misc_feature (596)..(596): Xaa can be any naturally occurring amino acid
MENGNHVNGVVNELCIKDPLNWGVAAEALTGSHLDEVKKMVAEFRKPVVKLGGETLTVSQVAGIAAANDSDTVKVELSEAARAGVKASSDWVMESMNKGTDSYGVTTGFGATSHRRTKQGGALQKELIRFLNAGIFGNGTETSHTLPHSATRAAMIVRINTLLQGYSGIRFEILEAITKFLNNNITPCLPLRGTITASGDLVPLSYIAGLLTGRPNSKAVGPTGEVLNAEKAFAAAGVEGGFFELQPKEGLALVNGTAVGSGMASMVLFDANVLALLSEVLSAIFAEVMQGKPEFTDHLTHKLKHHPGQIEAAAIMEYILDGSDYVKAAQKVHEMDPLQKPKQDRYALRTSPQWLGPQIEVIRSSTKMIEREINSVNDNPLIDVSRNKALHGGNFQGTPIGVSMDNTRLAIAAIGKLMFAQFSELVNDFYNNGLPSNLSGGRNPSLDYGFKGGEIAMASYCSELQFLANPVTNHVQSAEQHNQDVNSLGLISARKTAEAVDILKLMSSTYLVALCQSIDLRHLEENMKSTVKNTVSQVAKKVLTMGVNGELHPSRFCEKDLLRVVDREYVFAYIDDVCSGTYPLMQKLRQVLVDHXSKQRRNGEEH

SEQ ID NO: 8665 - protein, 715 aa, Artemisia annua
MGSLTVENVHQNGVVVGLCVKGDPLNWGAAAESLTGSHLDEVKKMVAEFRKPVVKLGGETLTVSQVAGIAASENAGVKVELSESARAGVKASSDWVMESMGKGTDSYGVTTGFGATSHRRTKNGGALQKELIRFLNSGIFGNGTESSHTLPHSATRAAMLVRINTLLQGYSGIRFEILEAITKFLNSNVTPCLPLRGTITASGDLVPLSYIAGLLTGRPNSKAVGPDGQILNAEKAFSLAGVEGGFFELQPKEGLALVNGTAVGSGMASMVLFEANVLSLLAEVLSAIFAEVMQGKPEFTDHLTHKLKHHPGQIEAAAIMEYILDGSDYVKAAQKVHEMDPLQKPKQDRYALRTSPQWLGPQIEVIRSSTKMIEREINSVNDNPLIDVSRNKALHGGNFQGTPIGVSMDNTRLAIAAIGKLMFAQFSELVNDFYNNGLPSNLSGGRNPSLDYGFKGAEIAMASYCSELQFLANPVTNHVQSAEQHNQDVNSLGLISARKTSEAVDILKLMSSTYLVALCQAIDLRHLEENLKATVKNTVSHVAKKVLTTGVTGELHPSRFCEKDLLRVIDREYVFAYIDDVCLATYPLMQKLRQVLVDHALNNGENEKDASTSIFQKIGMFEEELIALLPKEVESVRNAYETGELAIPNRIKACRSYPLYRFVREELGTGYLTGENVTSPGEEFDKVFTAVCKGLVIDPLLECLQGWNGAPLPIC

SEQ ID NO: 8666 - protein, 711 aa, Ocimum basilicum
MAAATENVHHSNGFCVKQNDPLNWGAAAEALQGSHLDEVKKMVEEFRKPAVKLGGETLTIAQVAAIAARDNAVAVELSEEARAGVKASSDWVMDSMNKGTDSYGVTTGFGATSHRRTKQGGALQKELIRFLNAGIFGKGTESCHTLPHSATRAAMLVRINTLLQGYSGIRFEILEALAKFLNHNITPCLPLRGTITASGDLVPLSYIAGLLTGRPNSRAVAPTGTELNAEEAFKLAGINGGFFELQPKEGLALVNGTAVGSGLASIALYEANILSVLSVVISAIFAEVMNGKPEFTDHLTHKLKHHPGQIEAAAIMEHILDGSAYVKAAQKLHEMDPLQKPKQDRYALRTSPQWLGPQVEVIRTATKMIEREINSVNDNPLIDVSRNKALHGGNFQGTPIGVSMDNARLAIASIGKLMFAQFSELVNDFYNNGLPSNLSGGRNPSLDYGFKGAEIAMASYCSELQFLANPVTNHVQSAEQHNQDVNSLGLISSRKTVEALDILKLMSSTFLIALCQAIDLRHLEENLRAAVKNTVSQVAKRTLTMGVNGELHPSRFCEKDLLRVVDREYVFAYIDDPCSATYPLMQKLRQVLVEHALNNGENEKNVSSSIFQKIQVFEEELKGVLPKEVEAARAAVEGGNPAVANRIKECRSYPLYKFVREELGTELLTGEKTTSPGEEGDKVFTALSNGLIVDPLLKCLEAWNGEPLPIC

SEQ ID NO: 8667 - protein, 711 aa, Lactuca sativa
MENGNHVNGVVNELCIKDPLNWGVAAEALTGSHLDEVKKMVAEFRKPVVKLGGETLTVSQVAGIAAANDSDTVKVELSEAARAGVKASSDWVMESMNKGTDSYGVTTGFGATSHRRTKQGGALQKELIRFLNAGIFGNGTETSHTLPHSATRAAMIVRINTLLQGYSGIRFEILEAITKFLNNNITPCLPLRGTITASGDLVPLSYIAGLLTGRPNSKAVGPTGEVLNAEKAFAAAGVEGGFFELQPKEGLALVNGTAVGSGMASMVLFDANVLALLSEVLSAIFAEVMQGKPEFTDHLTHKLKHHPGQIEAAAIMEYILDGSDYVKAAQKVHEMDPLQKPKQDRYALRTSPQWLGPQIEVIRSSTKMIEREINSVNDNPLIDVSRNKALHGGNFQGTPIGVSMDNTRLAIAAIGKLMFAQFSELVNDFYNNGLPSNLSGGRNPSLDYGFKGGEIAMASYCSELQFLANPVTNHVQSAEQHNQDVNSLGLISARKTAEAVDILKLMSSTYLVALCQSIDLRHLEENMKSTVKNTVSQVAKKVLTMGVNGELHPSRFCEKDLLRVVDREYVFAYIDDVCSGTYPLMQKLRQVLVDHALNNGETEKNTNTSIFQKIATFEEELKVLLPKEVEGVRIAYENDTLSIPNRIKACRSYPLYRFVREELGGGFLTGEKVTSPGEEFDRVFTAMCKGQIIDPLLECLGGWNGEPLPIC

SEQ ID NO: 8668 - protein, 713 aa, Jatropha curcas
MATIIGNGHQNGSLEGLCITRDPLSWGVAAESMKGSHLDEVKKMVSEYRKPLVKLGGETLTVAQVAAIASHDAGVKVELAESARAGVKASSDWVMDSMNKGTDSYGVTTGFGATSHRRTKQGAALQRELIRFLNAGIFGNGTETCHTLPHSATRAAMLVRINTLLQGYSGIRFEILEAITKLLNHNITPCLPLRGTITASGDLVPLSYIAGLLTGRPNSKAIGPSGESLDAVEAFRLADIDSGFFELQPKEGLALVNGTAVGSGLASMVLFEANVLAVLSEILSAIFAEVMNGKPEFTDHLTHKLKHHPGQIEAAAIMEHILDGSSYIKAAKQLHEIDPLQKPKQDRYALRTSPQWLGPQIEVIRFSTKSIEREINSVNDNPLIDVSRNKALHGGNFQGTPIGVSMDNARLAIASIGKLMFAQFSELVNDFYNNGLPSNLSGGRNPSLDYGFKGAEIAMASYCSELQFLANPVTSHVQSAEQHNQDVNSLGLISSRKTQEAIDILKLMSSTFLVALCQAIDLRHLEENLKHAVKNTVTQVAKRVLTTGANGELHPSRFCGKDLLKVVDREQVFAYIDDPCSATYPLMQKLRQVLVEHALANGENEKNASTSVFQKIGAFEEELKTLLPKEVESAREAYESGSAAIGNKIKECRSYPLYKFVREELGSGLLTGEKVRSPGEEFDKVFTAMCEGKIIDPMMECLKEWNGAPLPIC

SEQ ID NO: 8669 - protein, 714 aa, Populus trichocarpa
METITKNGYQNGSSESLCTQRDPLSWGVAAEAMKGSHLDEVKRMVAEYRKPVVNLAGQTLTIAQVASIAGHDASNVKVELSESARPRVKASSDWVMDSMDKGTDSYGVTTGFGATSHRRTKQGGALQKELIRFLNAGIFGNGTETCHTLPHSATRAAMLVRINTLLQGYSGIRFEILEAITKLLNNNITPCLPLRGTITASGDLVPLSYIAGLLTGRPNSKATGPNGEVLDAVEAFKAAGIDSGFFELQPKEGLALVNGTAVGSGLASMVLFETNVLAVLSELISAIFAEVMNGKPEFTDHLTHKLKHHPGQIEAAAIMEHILDGSAYMKAAKKLHEMDPLQKPKQDRYALRTSPQWLGPQIEVIRFSTKSIEREINSVNDNPLIDVSRNKALHGGNFQGTPIGVSMDNVRLAIASIGKLLFAQFSELVNDFYNNGLPSNLTASRNPSLDYGFKGAEIAMASYCSELQYLANPVTSHVQSAEQHNQDVNSLGLISSRKTAESVDILKLMSTTFLVALCQAIDLRHLEENLRSAVKNTVSHVSKRVLTTGANGELHPSRFCEKELLKVVDREDVFAYADDPCSATYPLMQKLRQVLVDHALANGENEKNTSTSVFQKITAFEEELKALLPKEVESARAAYDSGNSAIENKIKECRSYPLYKFVREELGTGLLTGEKVRSPGEEFDKVFTAMCQGKIIDPMLECLGEWNGAPLPIC

SEQ ID NO: 8670 - protein, 721 aa, Gossypium hirsutum
MESITQNGTSNGHLQSFCSATNGGVGVLVDPLNWGVAAESLKGSHLDEVKRMVAEFRKPLVKLGGETLTISQVAAIATRDLGVKVELSEDARAGVKASADWVLDGMNKGTDSYGVTTGFGATSHRRTKQGAALQKELIRFLNAGIFGNGTESCHTLPHSATRAAMLVRINTLLQGYSGIRFEILEAITKLLNNNITPCLPLRGTITASGDLVPLSYIAGLLTGRPNSKAVGPNGESLDAEEAFRVAGIDSGFFVLQPKEGLALVNGTAVGSGLASMVLFEANILAVLSEILSAIFAEVMNGKPEFTDHLTHKLKHHPGQIEAAAIMEHILDGSSYVKAAKKLHEMDPLQKPKQDRYALRTSPQWLGPQIEVIRFATKSIEREINSVNDNPLIDVSRNKALHGGNFQGTPIGVSMDNTRLAIAAIGKLMFAQFSELVNDFYNNGLPSNLSASRNPSLDYGFKGAEIAMASYCSELQYLANPVTNHVQSAEQHNQDVNSLGLISSRKTAEAVDILKLMSSTYLVALCQAIDLRHLEENLRNTVKNTVSQVAKKTLTTGNNGELHPSRFCEKDLLKAVDREYVFAYIDDPCSATYPLMQKLRQVLVEHAFANGDNEKDTNTSIFQKITAFEDEFKAALPKEVEGTRVSLENGNATIPNKIKGCRSYPLYKFVREELGTGLLSGEQGKSPGEEFDKVFIAMCEGKIIDPMMECLKGWNGAPLPIC

SEQ ID NO: 8671 - protein, 719 aa, Beta vulgaris
MEANQQYQNGSSEMDLCIGGKPIQADPLNWGKAAEAITGSHLDEVKKMVAEYRNPAIRLGGETLTVAQVAAVAAATGPHEAAVELAESARAGVKASSDWVMDSMNKGTDSYGVTTGFGATSHRRTKQGGALQKELIRFLNAGVFGNGTESSHTLPHTATRAAMLVRINTLLQGYSGIRFEILEAITGLLNNNITPCLPLRGTITASGDLVPLSYIAGLLTGRPNSKAVGPNGEVLNAEQAFKAAQISSGFFELQPKEGLALVNGTAVGSGMASIVLFETNILAVLAEVISAVFAEVMNGKPEFTDHLTHKLKHHPGQIEAAAIMEHILDGSSYMKAAKALHELDPLQKPKQDRYALRTSPQWLGPQIEVIRFATKSIEREINSVNDNPLIDVSRNKALHGGNFQGTPIGVSMDNARLAIAAIGKLLFAQFSELVNDYYNNGLPSNLTASRDPSLDYGFKGAEIAMASYCSELQFLGNPVTNHVQSAEQHNQDVNSLGLISARKTAEAVDILKLMSSTFLVALCQAIDLRHLEENVKHAVKNTVSQVCRRVLITGSNGELHPGRFCEKELIRVVEREYVFAYADDPCSVTYPLMQKLRQVLVDQALANGDSEKNVSTSIFQKIGAFEEELKARLPKEVEAARAAYESGNSVIPNRIKECRSYPVYKFIREELNTNLLTGEKVISPGEEIDKVFTAICQGKIIDPLLDCLKEWNGAPLPIC

SEQ ID NO: 8672 - protein, 722 aa, Citrus sinensis
MELSHETCNGINNDRNGGTSSLGLCTGTDPLNWTVAADSLKGSHLDEVKRMVDEYRRPVVKLGGESLTIGQVTAIAAHDSGVKVELAEAARAGVKASSDWVMDSMMKGTDSYGVTTGFGATSHRRTKQGGALQKELIRFLNSGIFGNGTESSHTLPHSATRAAMLVRVNTLLQGYSGIRFEILETITKFLNHNITPCLPLRGTITASGDLVPLSYIAGLLTGRPNSKAVGPNGQVLNPTEAFNLAGVTSGFFELQPKEGLALVNGTAVGSGLAATVLFEANILAIMSEVLSAIFAEVMNGKPEFTDHLTHKLKHHPGQIEAAAIMEHILDGSSYVKAAQKLHEIDPLQKPKQDRYALRTSPQWLGPQIEVIRAATKMIEREINSVNDNPLIDVSRNKALHGGNFQGTPIGVSMDNTRLAIASIGKLMFAQFSELVNDFYNNGLPSNLTGGRNPSLDYGFKGAEIAMASYCSELQFLANPVTNHVQSAEQHNQDVNSLGLISSRKTAEAVDILKLMSSTFLVALCQAIDLRHLEENLKNTVKNTVSQVAKRVLTMGVNGELHPSRFCEKDLIKVVDREYVFAYIDDPCSASYPLMQKLRQVLVDHALDNGDREKNSTTSIFQKIGAFEDELKTLLPKEVEIARTELESGNAAIPNRIKECRSYPLYKIVREEIGTSLLTGEKVRSPGEEFDKVFAAMCEGKLIDPMLECLKEWNGAPLPICQN

SEQ ID NO: 8673 - protein, 711 aa, Salvia sclarea
MAAENGHHEESNGFCVKQNDPLNWVAAAESLKGSHLDEVKRMVEEFRKPVVKLGGETLTISQVAAIAAKDNAVAVELAESSRAGVKASSDWVMESMSKGTDSYGVTTGFGATSHRRTKQGGALQKELIRFLNAGIFGNGTESNHTLPHTATRAAMLVRINTLLQGYSGIRFEILEAITKFLNENITPCLPLRGTITASGDLVPLSYIAGLLTGRPNSKAVGPNGEPLNAEEAFKLAGVKGGFFELQPKEGLALVNGTAVGSGLASIALFDANILAVLSEVMSAVFAEVMNGKPEFTDHLTHKLKHHPGQIEAAAIMEHILDGSGYVKAAQKLHEQDPLQKPKQDRYALRTSPQWLGPQIEVIRTATKMIEREINSVNDNPLIDVSRNKALHGGNFQGTPIGVSMDNARLAIASIGKLLFAQFSELVNDFYNNGLPSNLSGGRNPSLDYGFKGSEIAMASYCSELQFLANPVTNHVQSAEQHNQDVNSLGLISSRKTVEALDILKLMSSTYLVALCQAVDLRHLEENLKHAVKNTVSQVAKRTLTMGVNGELHPSRFCEKDLIRVVDREYVFAYIDDPCSATYPLMQKLRQVLVDHALKNGDLEKNASTSIFQKIEAFEEELKALLPKEVESARMALESGSPTVANRIAECRSYPLYKFIREQLGAGFLTGEKAVSPGEECEKVFTALSNGLIIDPLLECLQGWNGQPLPIC

SEQ ID NO: 8674 - protein, 712 aa, Aquilegia formosa
MAATKINENGNSNSLCINKIDPLNWGLAAESLKGSHLDEVKRMVEEFRKPGLKLGGATLTVSQVAGIAAHGANVKVELCESARAGVKASSDWVMESMNKGTDSYGVTTGFGATSHRRTKQGGALQKELIRFLNAGVFGNGTESSHTLPYSATRAAMLVRINTLLQGYSGIRFEILEAITKFLNNNITPCLPLRGTITASGDLVPLSYIAGLLTGRPNSKAVGPNGESLNAEQAFNLAGISSGFFELQPKEGLALVNGTAVGSGLASMVLFDANILAVMSEVLSAIFAEVMQGKPEFTDHLTHKLKHHPGQIEAAAIMEHILDGSSYVKSAKKLHDTDPLQKPKQDRYALRTSPQWLGPQIEVIRSSTKSIEREINSVNDNPLIDVSRNKAIHGGNFQGTPIGVSMDNTRLAIASIGKLMFAQFSELVNDFYNNGLPSNLSGGRNPSLDYGFKGAEIAMASYCSELQFLANPVTNHVQSAEQHNQDVNSLGLISSRKTAEAVDILKLMSSTFLVALCQSIDLRHLEENLKSTVKNTVSQVAKRVLTMGVNGELHPSRFCEKDLLKVVDREYVFSYIDDPCSATYPLMQKLRQVLVEHALLNGEKEKTSSNSIFQKINAFEEELKNLLPKEVESTRTLYETGTLPIANQIKECRSYPLYKFVREELDTGLLTGEKTLSPGEVFDKVFTAMCNGKMIDPLLECLSCWNGEPLPIC

SEQ ID NO: 8675 - protein, 792 aa, Mimulus guttatus
MTRPPPFLHSSNSQTHLPKIHTSNLHFKKRSFLNTHSPHTYTNKEKLRKKNTFFSSADHIFFHQCYLFLRSPLIYNLMAPAVVAAENGHHAAGNGFCVQQNDPLNWGMAAESLKGSHLDEVKRMVAEFRKPVVKLGGETLTISQVAAIAARDNAVAVELNESARAGVKASSDWVMDSMNKGTDSYGVTTGFGATSHRRTKQGGALQKELIRFLNAGIFGNGTESNHTLPHSATRAAMLVRINTLLQGYSGIRFEILEAITKFLNNNVTPCLPLRGTITASGDLVPLSYIAGLLTGRPNSKAVGPTGETLTAVEAFKLAGVDGFFELQPKEGLALVNGTAVGSGLASIALYEANVLSLLSEVMSAIFAEVMNGKPEFTDHLTHKLKHHPGQIEAAAIMEHILDGSAYVKAAQKLHETDPLQKPKQDRYALRTSPQWLGPQIEVIRTATKMIEREINSVNDNPLIDVSRNKAIHGGNFQGTPIGVSMDNSRLAIASIGKLMFAQFSELVNDFYNNGLPSNLSGGRNPSLDYGFKGSEIAMASYCSELQFLANPVTNHVQSAEQHNQDVNSLGLISSRKTVEALDILKLMSSTYLIALCQAIDLRHLEENLRLAVKNTVSQAAKKTLTMGVNGELHPSRFCEKDLLRVVDREYVFAYIDDPCSGTYPLMQKLREVLVDHALKNGDNQKNAATSIFQKIEAFEEELKAVLPKEVESARSAVENGNAAVGNRIKECRSYPLYKFMREELGTEFLTGEKLTSPGEECDKVFTALSKGLIVDPLLECLEGWNGAPLPIC

SEQ ID NO: 8676 - protein, 719 aa, Ricinus communis
MEFSHDDNNNNHGSSLESFCTATAGHHDPLNWGMLADSLKGSHLDEVKRMVDEYRRPVVRLGGETLTIAQVTAIANRDAGIKVELSEDARAGVKASSDWVMDSMNKGTDSYGVTTGFGATSHRRTKQGGALQRELIRFLNAGIFGNGTESCHTLPHSATRAAMLVRINTLLQGYSGIRFEILEAITKFINHNVTPSLPLRGTITASGDLVPLSYIAGLLIGRPNSKCVGPNGESLDPTEAFTLAGINSGFFDLQPKEGLALVNGTAVGSGLASMVLFEANVLGILSEVLSAVFAEVMQGKPEFTDHLTHKLKHHPGQIEAAAIMEHILDGSSYIKAAQKLHEVDPLQKPKQDRYALRTSPQWLGPQIEVIRSATKMIEREINSVNDNPLIDVSRNKALHGGNFQGTPIGVSMDNTRLAIAAIGKLMFAQFSELVNDFYNNGLPSNLTGGRNPSLDYGFKGAEIAMASYCSELQFLANPVTNHVQSAEQHNQDVNSLGLISARKTAEAVDILKLMSSTFLVALCQAIDLRHLEENLKSTVKNTVSQVAKRVLTMGFNGELHPSRFCEKDLLKVVDREYIFAYIDDPCSATYPLMQKLRQVLVDHALLNGEKEKNSSTSIFQKIGAFEEELKALLPKEVENARTEYDNGNPAIPNKIKECRSYPLYKFVREELGTGLLTGEKIRSPGEEFDKVFSAMCAGKLIDPMLECLKEWNGAPLPIC

SEQ ID NO: 8677 - protein, 710 aa, Vitis vinifera
MEAMNSHGSNKVESFCVSDPLNWGVAAEELKGSHLDEVKRMVAEYRKPVVRLGGETLTISQVAAIAGREEDVTVELSEAAREGVKASSDWVMESMNKGTDSYGVTTGFGATSHRRTKEGGALQKELIRFLNAGIFGNGTDSCHTLPHSATRAAMLVRINTLLQGYSGIRFEILEAITKLLNHNITPSLPLRGTITASGDLVPLSYIAGLLTGRPNSKAVGPTGEVVNAEEAFKMAGIESGFFELQPKEGLALVNGTAVGSGLASMVLFEANVLAVLSEVLSAIFAEVMQGKPEFTDHLTHKLKHHPGQIEAAAIMEHILDGSSYVKEAKKLHEMDPLQKPKQDRYALRTSPQWLGPQIEVIRASTKSIEREINSVNDNPLIDVSRNKALHGGNFQGTPIGVSMDNTRLAIAAIGKLMFAQFSELVNDFYNNGLPSNLSGGRNPSLDYGFKGAEIAMASYCSELQFLANPVTNHVQSAEQHNQDVNSLGLISSRKTAEAVDILKLMSSTYLVALCQAIDLRHLEENLKITVKNTISHIAKKTLTTGVNGELHPSRFCEKDLLKVVDREYIFAYIDDPCSETYPLMQKVRQVLVEHALNNGENEKNVSTSIFQKIVAFEEELKALLPKEVESTRAGLESGNPFIPNRIKDCRSYPLYKFVREELGTGLLTGEKVRSPGEEFDKVFTAMCEGKIIDPLLDCLSGWNGAPLPIC

SEQ ID NO: 8678 - protein, 710 aa, Vitis vinifera
MDATNCHGSNKVESFCVSDPLNWGMAAETLKGSHLDEVKRMVAEYRKPVVRLGGETLTISQVAAIAGREGDVGVELSETARAGVNASSEWVMESMSKGTDSYGVTTGFGATSHRRTKQGGALQKELIRFLNAGIFGNGRESCHTLPHSATRAAMLVRINTLLQGYSGIRFEILEAITKLLNHNITPCLPLRGTVTASGDLVPLSYIAGLLTGRPNSKAVGPSGEVVNAEEAFKMAGIESGFFELQPKEGLALVNGTAVGSGLASMVLFETNVLAVLSEVLSAIFAEVMQGKPEFTDHLTHKLKHHPGQIEAAAIMEHILDGSSYVKEAKKLHEMDPLQKPKQDRYALRTSPQWLGPHIEVIRASTKSIEREINSVNDNPLIDVSRNKALHGGNFQGTPIGVSMDNTRLAIAAIGKLMFAQFSELVNDFYNNGLPSNLSGSRNPSLDYGFKGAEIAMASYCSELQFLANPVTNHVESAEQHNQDVNSLGLISSRKTAEAVDILKLMSTTYLVALCQAIDLRHLEENLKSTVKKTVSHVAKKTLTIGANGELHPSRFCEKDLLKVVDREHVFAYIDDPCSATYPLMQKVRQVLVEHALNNGESEKNGSTSIFQKIGAFEEELKAVLPKEVESARDGVESGNPSIPNRIKECRSYPLYKFVREELGTGLLTGEKVRSPGEDFDKVFTAMCEGKIIDPLLDCLSAWNGAPLPIC

SEQ ID NO: 8679 - protein, 720 aa, Malus domestica
MEAKTITQNGQNGHHQNGVSESQLCIKKDPLNWGLVADSLKGSHLDEVKRMVAEYRKPVVKLGGESLTISQVAAIATHDTGVKVELSESARAGVKASSDWVMDSMGKGTDSYGVTTGFGATSHRRTNKGAALQKELIRFLNAGVFGSATESGHTLPHQATRAAMLVRINTLLQGYSGIRFEILEAITKFLNNNVTPCLPLRGTITASGDLVPLSYIAGLLTGRPNSKAVGPNGQTLNASEAFELVGINSGFFELQPKEGLALVNGTAVGSGLASTVLFETNILALLAEILSAIFAEVMQGKPEFTDHLTHKLKHHPGQIEAAAIMEHILDGSSYVKAAKKLHEQDPLQKPKQDRYALRTSPQWLGPQIEVIRFSTKSIEREINSVNDNPLIDVSRNKALHGGNFQGTPIGVSMDNTRLAIASIGKLMFAQFSELVNDFYNNGLPSNLSGGRNPSLDYGFKGAEIAMASYCSELQFLANPVTNHVQSAEQHNQDVNSLGLISSRKTAEAVDILKLMSSTFLVALCQSIDLRHLEENLRNTVKNTVSQVAKRTLTTGVNGELHPSRFCEKDLLKVVDREYVFAYIDDPCSATYPLMQKLREVLIEHALTNGESEKNASTSIFQKIGAFEEELKALLPKEVESARSAIESGNAAVPNRIAECRSYPLYKFVREELGGEYLTGEKVRSPGEECDKVFQAICQGKIIDPILGCLEGWNGAPLPIC

SEQ ID NO: 8680 - protein, 715 aa, Populus trichocarpa
METVTKNGYQNGSLESLCVNQLDPLSWGVAAEAMKGSHLDEVKRMVADYRKPVVKLGGETLTIAQVASIAGHDTGDVKVELSESARPGVKASSDWVMDSMDKGTDSYGVTTGFGATSHRRTKQGGALQKELIRFLNAGIFGNGTETCHTLPHSATRAAMLVRINTLLQGYSGIRFEILEAITRLLNNNITPCLPLRGTITASGDLVPLSYIAGLLTGRPNSKATGPTGEVLDAAEAFKAAGIESGFFELQPKEGLALVNGTAVGSGLASMVLFETNVLAVLSELLSAIFAEVMNGKPEFTDHLTHKLKHHPGQIEAAAIMEHILDGSAYMKAAKKLHETDPLQKPKQDRYALRTSPQWLGPQIEVIRFSTKSIEREINSVNDNPLIDVSRNKAIHGGNFQGTPIGVSMDNVRLAIASIGKLLFAQFSELVNDFYNNGLPSNLTASRNPSLDYGFKGAEIAMASYCSELQYLANPVTTHVQSAEQHNQDVNSLGLISSRKTAEAVDILKLMSTTFLVALCQAIDLRHLEENLKSAVKNTVSQVSKRVLTTGANGELHPSRFCEKELLKVVDREYVFAYVDDPCSATYPLMQKLRQVFVDHALENGENEKNFSTSVFQKIEAFEEELKALLPKEVESARAAYDSGNSAIDNKIKECRSYPLYKFVREELGTVLLTGEKVQSPGEEFDKVFTAMCQGKIIDPMLECLGEWNGSPLPIC

SEQ ID NO: 8681 - protein, 721 aa, Citrus sinensis
MDRGAVIENGHQNGCLEGLCKDNNYSSGDALNWGVMAETLKGSHLEEVKRMVAEYRKPVVNLGGETLTVAQVAAIATAGDVNAQVKVELSESAREGVKASSDWVMDSMNKGTDSYGVTTGFGATSHRRTKNGGALQKELIRFLNAGIFGNGTESSHTLPHSTTRAAMLVRVNTLLQGYSGIRFEILEAITKLLNHNITPCLPLRGTITASGDLVPLSYIAGLLTGRPNSKATGPNGEIIDAQEASKQAGFGFFELQPKEGLALVNGTAVGSGLASMVLFEANNLALLSEILSAIFAEVMQGKPEFTDHLTHKLKHHPGQIEAAAIMEHILDGSSYVNAAKKLHEIDPLQKPKQDRYALRTSPQWLGPQIEVIRFATKSIEREINSVNDNPLIDVSRNKALHGGNFQGTPIGVSMDNTRLAIAAIGKLMFAQFSELVNDFYNNGLPSNLSGGRNPSLDYGFKGAEIAMASYCSELQFLANPVTNHVQSAEQHNQDVNSLGLISSRKTAEAVDILKLMSSTFLVALCQAIDLRHLEENLKHTVKDTVSQVARKVLTVGANGELHPSRFCEKDLLKAADREHVFAYIDDPCSATYPLMQKLRQVLVEHALNNGEIEKNANSSIFQKIAAFEEELKAVLPKEVENARQTVENGNPTIPNRIKECRSYPLYRLVREELGTNFLTGEKVTSPGEKFDKVFTAMCQGKIIDPMLECLREWNGAPLPIC

SEQ ID NO: 8682 - protein, 717 aa, Prunus persica
  misc_feature (380)..(380): Xaa can be any naturally occurring amino acid
  misc_feature (419)..(419): Xaa can be any naturally occurring amino acid
  misc_feature (451)..(451): Xaa can be any naturally occurring amino acid
MATNSIKQNGHKNGSVELPELCIKKDPLNWGVAAETLKGSHLDEVKRMVAEYRKPVVKLGGESLTISQVAAIATHDSGVKVELSESARAGVKASSDWVMDSMSKGTDSYGVTTGFGATSHRRTKQGAALQKELIRFLNAGVFGSTKESGHTLPHQATRAAMLVRINTLLQGYSGIRFEILEVITKFLNNNVTPCLPLRGTITASGDLVPLSYIAGMLTGRPNSKAVGPDGQTLSAAEAFEFVGINSGFFELQPKEGLALVNGTAVGSGLASTVLFDTNILALLSEILSAIFAEVMQGKPEFTDHLTHKLKHHPGQIEAAAIMEHILDGSSYVKAAKKLHEQDPLQKPKQDRYALRTSPQWLGPQIEVIRYSTKSIEREIXSVNDNPLIDVSRNKALHGGNFQGTPIGVSMDNTRLAIAXIGKLMFAQFSELVNDFYNNGLPSNLSGGRNPXLDYGFKGAEIAMASYCSELQFLANPVTNHVQSAEQHNQDVNSLGLISSRKTAEAVDILKLMSSTFLVALCQAIDLRHLEENLRNTVKNTVSQVAKRTLTTGVNGELHPSRFCEKDLLKVVDREYVFAYIDDPCSATYPLMQKLRQVLVEHALTNGENEKNASTSIFQKIVAFEEELKVLLPKEVDSARAALDSGSAGVPNRITECRSYPLYKFVREELGAEYLTGEKVRSPGEECDKVFTAICEGKIIDPILDCLEGWNGAPLPIC

SEQ ID NO: 8683 - protein, 722 aa, Theobroma cacao
METIAQNGRQNGSLESFCTTASTATKGAVVDPLNWGATAESLKGSHLDEVKRMVAEYRKPSVKLGGETLTISQVAAIATRDLGVKVELSEDARAGVKASADWVLDGMNKGTDSYGVTTGFGATSHRRTKQGAALQKELIRFLNAGIFGNGTESCHTLPHSATRAAMLVRINTLLQGYSGIRFEILEAITKLLNHNITPCLPLRGTITASGDLVPLSYIAGLLTGRPNSKAVGPKGESLDAQEAFCVAGIDTGFFVLQPKEGLALVNGTAVGSGLASMVLFEANILAVLSEILSAIFAEVMNGKPEFTDHLTHKLKHHPGQIEAAAIMEHILEGSSYVKAAKKLHEMDPLQKPKQDRYALRTSPQWLGPQIEVIRFATKSIEREINSVNDNPLIDVSRNKALHGGNFQGTPIGVSMDNARLAIAAIGKLMFAQFSELVNDFYNNGLPSNLSGGRNPSLDYGFKGAEIAMASYCSELQYLANPVTNHVQSAEQHNQDVNSLGLISSRKTAEAVDILKLMSSTYLVALCQAIDLRHLEENLRNTVKNTVSQIAKKILTTGANGELHPSRFSEKDLLKAVDSEYVFAYIDDPCSATYPLMQKLRQVLVEHALANGENEKNASTSIFQKVAAFEEELKAILPKEVESARLSLENGNAGIPNRIQECRSYPLYKFVREELGTGLLTGENVKSPGEEFDKVFTAMCQGKIIDPMLECLKEWNGAPLPIC

SEQ ID NO: 8684 - protein, 694 aa, Cynara scolymus
DPLNWGIAAESLKGSHLDEIKRMVAEFRRPIVRLGGETLTVSQVAAIAATDDGGVKVELSESSRAGVKASSDWVMESMGKGTDSYGVTTGFGATSHRRTKEGGALQKELIRRFLNAGIFGNGTESSHTLPHSATRAAMLVRINTLLQGYSGIRFEILEAITKFLNHNVTPFLPLRGTITASGDLVPLSYIAGLLTGRPNSKAVGPTGEILNAEKAFAQAGVEGGFFELQPKEGLALVNGTAVGSGMASMVLFEANVLALLSEVLSAIFAEVMQGKPEFTDHLTHKLKHHPGQIEAAAIMEYILDGSDYVKAAQKVHEMDPLQKPKQDRYALRTSPQWLGPQIEVIRSATKMIEREINSVNDNPLIDVSRNKALHGGNFQGTPIGVSMDNTRLAIAAIGKLMFAQFSELVNDFYNNGLPSNLSGGRNPSLDYGFKGGEIAMASYCSELQFLANPVTNHVQSAEQHNQDVNSLGLISARKTAEAVDILKLMSSTYLVALCQSVDLRHLEENMKSTVKNTVSQVAKKVLTMGVNGELHPSRFCEKDLLRVVDREYVFAYIDDPCSATYPLMQRLRQVLVDHALNNGETEKNTNTSIFQKIATFEDELKAILPKEVESVRTAYETDSLSIPNRIKACRSYPLYRFVREELGGGFLTGEKVTSPGEEFDKVFTAMCKGELIDPLLECVEGWNGAPLPIC

SEQ ID NO: 8685 - protein, 712 aa, Medicago truncatula
MEGITNGHVEATFCLSKNGGDPLNWGAAAESLTGSHLDEVKRMVEEYRNPLVKIGGETLTIAQVAGIASHDSGVRVELSESARAGVKASSDWVMDSMNKGTDSYGVTTGFGATSHRRTKQGGALQKELIRFLNAGIFGNGTESNCTLPHTATRAAMLVRINTLLQGYSGIRFEILEAITKLLNNNITPCLPLRGTITASGDLVPLSYIAGLLTGRPNSKAVGPSGEILNAKEAFQLAGIGSDFFELQPKEGLALVNGTAVGSGLASIVLFEANVLAVLSEVMSAIFAEVMQGKPEFTDHLTHKLKHHPGQIEAAAIMEHILDGSAYVKAAKKLHETDPLQKPKQDRYALRTSPQWLGPLIEVIRFSTKSIEREINSVNDNPLIDVSRNKAIHGGNFQGTPIGVSMDNTRLALASIGKLMFAQFSELVNDFYNNGLPSNLTASRNPSLDYGFKGSEIAMASYCSELQYLANPVTTHVQSAEQHNQDVNSLGLISSRKTNEAIEILKLMSSTFLIALCQAIDLRHLEENLRNTVKNTVSQVAKRTLTTGVNGELHPSRFCEKDLLKVVDREYVFAYADDPCLATYPLMQKLRQVLVDHALVNTEGEKNSNTSIFQKIATFEDELKAILPKEVESARTAYENGQSGISNKIKECRSYPLYKFVREELGTALLTGEKVISPGEECDKLFTAMCQGKIVDPLMECLGEWNGAPLPIC

SEQ ID NO: 8686 - protein, 723 aa, Vitis vinifera
MELSNGNHCHTNGKASIESFCMGGTGTKAAADPLNWNMAAESLKGSHLDEVKRMVEEYRRQVVQLGGETLTISQVAAVASRDTGVTVELSEEAREGVKASSDWVMDSMNNGTDSYGVTTGFGATSHRRTKQGGALQMELIRFLNAGIFGNGTESCHTLPHSATRASMLVRINTLLQGYSGIRFEILEAITKLINHNITPCLPLRGTISASGDLVPLSYIAGLLLGRSSCKAVGPNGEPLSAEEAFRVAGIKGGFFELQPKEGLALVNGTAVGSGMASMVLFEANILAVLSEVLSALFAEVMQGKPEFTDHLTHKLKHHPGQIEAAAIMEHILDGSSYIKAAQKLHEMDPLQKPKQDRYALRTSPQWLGPQIEVIRAATKSIEREINSVNDNPLIDVSRNKALHGGNFQGTPIGVSMDNTRLAIASIGKLMFAQFSELVNDFYNNGLPSNLSGGRNPSLDYGFKGAEIAMASYCSELQFLANPVTNHVQSAEQHNQDVNSLGLISSRKTAEAVDILKLMSSTFLIALSQAIDLRHLEENLKNTVKNTVSQVAKRVLTIGFNGELHPSRFCEKDLLKIVDREHVFAYIDDPCSSTYPLMQKLRQVLVEHALINGEREKNSSTSIFQKIVAFEDELKALLPKEVESTRIDYENGNSAISNRIKDCRSYPLYKFVREELGASFLTGEKTTSPGEECDKVFTAMCAGKLIDPLLDCLKEWNGAPLPIC

SEQ ID NO: 8687 - protein, 718 aa, Citrus sinensis
MEIGATTENGHQNGGLEGLCKNNNYNYSSGDALNWGVMAETLKGSHLEEVKRMVAEYRKPVVNLGGETLTVAQVAAIATSSTNVELSESAREGVKASSDWVMESMNKGTDSYGVTTGFGATSHRRTKNGGALQKELIRFLNAGIFGNGTESSHTLPHSATRAAMLVRVNTLLQGYSGIRFEILEAITKLLNHNITPCLPLRGTITASGDLVPLSYIAGLLTGRPNSKATGPNGEIIDAQEASKQAGFGFFELQPKEGLALVNGTAVGSGLASMVLFEANNLALLSEILSAIFAEVMQGKPEFTDHLTHKLKHHPGQIEAAAIMEHILDGSSYVNVAKKLHEIDPLQKPKQDRYALRTSPQWLGPQIEVIRFATKSIEREINSVNDNPLIDVSRNKALHGGNFQGTPIGVSMDNTRLAIAAIGKLMFAQFSELVNDFYNNGLPSNLSGGRNPSLDYGFKGAEIAMASYCSELQFLANPVTNHVQSAEQHNQDVNSLGLISSRKTAEAVDILKLMSSTFLVALCQAIDLRHLEENLKHTVKNTVSQVAKKVLTVGASGELHPSRFCEKDLLKAADREHVFAYIDDPCSATYPLMQKLRQVLVEHALNNGENEKTANSSIFQKIAAFEEELKTVLPKEVENARQTVENGSPTIPNRIKECRSYPLYRLVREELGSNFLTGEKVTSPGEEFDKVFTAMCQGKIIDPMLECLREWNGAPLPIC

SEQ ID NO: 8688 - protein, 721 aa, Gossypium hirsutum
MDMVTQNAQQSSSLESFCTTTTTAKGGVVDPLNWGVAAESLQGSHLDEVKRMVAEYRRSLVKLGGETLTISQVAAIATRDLGVKVELSEDARAGVKASADWVLDGMNKGTDSYGVTTGFGATSHRRTKQGAALQKELIRFLNAGIFGNGIESCHTLPHSTTRAAMLVRINTLLQGYSGIRFEILEAITKLLNHNVTPCLPLRGTITASGDLVPLSYIAGLLTGRPNSKAVGPNGEPLDAQEAFHVAGIDSGFFVLQPKEGLALVNGTAVGSGLASMVLFEANILAVLSEILSAIFAEVMNGKPEFTDHLTHKLKHHPGQIEAAAIMEHILEGSSYVKAAKKLHEMDPLQKPKQDRYALRTSPQWLGPQIEVIRFATKSIEREINSVNDNPLIDVSRNKALHGGNFQGTPIGVSMDNARLAIAAIGKLMFAQFSELVNDFYNNGLPSNLSGGRNPSLDYGFKGAEIAMASYCSELQYLANPVTNHVQSAEQHNQDVNSLGLISSRKTAEAVDILKLMSSTFLVALCQAIDLRHVEENLRNTVKNTVSQIAKKTLTTGANGELHPSRFCEKDLLKAVDREYVFAYIDDPCSATYPLMQKLRQVLVEHALTNGESEKNTSTSIFQKIADFEEELQAVLPKEVESARVTLENGNAAIPNMIKDCRSYPLYKFVREELGTGLLTGEKVKSPGEEFDKVFTAMCQGKIIDPMLECLKEWNGAPLPIC

SEQ ID NO: 8689 - protein, 712 aa, Glycine max
MEATNGHQNGSFCLSSTKGSDPLNWGAAAEAMKGSHLDEVKRMVSEYRKPVVRLGGETLTIAQVAAVAGHDHGVTVELSESAREGVKASSEWVMNSMNNGTDSYGVTTGFGATSHRRTKQGGALQKELIRFLNAGIFGNGTESSHTLPHTATRAAMLVRINTLLQGYSGIRFEILEAITKLLNNNVTPCLPLRGTITASGDLVPLSYIAGLLTGRPNSKAVGPNGEVLNAKEAFELASINSEFFELQPKEGLALVNGTAVGSGLASMVLFEANILAVLSEVLSAIFAEVMQGKPEFTDHLTHKLKHHPGQIEAAAIMEHILDGSSYMKAAKKLHEIDPLQKPKQDRYALRTSPQWLGPLIEVIRFSTKSIEREINSVNDNPLIDVSRNKALHGGNFQGTPIGVSMDNTRLALASIGKLMFAQFSELVNDFYNNGLPSNLTASRNPSLDYGFKGAEIAMASYCSELQYLANPVTSHVQSAEQHNQDVNSLGLISSRKTNEAIEILKLMSSTFLIALCQAIDLRHLEENLKNSVKNTVSQVSKRILTTGVNGELHPSRFCEKDLLKVVDREYVFSYIDDPCSATYPLMQKLRQVLVDHALVNAENEKDMNTSIFQKIANFEEELKNFLPKEVESARVAYESGKAAIPNKIQECRSYPLYKFVREELGTGLLTGEKVRSPGEEFDKLFTAMCQGKIIDPLLECLGEWNGAPLPIC

SEQ ID NO: 8690 - protein, 703 aa, Manihot esculenta
MDFCHDNNGTPDPLNWNLAADSLKGSHLDEVKRMVNDYRKPVVRLGGETLTVAQVTAIANRDSGVKVELSEAARAGVKASSDWVLDSMNKGTDTYGITTGFGATSHRRTKQGGALQRELIRFLNAGIFGNGAESSHTLPHSGTRAAMLVRINTLLQGYSGIRFEILEAISKFINNNITPCLPLRGTITASGDLIPLAYIAGLLTGRPNSKSVGPDGESLDAAEAFKLAGINGGFFELQPKEGLALVNGTAVGSGLASLVLFEANVLAILSEVLSAIFAEVMQGKPEFTDHLTHKLKHHPGQIEAAAIMEHILDGSSYIKEAQKIHEIDPLQKPRQDRYALRTSPQWLGPQIEVIRTATKMIEREINSVNDNPLIDVSRNKALHCGNFQGTPIGVSMDNTRLAIASIGKLMFAQFSELVNDFYNNGLPSNLTGGRNPSLDYGFKGAEIAMASYCSELQFLANPVTNHVQSAEQHNQDVNSLGLISARKTAEAVDILKLMSSTYLVALCQAIDLRHLEENLKNTVKNTVSQVAKRVLTMGINGELHPSRFCEKDLLKVIDREYVFAYSDDPCSATYPLMQKLRQVLVDHALMNGDKEKNSSTSIFQKIAAFEEELKAILPKEVESCRIECENENPAIPNRIKECRSYPLYKFVREELGTNLLTGEKVRSPGEEFDKVFSAMCAGKMIDPMLECLKEWNGAPLPIS

SEQ ID NO: 8691 - protein, 706 aa, Tropaeolum majus
MESPLCNGGFCTTDPLNWGLAAESLKGSHLDEVKRMIDEYRKPVVKLGGESLTIGQVTAIANLWSGGVKVELSEEARAGVKASSDWVMDSMSKGTDSYGVTTGFGATSHRRTKEGGALQKELIRFLNAGIFGNGTEASHTLPHTATRAAMLVRINTLLQGYSGIRFEILEAISKFLNNNITPCLPLRGTITASGDLVPLSYIAGLLTGRPNSKAVGPKGEPLNPAQAFDVAGIDGGFFELQPKEGLALVNGTAVGSGLASMVLFEANILAIMSEVLSAIFAEVMQGKPEFTDHLTHKLKHHPGQIEAAAIMEHILDGSSYIKTAQTLHEMDPLQKPKQDRYALRTSPQWLGPQIEVIRAATKMIEREINSVNDNPLIDVSRNKALHGGNFQGTPIGVSMDNTRLAIASIGKLMFAQFSELVNDFYNNGLPSNLSGGRNPSLDYGFKGAEIAMASYCSELQFLANPVTNHVQSAEQHNQDVNSLGLISSRKTAEAIEILKLMSTTFLVGLCQAIDLRHLEENLKYVVKNTVSQVAKRVLTMGVNGELHPSRFCEKYLLQVVDREYVFAYIDDPCSAVYPLMQKLRQVLVEQALINVEKEKNSSTSIFQKISAFEEELKVVLPKEVESCRIKVENGNSDIPNQIKQCRSYPLYKFVREELGTGLLTGEKVRSPGEEFDKVFSAMCEGELIDPLMDCLKGWNGAPLPIC

SEQ ID NO: 8692 - protein, 711 aa, Populus trichocarpa
MEFCQDSCTGNGSLGFNPNDPLNWGMVAESLKGSHLDEVKRMIDEYRKPVVKLGGESLTIGQVTAIASRDVGVKVELSEEARVGVKASSDWVMDSMNKGTDSYGVTTGFGATSHRRTKQGGELQKELIRFLNAGIFGNGTESTHTLPHSASRAAMLVRINTLLQGYSGIRFEILEAITKLLNHNITPCLPLRGTITASGDLVPLSYIAGLLTGRPNSKAVGPNGETLAAAEAFTLAGINGGFFELQPKEGLALVNGTAVGSGLASMVLFEANVLAILSEVLSAIFAEVMQGKPEFTDHLTHKLKHHPGQIEAAAIMEHILDGSSYVKAAQKLHEIDPLQKPKQDRYALRTSPQWLGPLIEVIRTSTKMIEREINSVNDNPLIDVSRNKALHGGNFQGTPIGVSMDNTRLAIASIGKLMFAQFSELVNDYYNNGLPSNLTGGRNPSLDYGFKGAEIAMASYCSELQFLANPVTNHVQSAEQHNQDVNSLGLISARKTAEAVEILKLMSTTWLVALCQAIDLRHIEENLKNTVKNTVSQVAKRVLTMGFNGELHPSRFCEKDLLKVVDREHAFTYIDDPCSATYPLMQKLRQVLVDHALMNGEKEHNSSTSIFQKIGAFEEELKTLLPKEVENARLELENGNPAIPNRITECRSYPLYKFVREELGTILLTGEKVGSPGEEFDKVFTAICAGKLIDPMLECLKEWNGAPLPLC

SEQ ID NO: 8693 - protein, 714 aa, Camellia sinensis
MDSTTAIGNGVGSGGSPGFCLKDPLNWGVAAEAMKGSHLKEVKGMVEEFRKPVVRLGGETLTISQVAAIAVRGSEVAVELSESAREGVKASSDWVMESMNKGTDSYGVTTGFGATSHRRTKEGGALQKELIRFLNAGIFGNGTESCHTLPQSATRAAMLVRINTLLQGYSGIRFEILETISKFLNNNITPCLPLRGTITASGDLIPLSYIAGLLTGRHNSKAVGPTGKTLHPKEAFRLTGNEGGFFELQPKEGLALVNGTAVGSGLASMVLFEANILAVLSEVLSAIFAEVMQGKPEFTDHLTHKLKHHPGQIEAAAIMEHILDGSSYVKAAQKLHEMDPLQKPKQDRYALRTSPQWLGPLIEVIRSSTKSIEREINSVNDNPLINVSRNKALHGGNFQGTPIGVSMDNTRLAVASIGKLMFAQFSELVNDFYNNGLPSNLSGGRNPSLDYGFKGAEIAMAAYCSELQFLANPVTNHVQSAEQHNQDVNSLGLISSRKTAEAVDILKLMSSTYLVALCQAVDLRHFEENLRNTVKSTVSQVAKRVLTMGVNGELHPSRFCEKDLLRVVDREYIFAYIDDPCSATYPLMQKLRQVLVEHALKNGESEKNLSTSIFQKIRAFEEEIKTLLPKEVESTRAAIENGNSAIPNRIKECRSYPLYKFVREELGTELLTGEKVRSPGEEFDKVFTALCKGEMIDPLMDCLKEWNGAPLPIC

SEQ ID NO: 8694 - protein, 710 aa, Manihot esculenta
MEFCEAHNVTTSPGFSSADPLNWGMAAESLKGSHLDEVKRMVDEYRKPVVRLGGETLTIAQVTAIANHDSGVKVELSEEARAGVKASSDWVLDSMNKGTDSYGVTTGFGATSHRRTKQGGALQRELIRFLNAGIFGNGQESCHTLSHSATRAAMLVRINTLLQGYSGIRFEIMEAITKFINNNVTPRLPLRGTITASGDLVPLSYIAGLLTGRPNSKSLGPNGESLDAAEAFKLAGINGGFFELQPKEGLALVNGTAVGSGLASMVLFEANVLAVLSEVLSAIFAEVMLGKPEFTDHLTHKLKHHPGQIEAAAIMEHVLDGSSYIKAAQKVHEIDPLQKPKQDRYALRTSPQWLGPQIEVIRTATKMIEREINSVNDNPLIDVSRNIALHGGNFQGTPIGVSMDNTRLAIASIGKLMFAQFSELVNDFYNNGLPSNLTGGRNPSLDYGFKGAEIAMASYCSELQFLANPVTNHVQSAEQHNQDVNSLGLISSRKTAEAVDILKLMSSTYLVALCQAIDLRHLEENLKQTVKNTVSQVAKRVLTMGINGELHPSRFCEKDLLKVVDREYVYAYVDDPCSATYPLMQKLRQVLVDHAMMNGEKEKNSSTSIFQKIGAFEEELKTLLPKEVESARTEYENGNPAISNKIKECRSYPLYKFVREELGCSLLTGEKIRSPGEEFDKVFSAICAGKLIDPMLECLKEWNGAPLPIC

SEQ ID NO: 8695 - protein, 713 aa, Glycine max
MEATNGHQNGSFCLSTAKGSSDPLNWGAAAEAMKGSHLDEVKRMVAEYRKPVVRLGGETLTIAQVAAVAGHDHGVAVELSESAREGVKASSEWVMNSMNNGTDSYGVTTGFGATSHRRTKQGGALQKELIRFLNAGIFGNGTESSHTLPHTATRAAMLVRINTLLQGYSGIRFEILEAITKLLNNNVTPCLPLRGTITASGDLVPLSYIAGLLTGRPNSKAVGPSGEVLNAKEAFELASINSEFFELQPKEGLALVNGTAVGSGLASMVLFEANILAVLSEVLSAIFAEVMQGKPEFTDHLTHKLKHHPGQIEAAAIMEHILDGSSYMKAAKKLHEIDPLQKPKQDRYALRTSPQWLGPLIEVIRFSTKSIEREINSVNDNPLIDVSRNKALHGGNFQGTPIGVSMDNTRLALASIGKLMFAQFSELVNDFYNNGLPSNLTASRNPSLDYGFKGAEIAMASYCSELQYLANPVTTHVQSAEQHNQDVNSLGLISSRKTNEAIEILKLMSSTFLIALCQAIDLRHLEENLKNSVKNTVSQVSKRILTTGVNGELHPSRFCEKDLLKVVDREYIFSYIDDPCSATYPLMQKLRQVLVDHALVNAESEKDVNSSIFQKIAIFEEELKNLLPKEVEGARAAYESGKAAIPNKIQECRSYPLYKFVREELGTGLLTGEKVRSPGEEFDKLFTAMCQGKIIDPLMECLGEWNGAPLPIS

SEQ ID NO: 8696 - protein, 714 aa, Mimulus guttatus
MAAAAATENGHHNSNGYCVKQKDPLNWGLAAEGLKGSHLDEVKRMVEEFRKPVVNLGGKTLTIAQVAAIAATDNAVTVELAEAARAGVKASSDWVMDSMNKGTDSYGVTTGFGATSHRRTKQGGALQKELIRFLNAGIFGNGTESSHMLPHSATRAAMLVRINTLLQGYSGIRFEILEAITKFLNHNITPCLPLRGTITASGDLVPLSYIAGFLTGRPNSKAVGPKGEPLTADEAFTLAGVAGGFFELQPKEGLALVNGTAVGSGLASIALYEANVLSLLSEVMSAIFAEVMNGKPEFTDHLTHKLKHHPGQIEAAAIMEHILDGSAYVKAAAKLHETDPLQKPKQDRYALRTSPQWLGPQIEVIRTATKMIEREINSVNDNPLIDVSRNKAIHGGNFQGTPIGVSMDNSRLAIASIGKLMFAQFSELVNDFYNNGLPSNLSGGRNPSLDYGFKGSEIAMASYCSELQFLANPVTNHVQSAEQHNQDVNSLGLISSRKTVEALDILKLMSSTYLVALCQAIDLRHLEENLRLTVKNTVSQVAKKTLTTGSTGELHPSRFCEKDLMRIVDREYVFAYIDDPCSGTYPLMQKLREVLVEHALKNGENEKNANTSIFQKIGDFEEELKAILPKEVESARVALESGNAAVGNRITECRSYPLYKFIREELGTGLLTGEKVISPGEECEKVFVALSNGLIVDPLLECLQGWNGEPLPIC

SEQ ID NO: 8697 - protein, 712 aa, Trifolium pratense
MEGITNGHAEATFCVTKSVGDPLNWGAAAESLTGSHLDEVKRMVEEYRNPLVKIGGATLTIAQVAGIASHDSGVRVELSESARAGVKASSDWVMDSMNNGTDSYGVTTGFGATSHRRTKQGGALQKELIRFLNAGIFGNGTESNCTLPHTATRAAMLVRINTLLQGYSGIRFEILEAITKLLNNNITPCLPLRGTITASGDLVPLSYIAGLLTGRPNSKAVGPSGEILNAKEAFQLAGIGSEFFELQPKEGLALVNGTAVGSGLASIVLFEANVLAVLSEVMSAIFAEVMQGKPEFTDHLTHKLKHHPGQIEAAAIMEHILDGSAYVKAAKKLHETDPLQKPKQDRYALRTSPQWLGPLIEVIRFSTKSIEREINSVNDNPLIDVSRNKAIHGGNFQGTPIGVSMDNTRLALASIGKLMFAQFSELVNDFYNNGLPSNLTASRNPSLDYGFKGAEIAMASYCSELQYLANPVTTHVQSAEQHNQDVNSLGLISSRKTNESIEILKLMSSTFLIALCQAIDLRHLEENLRNTVKNTVSQVAKRTLTTGVNGELHPSRFCEKDLLKVVDREYVFAYADDPCLATYPLMQKLRQVLVDHALVNVDGEKNSNTSIFQKIATFEDELKAILPKEVESTRVAYENGQCGISNKIKECRSYPLYKFVREELGTALLTGEKVISPGEECDKLFTAMCQGKIVDPLLECLGEWNGAPLPIC

SEQ ID NO: 8698 - protein, 706 aa, Manihot esculenta
MATVSQNGHQNGSLDNLCTIRDPLSWGVAAESMSGNHLDEVKKMVAEYRKPLVKLGGETLTVAQVAAIASGGGRDSCVKVELAESARAGVKASSDWIMDSMNQGTDSYGVTTGFGATSHRRTKEGGALQRELIRFLNAGIFGKGTESCHTLSHSATRAAMLVRINTLLQGYSGIRFEILEAITKFLNHNITPCLPLRGTITASGDLVPLSYIAGLLTGRPNSKAVGPNGESIDAQQAFSVLPKEGLALVNGTAVGSGLASMVLFEANVLAVLSEVLSAIFAEVMNGKPEFTDHLTHKLKHHPGQIEAAAIMEHILDGSSYIKAAKKLHEMDPLQKPKHDRYALRTSPQWLGPQIEVIRFSTKAIEREINSVNDNPLIDVSRNKALHGGNFQGTPIGVSMDNARLAIASIGKLMFAQFSELVNDFYNNGLPSNLTASRDPSLDYGFKGAEIAMASYCSELQYLANPVTSHVQSAEQHNQDVNSLGLISARKTEEAIDILKLMSTTFLVALCQAIDLRNLEENLKHTVKNTVSQVAKRVLTTNANGELHPSRFCEKDLLKVVDHEQVFAYIDDPCSATYPLMQKLRQVLVDHALANGENEKNPSSSIFQKIEAFEEELKALLPKEVENAREAYESGNPAIANKIKECRSYPLYKFVREEVGTGLLTGEKVRSPGEEFDKVFTAMCQGKIIDPMLDCLKEWNGAPLPIC

SEQ ID NO: 8699 - protein, 711 aa, Populus trichocarpa
MEFCQDSRNGNGSLGFNTNDPLNWGMAAESLKGSHLDEVKRMIEEYRKPVVKLGGETLTIGQVTAIASRDVGVMVELSEEARAGVKASSDWVMDSMSKGTDSYGVTTGFGATSHRRTKQGGELQKELIRFLNAGIFGNGTESSHTLPRSATRAAMLVRINTLLQGYSGIRFEMLEAITKLLNHNITPCLPLRGTITASGDLVPLSYIAGLLTGRPNSKAVGPNGEPLSPAEAFTQAGIDGGFFELQPKEGLALVNGTAVGSGLASMVLFETNVLAILSEVLSAIFAEVMQGKPEFTDHLTHKLKHHPGQIEAAAIMEHILDGSAYVKEAQKLHEIDPLQKPKQDRYALRTSPQWLGPLIEVIRTSTKMIEREINSVNDNPLIDVSRNKALHGGNFQGTPIGVSMDNTRLAIASIGKLMFAQFSELVNDFYNNGLPSNLTGGRNPSLDYGFKGAEIAMASYCSELQFLANPVTNHVQSAEQHNQDVNSLGLISSRKTAEAVDILKLMSTTFLVGLCQAVDLRHIEENLKSTVKNTVSQVAKRVLTMGFNGELHPSRFCEKDLLKVVDREHVFSYIDDPCSATYPLMQNLRQVLVEHALVNGERERNSTTSIFQKIGSFEEELKTLLPKEVESARLEVENGNPAIPNRIKECRSYPLYKFVREELGTSLLTGEKVKSPGEEFDKVFTAICAGKLIDPLLECLKEWDGAPLPIC

SEQ ID NO: 8700 - protein, 714 aa, Lotus japonicus
MAATTNSQNSSLFCTAKGGSDPLNWGVAAESMKGSHLDEVKRMVAEYRKPVVRLGGETLTIAQVAAVAAHDQHNGVSVELCESARAGVKASSDWVMNSMNNGTDSYGVTTGFGATSHRRTKQGNALQQELIRFLNAGIFGNGTESSHTLPQPATRAAMLVRINTLLQGYSGIRFEILEAITKLLNNNITPCLPLRGTVTASGDLVPLSYIAGLLTGRQNSKAVGPSGEVLNAKEAFELASIDSGFFELQPKEGLALVNGTAVGSGLASIVLFEANILAVLSEVLSAIFAEVMQGKPEFTDHLTHRLKHHPGQIEAAAIMEHILDGSSYIKAAKKLHEMDPLQKPKQDRYALRTSPQWLGPLIEVIRFSTKSIEREINSVNDNPLIDVSRNKALHGGNFQGTPIGVSMDNTRLALAAIGKLMFAQFTELVDDHYNNGLPSNLTASRNPSLDYGLKGAEIAMASYCSELQYLANPVTTHVQSAEQHNQDVNSLGLISSRKTNEAIEILKLMSSTFLIALCQAIDLRHLEENLRYSVKNTVSQVAKRTLTTSVSGELHPSRFCEKDLLKVVDREVVFAYIDDPCSATYPLMQKLRQVLVDHALVNAENEKNQNTSIFQKISTFEDELKSLLPKEVESARNAYESGNPVIPNKINECRSYPLYKFVREELGTELLTGEKVRSPGEECDKLFTAICQGKIIDPLLECLGEWNGAPLPIC

SEQ ID NO: 8701 - protein, 718 aa, Petunia hybrida
MEYANENCNGHASQDICVKGHDQQLDPLNWNMAADALKGSHLDEVKRMVKEFRKPVVRLGGETLTVAQVAAIASQSGTDVTVQLSEASRAGVKASSDWVLQGMINGTDSYGVTTGFGATSHRRTKEGAALQKELIRFLNAGIFGNGTESSHTLPHSATRAAMLVRINTLLQGYSGIRFEILEAITKLLNNNITPCLPLRGTITASGDLVPLSYIAGLLTGRPNSKATGPNGELLDAVKAFQRAGIDTGFFELQPKEGLALVNGTAVGSGLASMVLFDANILAVLSEVLSAIFAEVMQGKPEFTDYLTHKLKHHPGQIEAAAIMEHILDGSSYVKEAKIVHEMDPLQKPKQDRYALRTSPQWLGPQIEVIRAATKMIEREINSVNDNPLIDVSRNKALHGGNFQGTPIGVSMDNTRLALASIGKLMFAQFSELVNDYYNNGLPSNLTGGRNPSLDYGFKGAEIAMASYCSELQFLANPVTNHVQSAEQHNQDVNSLGLISSRKTAEAVDILKLMSSTYLVALCQAIDLRHLEENLKATVKNSVSLVAKKVLTIGEKGELHHSRFCEKDMLKVVDREYIFAYADDACSATYPLMQKLRQVLVDRALLNVDGEKDSSTSIFQKIKAFEEELKVVLPKEIERARSDLEQGKPAIPNRIQECRSYPLYKFVREELKANYLTGEKVQSPGEEFDKVFTAMNEGKLVDPLLNCLKEWNGAPLPLC

SEQ ID NO: 8702 - protein, 717 aa, Lotus japonicus
MAPTTNGHHQSQNDSIFCTAAKAGSDPLSWGVAAESMKGSHLDEVKRMVAEYRKPVVKLGGETLTIAQVAAIAANDQGVSVELCESARAGVKASSDWVMNSMNNGTDSYGVTTGFGATSHRRTKNGNALQLELIRFLNAGIFGNGTESTHTLPQPATRAAMLVRINTLLQGYSGIRFEILEAITKLINNNITPCLPLRGTVTASGDLVPLSYIAGLLTGRQNSKAVGPSGEVVNAKEAFQLAGIDSGFFELQPKEGLALVNGTAVGSGLASIVLFDANVLAILSEVLSAIFAEVMQGKPEFTDHLTHKLKHHPGQIEAAAIMEHILDGSSYMKAAKKLHEVDPLQKPKQDRYALRTSPQWLGPLIEVIRFSTKSIEREINSVNDNPLIDVSRNKALHGGNFQGTPIGVSMDNTRLALAAIGKLMFAQFTELVDDHYNNGLPSNLTASRNPSLDYGLKGAEIAMASYCSELQYLANPVTTHVQSAEQHNQDVNSLGLISSRKTYEAIEILKLMSSTFLIALCQAIDLRHLEENLKHSVKSTVSQVAKRTLTTGVNGELHPSRFCEKDLLKVVDRETLFAYIDDPCLATYPLMQKLRQVLVDHALVNGENEKDSKTSIFQKIATFEDELKSLLPKEVESARAAYESGNPAIPNKINECRSYPLYKFVREELGTELLTGEKTRSPGEEFDKLFTAICQGKIIDPLMECLGEWNGAPLPIC

SEQ ID NO: 8703 - protein, 723 aa, Pisum sativum
METVAAAITKNNGYESFCVTNAKNNNMKVNSADPLNWGVAAEAMKGSHLDEVKRMVEEYRKPVVRLGGETLTISQVAAIAAHDHGVKVELSESARAGVKASSDWVMESMNKGTDSYGVTTGFGATSHRRTKQGGALQKELIRFLNAGIFGNGTESSHTLPHTATRAAMLVRINTLLQGYSGIRFEILEAITKLINNNVTPCLLRGTITASGDLVPLSYIAGLLTGRPNSKAHGTSGEILNAKEAFQSAEINDGFFELQPKEGLALVNGTAVGSGLASIVLFEANILAVLSEVLSAIFAEVMQGKPEFTDHLTHKLKHHPGQIEAAAIMEHILDGSAYVKAAKKLHEMDPLQKPKQDRYALRTSPQWLGPLIEVIRFSTKSIEREINSVNDNPLIDVSRNKALHGGNFQGTPIGVSMDNTRLALASIGKLLFAQFSELVNDFYNNGLPSNLSASRNPSLDYGFKGSEIAMASYCSELQYLANPVTTHVQSAEQHNQDVNSLGLISSRKTYEAIEILQLMSSTFLIALCQAVDLRHLEENLKNSVKNIVSQVAKRTLTTGVNGELHPSRFCEKDLLRVVDREHVFAYIDDPCSATYPLMQKLRQVLVDHALVNGESEKNLNTSIFQKIATFEDELKTLLPKEVESTRAAYESGNPTVPNKINGCRSYPLYRFVRQELGTGLLTGEKVISPGEECDKLFTAICQGKIIDPLLQCLGDWNGAPLPIS

SEQ ID NO: 8704 - protein, 716 aa, Glycine max
MTQEGNGNTNFCMSVNNNGYISANDPLNWGAAAEAMAGSHLDEVKRMVEEYRRPVVKLGGETLTISQVAAIAAHDQGVKVELAESSRAGVKASSDWVMESMDKGTDSYGVTTGFGATSHRRTKQGGALQKELIRFLNAGIFGNGTESNCTLPHTATRAAMLVRINTLLQGYSGIRFEILEAITKLLNNNITPCLPLRGTITASGDLVPLSYIAGLLTGRPNSKAVGPSGEILNAKEAFELANISAEFFELQPKEGLALVNGTAVGSGLASIVLFEANIIAVLSEVISAIFAEVMQGKPEFTDHLTHKLKHHPGQIEAAAIMEHILEGSSYIKAAKKLHEIDPLQKPKQDRYALRTSPQWLGPQIEVIRFSTKSIEREINSVNDNPLIDVSRNKALHGGNFQGTPIGVSMDNTRLALASIGKLMFAQFSELVNDYYNNGLPSNLTASRNPSLDYGFKGAEIAMASYCSELQYLANPVTSHVQSAEQHNQDVNSLGLISSRKTHEAIEILKLMSSTFLIALCQAIDLRHLEENLKNTVKNVVSQVAKRTLTTGVNGELHPSRFCEKDLLKVVDREYTFAYIDDPCSGTYPLMQKLRQVLVDYALANGENEKNTNTSIFQKIATFEEELKTLLPKEVEGARVAYENDQCAIPNKIKECRSYPLYKFVREELGTALLTGERVVSPGEECDKVFTAMCQGKIIDPLLECLGEWNGAPLPIC

SEQ ID NO: 8705 - protein, 717 aa, Glycine max
MASEANAANTNFCVNVSNNGYISANDPLNWGAAAEAMAGSHLDEVKRMLEEYRRPVVKLGGETLTISQVAAIAAHDQGVKVELAESSRAGVKASSDWVMESMNKGTDSYGVTTGFGATSHRRTKQGAALQKELIRFLNAGIFGNGTESNCTLPHTATRAAMLVRINTLLQGYSGIRFEILEAITKLLNNNITPCLPLRGTITASGDLVPLSYIAGLLTGRPNSKAVGPSGEILNAKEAFELANIGAEFFELQPKEGLALVNGTAVGSGLASIVLFEANIIAVLSEVISAIFAEVMQGKPEFTDHLTHKLKHHPGQIEAAAIMEHILEGSSYVKAAKKLHEIDPLQKPKQDRYALRTSPQWLGPLIEVIRFSTKSIEREINSVNDNPLIDVSRNKALHGGNFQGTPIGVSMDNTRLALASIGKLMFAQFSELVNDYYNNGLPSNLTASRNPSLDYGFKGAEIAMASYCSELQYLANPVTSHVQSAEQHNQDVNSLGLISSRKTHEAIEILKLMSSTFLVALCQAIDLRHLEENLKNTVKNVVSQVAKRTLTTGVNGELHPSRFCEKDLLKVVDREYTFAYIDDPCSGTYPLMQKLRQVLVDYALANGENEKNTNTSIFQKIATFEEELKTLLPKEVEGARVAYENDQCAIPNKIKECRSYPLYKFVREELGTALLTGERVISPGEECDKVFTALCQGKIIDPLLECLGEWNGAPLPIC

SEQ ID NO: 8706 - protein, 722 aa, Brassica napus
MEVNGLSHGGEVDAMLCGGEIKKNATVVGADPLNWGAAAEQMKGSHLDEVKRMVKEFRRPVVNLGGETLTIGQVAAISTLGNGVKVELSETARAGVKASSDWVMESMGKGTDSYGVTTGFGATSHRRTKNGVALQKELIRFLNAGIFGSTKETSHTLPHSATRAAMLVRINTLLQGYSGIRFEILEAITSFLNNNITPSLPLRGTITASGDLVPLSYIAGLLTGRPNSKATGPNGEALNAEEAFKMAGVTSGFFDLQPKESLALVNGTAVGSGMASMVLFEANVLSVLAEVLSAVFAEVMSGKPEFTDHLTHRLKHHPGQIEAAAIMEHILDGSSYMKLAQKLHEMDPLQKPKQDRYALRTSPQWLGPQIEVIRYATKSIEREINSVNDNPLIDVSRNKAIHGGNFQGTPIGVSMDNTRLAIAAIGKLMFAQFSELVNDYYNNGLPSNLTASRNPSLDYGFKGAEIAMASYCSELQYLANPVTSHVQSAEQHNQDVNSLGLISSRKTSEAVDILKLMSTTFLVGICQAIDLRHLEENLKQTVKNTVSQVAKKVLTTGVNGELHPSRFCEKDLLKVVDREQVYTYADDPCSATYPLIQKLRQVIVDHALVNGESEKNAMTSIFHKIGAFEEELKAVLPKEVEAARAAYDNGTAAIPNRIKECRSYPLYRFVREELGTELLTGEKATSPGEEFDKVFTAICEGKIIDPLMECLDEWNGAPIPIC

SEQ ID NO: 8707 - protein, 722 aa, Tropaeolum majus
MENMMKKTQNGSLESLCENNQNGGGVIGCDPLNWGLAAEGLKGSHLEEVKRMVAEFRKPVVKLGGENLTIAQVAAVAYGDDRGVTVELSESARDGVKASSEWVMDSMNKGTDSYGVTTGFGATSHRRTKQGGALQKELIRFLNAGIFGNGTETSHTLPHSATRAAMLVRINTLLQGYSGIRFEILEAITKLLNNKITPCLPLRGTITASGDLVPLSYIAGLLTGRPNSKATGPNGEALDAREAFRVAGIGSEFFELQPKEGLALVNGTAVGSGLASMVLFEANVLSVLSEVMSAIFAEVMNGKPEFTDHLTHKLKHHPGQIEAAAIMEHILDGSGYVKAAEKLHEMDPLQKPKQDRYALRTSPQWLGPLIEVIRYSTKSIEREINSVNDNPLIDVSRNKALHGGNFQGTPIGVSMDNTRLAIASIGKLMFAQFSELVNDFYNNGLPSNLSGGRNPSLDYGFKGAEIAMASYCSELQYLANPVTTHVQSAEQHNQDVNSLGLISSRKTAEAVDILKLMSTTYLVALCQAIDLRHLEENLRNTVKTVVSQVAKKVLTVGANGELHPSRFCEKDLLQVIYREHVFTYIDDPCLATYPLMQKLRQVLVDHALKNDENEKNANTSIFQKIGAFEEEVKTLLPKEVERTRVAMECDNPIVSNRIIECRSYPLYRFVREELGTRLLTGEKVSSPGEVFDKVFNAICEGKIIDPMLECLKEWNGAPLPIC

SEQ ID NO: 8708 - protein, 619 aa, Phaseolus coccineus
MESMDKGTDSYGVTTGFGATSHRRTKQGGALQKELIRFLNAGIFGNGTESNCTLPHTATRAAMLVRVNTLLQGYSGIRFEILEAITKLLNNNITPCLPLRGTITASGDLVPLSYIAGLLTGRPNSKAVGPSGEILNAKEAFELANIGSEFFELQPKEGLALVNGTAVGSGLASIVLFEANILAVLSEVISAIFAEVMQGKPEFTDHLTHKLKHHPGQIEAAAIMEHILDGSSYIKAAKKLHEIDPLQKPKQDRYALRTSPQWLGPQIEVIRFSTKSIEREINSVNDNPLIDVSRNQALHGGNFQGTPIGVSMDNTRLAIASIGKLMFAQFSELVNDYYNNGLPSNLTASRNPSLDYGFKGAEIAMASYCSELQYLANPVTSHVQSAEQHNQDVNSLGLISSRKTNEAIEILKLMSSTFLVALCQAIDLRHLEENLKNTVKNVVSQVAKRTLTTGVNGELHPSRFCEKDLLKVVEREYTFAYIDDPCSGTYPLMQKLRQVLVDYALANGENEKNLNTSIFQKIASFEEELKTLLPKEVEGARLAYENDQCAIPNKIKDCRSYPLYKFVREELGTSLLTGEKVISPGEECDKVFSAMCQGKIIDPLLECLGEWNGAPLPIC

SEQ ID NO: 8709 - protein, 709 aa, Castanea mollissima
MEYCNGNGSSVDSCKSSDPLNWGLAAEGLKGSHLDEVKRMVDEFRKPLVRLGGKSLTVAQVAAIASHDGGIKVELAEEARAGVKASSDWVMDSMDKGKDSYGVTTGFGATSHRRTKQGGALQRELIRFLNAGIFGNGTESCHTLPHTATRAAMLVRINTLLQGYSGIRFEIMEAITKFLNHNITPCLPLRGTISSSGDLVPLSYIAGLLIGRPNSKAVGPNGESLDATKAFELAGIDGGFFELQPKEGLALVNGTAVGSGLASMVLFEANVQAVFAEVLSAIFAEVMQGKPEFTDHLTHKLKHHPGQIEAAAIMEHILDGSAYVKAAQKLHEIDPLQKPKQDRYALRTSPQWLGPQIEVIRTATKMIEREINSVNDNPLIDVARNKALHGGNFQGTPIGVSMDNTRLAIASVGKLMFAQFSELVNDFYNNGLPSNLTASRNPSLDYGFKGSEIAMASYCSELQYLANPVTNHVQSAEQHNQDVNSLGLISSRKTAEAVDILKLMSTNFLVALCQAVDLRHMEENLKNTVKNTVSQVAKRVLTMGSNGELHPSRFCEKDLLKVVDREYVFTYIDDPCSATYPLMQKLRQVLVEHALNNGDKESNLSTSIFQKIGAFEEELKTLLPKEVEGARIEIENGKAAIPNPIKECRSYPLYRFVREELGTSLLTGERIRSPGEEFDKVFSAMCAGKLIDPLLDCLKEWNGAPLPIN

SEQ ID NO: 8710 - protein, 699 aa, Triphysaria pusilla
RAATEGGGGPAELGGGGGGAFWQPPRGGEADGGGVPEAGGEARRGDADDIAGGGDRGRDNAVAVELAESARAGVKASSDWVMESMNKGTDSYGVTTGFGATSHRRTKQGGALQKELIRFLNAGIFGIGTESNHTLPHTATRAAMLVRINTLLQGYSGIRFEILEAITKFLNQNITPILPLRGTITASGDLVPLSYIAGLLTGRPNSKAVGPTGEPLNAEQAFKLAGITNFFELQPKEGLALVNGTAVGSGLAAIALYDANILAVLSVVMSAIFAEVMNGKPEFTDHLTHRLKHHPGQIEAAAIMEHILDGSSYVKAAQKLHETDPLQKPKQDRYALRTSPQWLGPQIEVIRTATKMIEREINSVNDNPLIDVSRNKAIHGGNFQGTPIGVSMDNTRLAIASIGKLMFAQFSELVNDFYNNGLPSNLSGGRNPSLDYGFKGSEIAMASYCSELQFLANPVTNHVQSAEQHNQDVNSLGLISSRKTVEAIDILKLMSSTYLIALCQAVDLRHVEENMRLAVKNAVCQVAKKTLTMGVNGELHPARFCEKDLLRVVDREYVFAYIDDPCSGTYPLMQKLRQVLVEHALKNKEGEKNEGSSIFQKIEAFEEELKAVLPKEVESARAALEAGKAAIGNRIVECRSYPLYKFVREELGTDYLTGEKAVSPGEECEKVFEALCKGSIVDPLLKCLEAWNGEPLPIC

SEQ ID NO: 8711 - protein, 717 aa, Coffea canephora
MECANGNGNDLAETFCTQRAGPAPDPLNWNAAAESLKGSHLDEVKRMVDEFRRPLVRLGGETLTIAQVAAVAASSDAAVKVELSEGARAGVKASSDWVMESMRKGTDSYGITTGFGATSHRRTKQGGALQEELIRFLNAGIFGNGTETCHTLPHSATRASMLVRINTLLQGYSGIRFEILEAITKLLNNNITPCLPLRGTITASGDLVPLSYIVGLLTGRPNSKAVGPDGKFVNATEAFSLAGIDTGFFELQAKEGLALVNGTAVGSALASMVLFEANILAVLAEVLSGIFAEVMHGKPEFTDHLTHKLKHHPGQIEAAAIMEHILDGSSFVKEAQRVHEFDPLQKPKQDRYALRTSPQWLGPLIEVIRASTKSIEREINSVNDNPLIDVSRNKALHGGNFQGTPIGVSMDNTRLAIASIGKLMFAQFSELVNDFYNNGLPSNLSGGRNPSLDYGFKGAEIAMAAYCSELQFLANPVTNHVQSAEQHNQDVNSLGLISSRKTAEAVDILKLMSSTYLVALCQAIDLRHLEENLKASVKNTVSLVAKKVLTMGYNGELHPSRFCEKDLLKVVDREHVFAYIDDPCSGTYPLMQKLRQVLVEHSLANGDKEKDATTSIFQKIGAFEDELKALLPKEVESARCELENGKPGIANRIKDCRSYSLYKFVRGELGTNFLTGEKVRSPGEEFDKVFTAICEGKLIDPLLDCLKEWNGAPRPIC

SEQ ID NO: 8712 - protein, 715 aa, Tropaeolum majus
MMNGRQNGCLENFCEKKSVGVDPLNWGLAAEGLKGSHLEEVMKMVGEYRKGVVNLGGENLTIAQVASVAYSEVGVGVKVELSESARAGVKASSDWVMDSMNKGTDSYGVTTGFGATSHRRTKQGGALQKELIRFLNAGIFGSATETSHTLPHSATRAAMLVRINTLLQGYSGIRFNILEAITKFLNSNITPCLPLRGTITASGDLVPLSYIAGLLTGRPNSKATGPDGKTLDAQEAFRLAGIDSGFFELQPKEGLALVNGTAVGSGLASMVLFDANILSVLAEVLSAIFAEVMNGKPEFTDHLTHKLKHHPGQIEAAAIMEHILDGSDYVKAAKKLHENDPLQKPKQDRYALRTSPQWLGPLIEVIRYSTKSIEREINSVNDNPLIDVSRNKALHGGNFQGTPIGVSMDNTRLAIASIGKLMFAQFSELVNDFYNNGLPSNLSGGRNPSLDYGFKGAEIAMASYCSELQYLANPVTSHVQSAEQHNQDVNSLGLISSRKTAEAIDILKLMSTTYLVALCQAIDLRHLEENLRNTVKNVVSQVAKKVLTTGPNGELHPSRFCEKDLLKVVDYEHVFTYIDDPCLATYPLMQKLRQIMVDHALNNGEKEKNATTAIFQKIKLFEEELKTLLPKEVENARISLENGKPLIPNRITQCRSYPLYKFVREDVATGLLTGEKVTSPGEEFDKVFDAICQGKIIDPLLNCLKEWNGAPLPIS

SEQ ID NO: 8713 - protein, 709 aa, Solanum lycopersicum
MEYVNGNSNGDQVFCVKAQQQQDPLNWNVSADALKGSHLDAVKKMVEEYRKPVVRLGGETLTVAQVAAIAAQSGKDVTVQLSEAARAGVKASSDWVMEGMRNGTDSYGVTTGFGATSHRRTKQGAALQKELIRFLNAGVFGKGTESCHTLPHSATRAAMLVRINTLLQGYSGIRFEILEAITKLLNNNITPCLPLRGTITASGDLVPLSYIAGLLTGRPNSKATGPNGELLDAINAFQQAGIESGFFELQPKEGLALVNGTAVGSGLASMVLFEANILAILSEVLSAIFAEVMQGKPEFTDHLTHKLKHHPGQIEAAAIMEHILDGSSYVKEAKKIHEMDPLQKPKQDRYALRTSPQWLGPQIEVIRSSTKMIEREINSVNDNPLIDVSRNKALHGGNFQGTPIGVSMDNTRLALASIGKLLFAQFSELVNDYYNNGLPSNLTGGRNPSLDYGFKGAEIAMASYCSELQFLANPVTNHVQSAEQHNQDVNSLGLISSRKTEEAVDILKLMSSTYLVALCQAIDLRHLEENLKATVKSAVSLAAKKVLITGQNGELHQSRFCEKDLLTMVDREYVFAYADDPCSANYPLMQKLRQVLVDHALKNSNTEIFQKISAFEEELKLVLPKEIESVRCDLENGKAPIGNRIQECRSYPLYKFVREELGAKYLTGEKALSPGEVFDKVFTAMNEGKLIDPLLNCLKEWNGAPLPLC

SEQ ID NO: 8714 - protein, 719 aa, Brassica napus
MEINGSSYKVDAMLCGGETKNVTVAAADPLNWGAAADQMKGSHLDEVKRMVMEFRKPVVNLGGETLTIGQVAAISTVGNGVKVELSETARAGVKASSDWVMESMGKGTDSYGVTTGFGATSHRRTKNGVALQKELIRFLNAGIFGSTKETCHTLPHSATRAAMLVRINTLLQGYSGIRFEILEAITSFLNTNITPSLPLRGTITASGDLVPLSYIAGLLTGRPNSKATGPNGEALNAEEAFKKAGIPSGFFDLQPKEGLALVNGTAVGSGMASMVLFETNVLSVLAEVLSAVFAEVMSGKPEFTDHLTHRLKHHPGQIEAAAIMEHILDGSSYMKLAQKLHEMDPLQKPKQDRYALRTSPQWLGPQIEVIRYATKSIEREINSVNDNPLIDVSRNKAIHGGNFQGTPIGVSMDNTRLAIASIGKLMFAQFSELVNDFYNNGLPSNLTASRNPSLDYGFKGAEIAMASYCSELQYLANPVTTHVQSAEQHNQDVNSLGLISSRKTAEAVDILKLMSTTFLVAICQAVDLRHLEENLKQTVKNTVSQVAKKVLTTGVNGELHPSRFCEKDLLKVVDREQVYTYADDPCSATYPLIQKLRQVIVDHALVNGESEKNAMTSIFHKIGAFEEELKAVLPDEVEAARVAYDNGTSAIPNRIKECRSYPLYRFVREELGTELLTGEKVTSPGEEFDKVFTAICEGKIIDPLMECLSEWNGAPIPIC

SEQ ID NO: 8715 - protein, 712 aa, Cucumis sativus
MAPIDQTNDDSSFCTNTTHPDPLNWGLAADSLKGSHLDEVKRMVQEYRRPLVKLGGETLTISQVAAIATRDTDVIVELSESARAGVKASSDWVMESMNKGTDSYGVTTGFGATSHRRTKQGGALQKELIRFLNAGIFGSGAESDHTLPHSATRAAMLVRINTLLQGYSGIRFEILEAITKLLNNNITPCLPLRGTITASGDLVPLSYIAGLLTGRPNSKAIGPNGESLDAKEAFQQAGIPSGFFELQPKEGLALVNGTAVGSGLASIVLFEANILAVLSEILSAIFAEVMQGKPEFTDHLTHKLKHHPGQIEAAAIMEHILDGSSYMKTAKKLHEMDPLQKPKQDRYALRTSPQWLGPLIEVIRFSTKSIEREINSVNDNPLIDVSRNKALHGGNFQGTPIGVSMDNTRLAIASIGKLLFAQFSELVNDFYNNGLPSNLSASRNPSLDYGFKGAEIAMASYCSELQYLANPVTSHVQSAEQHNQDVNSLGLISSRKTAEAVDILKLMSSTFLVALCQAIDLRHLEENLKNVVKSTVSQVAKKVLTTGVNGALHPSRFCEKDLLKVVDREYTFAYVDDACSATYPLMQKLRQVLVEHALENGEDEKNTNTSIFQKIGAFEEELKAILPKEVENARLSYENGTSTIENQIKECRSYPLYKFVREELRTGLLTGEKVISPGEECEKVFTALCQGKMIDPILECLKEWNGAPIPIC

SEQ ID NO: 8716 - protein, 724 aa, Pisum sativum
MEAIGAAITKNNSGYDSFCLTNAKNNNIKVSDSDPLNWGVAAEAMKGSHLDEVKRMVDEYRKPVVRLGGETLTISQVAAIAAHDHGVKVELSESARAGVKASSDWVMESMNKGTDSYGVTTVHGATSHRRTKQGGALQKELIRFLNAGIFGNGSESTHTLPHTATRAAMLVRINTLLQGYSGIRFEILEAITKLINNNVTPCLLRGTITASGDLVPLSYIAGLLTGRPNSKAHGPSGEILNAREAFQSAGINDGFFELQPKEGLALVNGTAVGSGLASIVLFEANILAVLSEVLSAIFAEVMQGKPEFTDHLTHKLKHHPGQIEAAAIMEHILDGSAYVKAAKKLHEMDPLQKPKQDRYALRTSPQWLGPLIEVIRFSTKSIEREINSVNDNPLIDVSRNKALHGGNFQGTPIGVSMDNTRLALASIGKLLFAQFSELVNDFYNNGLPSNLSASRNPSLDYGFKGSEIAMASYCSELQYLANPVTTHVQSAEQHNQDVNSLGLISSRKTYEAIEILQLMSSTFLIALCQAIDLRHLEENLKNSVKNMVSHVAKRTLTTGINGELHPSRFCEKDLLRVVDREHVFSYIDDPCSATYPLMQKLRQVLVDHALVNGESEKNLNTSIFQKIATFEDELKTLLPKEVESARGAYENGNTTISNKIKECRSYPLYKFVREELGTSLLTGEKVISPGEECDKLFTAICQGKIIDPLLECLGDWNGAPLPIS

SEQ ID NO: 8717 - protein, 717 aa, Cucumis sativus
MAPAQLEQFAHQNGSMESFCTSHVVDPLNWGVAAEALKGSHLDEVKRMVDEYRRPVVKLGGETLTISQVAAIATRDNDVVVKLAESARAGVKASSDWVMESMNKGTDSYGVTTGFGATSHRRTKQGGALQKELIRFLNAGIFGNGAESNHTLPHSATRAAMLVRINTLLQGYSGIRFEILEAITNLLNENVTPCLPLRGTITASGDLVPLSYIAGLLTGRPNSKAIGPNGETLDAEAAFKQAGIPSSFFELQPKEGLALVNGTAVGSGLASIVLFEANILAVLSEILSAIFAEVMQGKPEFTDHLTHKLKHHPGQIEAAAIMEHILDGSSYMKAAKKLHEIDPLQKPKQDRYALRTSPQWLGPLIEVIRFSTKSIEREINSVNDNPLIDVSRNKALHGGNFQGTPIGVSMDNTRLAIASIGKLMFAQFSELVNDFYNNGLPSNLSASRNPSLDYGFKGAEIAMASYCSELQYLANPVTSHVQSAEQHNQDVNSLGLISSRKTAEAIDILKLMSSTFLVALCQAIDLRHLEENLKSTVKSVVSQVAKKVLTTSSIGTLHPSRFCEKDLLKVVDREYTFAYIDDPCSATYPLMQKLRQVLVDHALTNGENEKNMNTSIFQKITAFEEELKVALPKEVENTRLAYESGNSKVANQIKDCRSYPLYKFVREDLGAKLLTGERVISPGEECEKVFTALCQGKMIDSILECLKEWNGAPIPIC

SEQ ID NO: 8718 - protein, 703 aa, Lotus japonicus
CTAANGTATATDPLSWGVAAESMKGSHLNEVKRMVAEYRKPVVKLGGETLTIAQVAAIAANEQGVSVELCESARAGVKASSDWVMNSMNNGTDSYGVTTGFGATSHRRTKNGNALQLELIRFLNAGIFGNGTESTHTLPQPATRAAMLVRINTLLQGYSGIRFEILEAITKLINNNITPCLPLRGTVTASGDLVPLSYIAGLLTGRPNSKAVGPSGEVLNAKNAFQLAGIDSGFFELQPKEGLALVNGTAVGSGLASIVLFDANVLAILAEVLSAIFAEVMQGKPEFTDHLTHKLKHHPGQIEAAAIMEHILDGSSYMKAAKKLHEVDPLQKPKQDRYALRTSPQWLGPLIEVIRFSTKSIEREINSVNDNPLIDVSRNKALHGGNFQGTPIGVSMDNTRLALAAIGKLMFAQFTELVDDHYNNGLPSNLTASRNPSLDYGLKGAEIAMASYCSELQYLANPVTTHVQSAEQHNQDVNSLGLISSRKTNEAIEILKLMSSTFLIALCQAIDLRHLEENLKYSVKSTVSQVVKRTLTTGVNGELHPSRFCEKDLLKVVDRETLFSYIDDPCSATYPLMQKLRQVLVDHALVNGENEKDSKTSIFQKIATFEDELKSLLPKEVESARAAYESGNPTIPNKINECRSYPLYKFVREELGTELLTGEKTRSPGEECDKLFTAICQGKIIDPLLECLGEWNGAPLPIC

SEQ ID NO: 8719 - protein, 689 aa, Quercus alba
NWGLAAEGLKGSHLDEVKRMVDEFRKPLVKPGGKSLTIAQVAAIASQDGAIKVELSEEARAGVKASSDWVMDSMDKGKDSYGVTTGFGATSHRRTKQGGALQRELIRFLNAGIFGNGTESCHTLPHTATRAAMLVRINTLLQGYSGIRFEIMEAITKFLNHNITPCLPLRGTITASGDLVPLSYIAGLLTGRPNSKAVGPNGESLDATKAFELAGIDGGFFELQPKEGLALVNGTAVGSGLASMVLFEANIQAVFAEVLSAIFAEVMQGKPEFTDHLTHKLKHHPGQIEAAAIMEHILDGSAYIKAAQKLHEVDPLQKPKQDRYALRTSPQWLGPQIEVIRTANKMIEREINSVNDNPLIDVARNKALHGGNFQGTPIGVSMDNTRLAIASVGKLMFAQFSELVNDFYNNGLPSNLTASRNPSLDYGFKGAEIAMASYCSELQFLANPVTNHVQSAEQHNQDVNSLGLISSRKTAEAVDILKLMSTTFLVALCQAVDLRHMEENLKNTVKNTVSQVAKRVLTMGSNGELHPSRFCEKDLLKVVDREYVFAYIDDPCSATYPLMQKLRQVLVEHALNNGDKETNLSTSIFQKIGAFEEELKTLLPKEVEGARIEIENGKAAIPNPIKECRSYPLYRFVREELGTSLLTGERIRSPGEEFDKVFSAMCAGKLIDPLLDCLKEWNGAPLPIN

SEQ ID NO: 8720 - protein, 707 aa, Solanum phureja
MEYVNGNSNGTHDDQVFCVKDPLNWNMSADALRGSHLDEVKKMVEEYRKPVVRLGGETLTVAQVAAIAAQSGTDVTVQLSEAARAGVKASSDWVMEGMRNGTDSYGVTTGFGATSHRRTKQGAALQKELIRFLNAGVFGNGTESCHMLPHSTTRAAMLVRINTLLQGYSGIRFEILEAITKLLNNNITPCLPLRGTITASGDLVPLSYIAGLLTGRTNSKATGPNGELLDAVNAFQRAGIESGFFELQPKEGLALVNGTAVGSGLASMVLFEANILAILSEVLSAIFAEVMQGKPEFTDHLTHKLKHHPGQIEAAAIMEHILDGSSYVKEAKKIHEMDPLQKPKQDRYALRTSPQWLGPQIEVIRSSTKMIEREINSVNDNPLIDVSRNKALHGGNFQGTPIGVSMDNTRLALASIGKLLFAQFSELVNDYYNNGLPSNLTGGRNPSLDYGFKGAEIAMASYCSELQFLANPVTNHVQSAEQHNQDVNSLGLISSRKTEEAVDILKLMSSTYLVALCQAIDLRHLEENLKATVKSAVSLAAKKVLITGQNGELHQSRFCEKDLLKMVDREYVFSYADDPCSANYPLMQKLRQVLVDHALKNSNTEIFQKISAFEEELKLVLPKEIESIRCDLENGKAPIGNRIQECRSYPLYKFVREELGAKYLTGENVLSPGEVFDKVFTAMNEGKLIDPLLNCLKEWNGAPLPLR

SEQ ID NO: 8721 - protein, 710 aa, Glycine max
LSNGNANGSLNLCNGSTDPLNWGMAAEALKGSHLDEVKRMVEDYRNPVVKLGGKSLTVSQVAAVATRHHGGVTVELAKETRHGVKASSDWVMDSMVKGTDSYGVTTGFGATSHRRTKQGAALQNELIRFLNAGIFGNGTESCHTLPHSATRAAMLVRINTLLQGYSGIRFEIMEAISKFLNHNITPCLPLRGTITASGDLVPLSYVAGLLIGRPNSKSIGPNGQVLNAKEAFQLAGIDGGFFELQPKEGLALVNGTAVGSGLASVVLFEANLLVILSEVLSAIFAEVMQGKPEFTDHLTHKLKHHPGQIEAAAIMEHILDGSSYCKAARKLHEIDPLQKPKQDRYALRTSPQWLGPQIEVIRHATKMIEREINSVNDNPLIDVSRNKALHGGNFQGTPIGVSMDNTRLAIASIGKLMFAQFSELVNDFYNNGLPSNLTASRNPSLDYGFKGAEIAMASYCSELQYLANPVTNHVQSAEQHNQDVNSLGLVSSRKTAEAIDILKLMSSTFLVALCQAIDLRHLEENLKNTVRNTVSQVAKRVLTVGINGELHPSRFCEKDLLKIVDREYVYAYIDDPCSATYPLMQKLRLVLVDHALQNGDKEVNSSTSIFQKIGAFEEELNALLPKEVESSRIEVENGNPAIPNRIKECRSYPLYKFVRENLGTTLLTGEKVKSPGEEFDKVFTALCEGKLIDPLLDCLKEWKGAPLPIC

SEQ ID NO: 8722 - protein, 716 aa, Ricinus communis
MEMSDGETNEDAYSSGLCPKDPLKWGIAAEALKGSHLDEVKKMVREYRNPVVRLGGETLTIGQVAAVAVGAGAAGNRVAVELCESARAGVKASSDWVMESMEKGTDSYGVTTGFGATSHRRTKQGAALQKELIRFLNAGILGHGTESSHILPQSATRAAMLVRINTLLQGYSGIRFEILEAITKLINHNITPCLPLRGSITASGDLLPFSYIAGFLTGRPNSIALGPNGGSLDAGEAFRLAGIDAGFFELQPKEGLALVNGTGVGAGLASIVLFEANILALLSEVVSAIFAEVMQGKPEFTDHLTHKLKHHPGQIEAAAIMEHILDGSSYVKQAKKLHEMDPLQKPKQDRYALRTSPQWLGPQIEVIRSSTKSIEREINSVNDNPLIDVSRNKALHGGNFQGTPIGVSMDNTRLALASIGKLMFAQFSELVNDFYNNGLPSNLTGGRNPSLDYGFKGAEIAMAAYCSELQYLANPVTNHVQSAEQHNQDVNSLGLISSRKTAEAVDILKLMSSTFLVALCQAIDLRHLEENLKSAVKNTVSQVARTVLTIGINGELHPSRFCEKDLLRVVNREHVFAYIDEPCSSTYPLMQKLRQVLVDHALINNDDTNNVNASIFLKIGAFEEELKAVLPKEVEAARNAFESGNPEIPNRIRESRSYPLYKFVREDLGTEILTGEKIKSPGEEFDKLFRAMCEGKIVDPLLECLKNWDGMPLPIC

SEQ ID NO: 8723 - protein, 725 aa, Trifolium pratense
MEAVAAAITKNNINDYDSFCLTHANANNMKVNGADPLNWGVAAEAMKGSHLDEVKRMVEEYRKPVVRLGGETLTISQVAAIAAHDGATVELSESARAGVKASSDWVMESMNKGTDSYGVTTGFGATSHRRTKQGGALQKELIRFLNAGIFGNGTESNHILPHTATRAAMLVRINTLLQGYSGIRFEILEAITKLLNNNITPCLPLRGTITASGDLVPLSYIAGLLTGRPNSKAHGPSGEILNAKEAFQLAGINADFFELQPKEGLALVNGTAVGSGLASIVLFEANILAVLSEVLSAIFAEVMQGKPEFTDHLTHKLKHHPGQIEAAAIMEHILDGSAYVKAAKKLHEIDPLQKPKQDRYALRTSPQWLGPLIEVIRFSTKSIEREINSVNDNPLIDVSRNKALHGGNFQGTPIGVSMDNTRLALASIGKLMFAQFSELVNDFYNNGLPSNLSASRNPSLDYGFKGSEIAMASYCSELQYLANPVTTHVQSAEQHNQDVNSLGLISSRKTKEAIEILQLMSSTFLIALCQAIDLRHLEENLKNSVKNTVSQVAKKTLTIGVNGELHPSRFCEKDLLKVVDREHVFSYIDDPCSATYPLSQKLRQVLVEHALVNGESEKNSNTSIFQKIATFEEELKTLLPKEVESARTAYESGNSTIANKINGCRSYPLYKFVREELGTSLLTGERVISPGEECDKLFTAMCQGKIIDPLLECLGEWNGAPLPIC

SEQ ID NO: 8724 - protein, 714 aa, Cucumis sativus
MAELGHQNGVEFCIGGRNNINNDPLNWGAAAESLKGSHLEEVKRMVEEYRRPVVKLGGETLTISQVAAIASRDSGVVVELSESARGGVEASSKWVMDSMNQGTDSYGVTTGFGATSHRRTKEGGALQRELIRFLNAGVFGNGTESSHTLPHLATRAAMLVRINTLLQGYSGIRFEILEAITKLLNHNVTPCLPLRGTITASGDLVPLSYIAGLLTGRSNSKAIGPNGESLDAKEAFKQASIPSGFFELQPKEGLALVNGTAVGSGLASIVLFEANILAVLAEIMSAIFAEVMQGKPEFTDHLTHKLKHHPGQIEAAAIMEHILDGSSYMKTAKKLHEMDPLQKPKQDRYALRTSPQWLGPLIEVIRFSTKSIEREINSVNDNPLIDVSRNKALHGGNFQGTPIGVSMDNTRLAIASIGKLIFAQFSELVNDFYNNGLPSNLSASRNPSLDYGLKGTEIAMASYCSELQYLANPVTSHVQSAEQHNQDVNSLGLISSRKTEEAIDILKLMSSTFLVALCQAIDLRHLEENLKSTVKNTVSQVAKKILTTGANGALHPSRFCEKDLLKVVDREYIFAYIDDPCSATYPLMQKLRQVLVEHALSNGEDEKNANSSIFQKIHVFEEELKVVLPKEVESARFAYENGNSTVQNQIKKCRSYPLYKFIRKELGTELLTGEKAKSPGEVCEKVFIALCQGKMIDPILECLKEWNGAPIPIC

SEQ ID NO: 8725 - protein, 725 aa, Arabidopsis thaliana
MEINGAHKSNGGGVDAMLCGGDIKTKNMVINAEDPLNWGAAAEQMKGSHLDEVKRMVAEFRKPVVNLGGETLTIGQVAAISTIGNSVKVELSETARAGVNASSDWVMESMNKGTDSYGVTTGFGATSHRRTKNGVALQKELIRFLNAGIFGSTKETSHTLPHSATRAAMLVRINTLLQGFSGIRFEILEAITSFLNNNITPSLPLRGTITASGDLVPLSYIAGLLTGRPNSKATGPNGEALTAEEAFKLAGISSGFFDLQPKEGLALVNGTAVGSGMASMVLFETNVLSVLAEILSAVFAEVMSGKPEFTDHLTHRLKHHPGQIEAAAIMEHILDGSSYMKLAQKLHEMDPLQKPKQDRYALRTSPQWLGPQIEVIRYATKSIEREINSVNDNPLIDVSRNKAIHGGNFQGTPIGVSMDNTRLAIAAIGKLMFAQFSELVNDFYNNGLPSNLTASRNPSLDYGFKGAEIAMASYCSELQYLANPVTSHVQSAEQHNQDVNSLGLISSRKTSEAVDILKLMSTTFLVAICQAVDLRHLEENLRQTVKNTVSQVAKKVLTTGVNGELHPSRFCEKDLLKVVDREQVYTYADDPCSATYPLIQKLRQVIVDHALINGESEKNAVTSIFHKIGAFEEELKAVLPKEVEAARAAYDNGTSAIPNRIKECRSYPLYRFVREELGTELLTGEKVTSPGEEFDKVFTAICEGKIIDPMMECLNEWNGAPIPIC

SEQ ID NO: 8726 - protein, 717 aa, Vitis vinifera
MEFSHHNGNGNGKVDANGFCMKAADPLYWAAAAETLKGSHLEEVKRMVADFRKPVVRLGGESLNIAQVAAVAATGSDGVTVELSESARAGVQASSNWVMESMNQGTDSYGVTTGFGATSHRRTKQGNALQKELIRFLNAGIFGKGTESCHTLPHSATRAAMLVRINTLLQGYSGIRFEILEATVKLLNANISPCLPLRGTISASGDLVPLSYIAGLLTGRPNSRAVGPNGESLNAEEAFRLAGIDGGFFELQPKEGLALVNGTAVGSGLASTVLFEANILAVLSEVLSAIFAEVMQGKPEFTDHLTHKLKHHPGQIEAAAIMEHILDGSAYVKAAQMLHEIDPLQKPKQDRYALRTSPQWLGPQIEVIRTSTKSIEREINSVNDNPLIDVSRNKALHGGNFQGTPIGVSMDNTRLAIASIGKLMFAQFSELVNDFYNNGLPSNLSGGRNPSLDYGFKGAEIAMAAYCSELQFLANPVTNHVQSAEQHNQDVNSLGLISSRKTEEAIDILKLMSSTYLVALCQAIDLRHLEENLKNTVKNTVSQVAKKVLAIGINGELHPSRFCEKDLLKVVDREHVFAYIDDPCSATYPLMQNLRQVLVDHALMNNEDLRNSSTSIFLKIGAFEEELKTLLPKDVESTRIAFDNGNLAIPNRIKECRSYPLYKFVREESGTEFLTGEKVTSPGEEFDKVFSAICEGKIIDPLLKCLNDWDGTPLPIC

SEQ ID NO: 8727 - protein, 719 aa, Cucumis sativus
IQIQLYMAQKVCANQNGSVETLCNTHQDPLNWGLAADSMKGSHLDEVKRMVEEYRRPLVKLGGQTLTISQVAAIATRDNDVLVELAESARAGVKASSDWVMESMGKGTDSYGVTTGFGATSHRRTNQGGALQKELIRFLNSGIFGNGSESNHTLPHSATRAAMLVRINTLLQGYSGIRFEILEAITNLLNHNVTPCLPLRGTITASGDLVPLSYIAGLLTGRHNSKAIGPNGETLDAKAAFTQAGIDSGFFELQPKEGLALVNGTAVGSGLASIVLFEANILAVLSEILSAIFAEVMQGKPEFTDHLTHKLKHHPGQIEAAAIMEHILDGSSYMKTAKKLHEMDPLQKPKQDRYALRTSPQWLGPLIEVIRFSTKSIEREINSVNDNPLIDVSRNKALHGGNFQGTPIGVSMDNTRLAVASIGKLMFAQFSELVNDFYNNGLPSNLSASRNPSLDYGFKGAEIAMASYCSELQYLANPVTSHVQSAEQHNQDVNSLGLISSRKTAEAIDILKLMSSTFLVALCQAIDLRHLEENLKSVVKSTVSQVAKKVLTTSSNGALHPSRFCEKDLLKVVDREYTFAYIDDPCSATYPLMQKLRQILVEHALKNGDSETNENTSIFQKIGAFEEELKAILPKEVENVRLAYENGNSEIENQIKDCRSYPLYKFVREELGTRLLTGEKVISPGEECEKVFTALSQGKMIDSIFECLKEWNGAPLPIC

SEQ ID NO: 8728 - protein, 725 aa, Arabidopsis lyrata
MEINGEHKANGGSIDAMLCGGDIKTKNMVINAEDPLNWGAAAEQMKGSHLDEVKRMVVEFRKPVVNLGGETLTIGQVAAISTIGNGVKVELSETARAGVNASSDWVMESMNKGTDSYGVTTGFGATSHRRTKNGVALQKELIRFLNAGIFGSTKETSHTLPHSATRAAMLVRINTLLQGFSGIRFEILEAITSFLNNNITPSLPLRGTITASGDLVPLSYIAGILTGRPNSKATGPNGEALTAEEAFKLAGISSGFFDLQPKEGLALVNGTAVGSGMASMVLFETNVLSVLAEILSAVFAEVMSGKPEFTDHLTHRLKHHPGQIEAAAIMEHILDGSSYMKLAQKLHEMDPLQKPKQDRYALRTSPQWLGPQIEVIRYATKSIEREINSVNDNPLIDVSRNKAIHGGNFQGTPIGVSMDNTRLAIAAIGKLMFAQFSELVNDFYNNGLPSNLTASRNPSLDYGFKGAEIAMASYCSELQYLANPVTSHVQSAEQHNQDVNSLGLISSRKTSEAVDILKLMSTTFLVAICQAVDLRHLEENLKQTVKNTVSQVAKKVLTTGVNGELHPSRFCEKDLLKVVDREQVYTYADDPCSATYPLIQKLRQVIVDHALINGESEKNAVTSIFHKIGAFEEELKAVLPKEVEAARAAYDNGTSAIPNRIKECRSYPLYRFVREELGTELLTGEKVTSPGEEFDKVFTAICEGKIIDPMMECLNEWNGAPIPIC

SEQ ID NO: 8729 - protein, 714 aa, Citrus sinensis
  misc_feature (101)..(101): Xaa can be any naturally occurring amino acid
  misc_feature (108)..(108): Xaa can be any naturally occurring amino acid
  misc_feature (164)..(164): Xaa can be any naturally occurring amino acid
  misc_feature (448)..(448): Xaa can be any naturally occurring amino acid
  misc_feature (589)..(589): Xaa can be any naturally occurring amino acid
MEASHENQSGGNIPSGKLCTNIDPLNWVSASESLKGSHLDEVKRMVSEYRKPVVRLGGETLTIAQVAAVASRDDGVTVELNEEARAGVKASSDWVMESMNXGTDSYGXTTGFGATSHRRTKQGAALQKELIRFLNAGIFGKGTESCHMLPHTATRAAMLVRINXLLQGYSGIRFEILEAITKFLNRNITPCLPLRASITASGDLVPFSYIAGLLTGRPNSVAVGPNGESLNAAEAFSQAGIDGGFFELQPKEGLALVNGTGVGAGLASIVLFEANILTVLSEVLSAIFAEAMQGKPEFTDHLTHKLKHHPGQIEAAAIMEHILDGSSYVEAAQKFHEIDPLQKPKQDRYALRTSPQWLGPQAEVIRASTKSIEREINSVNDNPLIDVSRNKALHGGNFQGTPIGVSMDNSRLAIASIGKLMFAQFSELVNDFYSNGLPSNLSGGRNPXLDYGFKGAEIAMAAYCSELQFLANPVTNHVQSAEQHNQDVNSLGLISARKTAEAVDILKLMSSTYLIALCQAIDLRHLEENLKSTVKNTISQVAKKVLTMGVNGELHPSRFCEKDLLKVVDREYVFSYADDPCSATYPLMXKLRQVLVDHALTNNEDLKNANASIFLKIGAFEEELKTLLPKEVESARSAFESGNLEIPNRIKECRSYPLYRFVREELGARYLTGEKAISPGEECDKVFTAICQGKIIDPLLECLKEWDGSPLPIC

SEQ ID NO: 8730 - protein, 136 aa, Lotus japonicus
MAPTTNSNHESLNSSIFCTAAKAGSDPLSWGVAADSMKGSHLDEVKRMVAEYRKPVVKLGGETLTIAQVAAIAANDQGVSVELCESARAGVKASSDWVMNSMNNGTDSYGVTTGFGATSHRRTKNGNALQLELISC

SEQ ID NO: 8731 - protein, 724 aa, Brassica napus
MDQINGSVHQNGKTEAMLLCGGLEKTKVTVAADPLNWGAAAEQMKGSHLDEVKRMVEDYRKPVVNLGGETLTIGQVAAISNVGGGVKVELAEASRAGVKASSDWVMESMGKGTDSYGVTTGFGATSHRRTKNGTALQTELIRFLNAGIFGNTKETCHTLPESATRAAMLVRVNTLLQGYSGIRFEILEAITSLLNHNISPSLPLRGTITASGDLVPLSYIAGLLTGRPNSKATGPNGESLTAEEAFKKAGITSGFFDLQPKEGLALVNGTAVGSGMASMVLFEANVQSVLAEVLSAIFAEVMSGKPEFTDHLTHRLKHHPGQIEAAAIMEHILDGSSYMKLAAKLHEMDPLQKPKQDRYALRTSPQWLGPQIEVIRHATKSIEREINSVNDNPLIDVSRNKAIHGGNFQGTPIGVSMDNTRLAVAAIGKLMFAQFSELVNDFYNNGLPSNLTASNNPSLDYGFKGAEIAMASYCSELQYLANPVTTHVQSAEQHNQDVNSLGLISSRKTSEAVDILKLMSTTFLVAICQAVDLRHLEENLRQTVKNTVSQVAKKVLTTGVNGELHPSRFCEKDLLKVVDREQVFTYVDDPCSATYPLMQKLRQVIVDHALSNGETEKNAVTSIFQKIGAFEEELKMVLPKEVDATREAYGNGTAAIPNRIKECRSYPLYKFVREELGTKLLTGEKVVSPGEEFDKVFTAMCEGKIIDPLMDCLKEWNGAPIPIC

SEQ ID NO: 8732 - protein, 723 aa, Brassica napus
MDQTNGSVHQNGKIEAMLCGGVEKTKVAVAADPLNWGAAAEQMKGSHLDELKRMVEEYRRPVVNLGGETLTIGQVAAISTAGGGVKVELAEASRAGVKASSDWVMESMGKGTDSYGVTTGFGATSHRRTKNGTALQTELIRFLNAGIFGNTKETCHTLPESATRAAMLVRVNTLLQGYSGIRFEILEAITSFLNHNISPSLPLRGTITASGDLVPLSYIAGLLTGRPNSKATGPNGESLTAEEAFKQAGIASGFFDLQPKEGLALVNGTAVGSGMASMVLFEANVQSVLAEVLSAIFAEVMSGKPEFTDHLTHRLKHHPGQIEAAAIMEHILDGSSYMKLAQKLHEMDPLQKPKQDRYALRTSPQWLGPQIEVIRHATKSIEREINSVNDNPLIDVSRNKAIHGGNFQGTPIGVSMDNTRLAIASIGKLMFAQFSELVNDFYNNGLPSNLTASNNPSLDYGFKGAEVAMASYCSELQYLANPVTSHVQSAEQHNQDVNSLGLISSRKTSEAVDILKLMSATFLVAICQAVDLRHLEENLRQTVKNTVSQVAKKVLTTGVYGELHPSRFCEKDLLKVVDREQVFTYVDDPCSATYPLMQKLRQVIVDHALSNGETEKNAVTSIFQKIGAFEEELKMVLPKEVDAAREAYGNGTAAIPNRIKECRSYPLYKFVREELGTKLLTGEKVVSPGEEFDKVFTAMCEGKIIDPLMECLKEWNGAPIPIC

SEQ ID NO: 8733 - protein, 710 aa, Gossypium hirsutum
  misc_feature (508)..(508): Xaa can be any naturally occurring amino acid
  misc_feature (515)..(515): Xaa can be any naturally occurring amino acid
  misc_feature (524)..(524): Xaa can be any naturally occurring amino acid
  misc_feature (526)..(526): Xaa can be any naturally occurring amino acid
  misc_feature (528)..(528): Xaa can be any naturally occurring amino acid
  misc_feature (562)..(562): Xaa can be any naturally occurring amino acid
MEPMELQFCNGGNGSSLADPLNWAASAQSMKGSHLDEVKRMVEEYKKPVVRLGGETLTIAQVTAIANRDVAVQVELSEAARPAVKASSDWVMEGMNRGTDSYGVTTGFGATSHRRTKQGGALQKELIRFLNAGVFGQGTESCHSLPHTATRAAMLVRINTLLQGYSGIRFEILEAITKLLNVNITPCVPLRGSITASGDLVPLSYIAGLLTGRPNSKALGPNGETLNPTEAFSKAGINGGFFELQPKEGLAMVNGTAVGSGLASLVLFEANVLAVLSEVLSAIFAEVMQGKPEFTDHLTHKLKHHPGQIEAAAIMEHILSGSSYIKAAQKLHELDPLQKPKQDRYALRTSPQWLGPQIETIRFATKMIEREINSVNDNPLIDVSRDKALHGGNFQGTPIGVSMDNTRLAIAAIGKLMFAQFSELVNDYYNNGLPSNLSASRNPSLDYGFKGAEIAMASYCSELQYLGNPVTNHVQSAEQHNQDVNSLGLISARKTAEAIDILKLMSSXFLVALCXAIDLRHLEXNXKXTVKNTVSQVAKRVLTMGSNGELHPSRFCEKDLLXVVDREYLYAYADDPCSANYPLIQKLRQVLVDHALMNGDREKDSTTSIFQKIGVFEEELKTQLPKEVESARTEFENGSPAIANKIEECRSYPLYKFVREVLGTHLLTGEKVISPGEECDKVFTAMCAGKLIDPLLDCLKDWNGAPLPIC

SEQ ID NO: 8734 - protein, 706 aa, Camellia sinensis
MEFCHENGNGNGHVIKDPLSWELAADSMKGSHLDEVKRMVREFRQPAIRLGGETLTISQVAAVAAGCLPVELSEAARAAVQASSEWVMESMNKGTDSYGVTTGFGATSHRRTKQGGALQKELIRFLNAGIFGNGTESCHTLPHSSTRAAMLVRINTLLQGYSGIRFEILEALTKLINHNITPCLPLRGTITASGDLVPLSYIAGVLTGRPNSKCVGPTGEPLDATEAFRRAGIDGGFFELQPKEGLALVNGTAVGSGLASIVLFDANVLAVLSVVLSAIFAEVMQGKPEFTDHLTHKLKHHPGQIEAAAIMEHVLDGSSYVKAAQKLHEMDPLQKPKQDRYALRTSPQWLGPLIEVIRSSTKSIEREINSVNDNPLIDVSRNKALHGGNFQGTPIGVSMDNTRLALASIGKLMFAQFSELVNDFYNNGLPSNLSGGRNPSLDYGFKGAEIAMAAYCSELQFLANPVTNHVQSAEQHNQDVNSLGLISSRKTAEAIDILKLMSSTYLVGLCQAIDLRYLEENLKNTVRNTVSQVAKKVLTMGINGELHPSRFCEKDLIKVVDREHIFTYIDDPCSATYPLMQKLRQVLVDHALINNDDTKNMNASIFLKIGAFEEELKTQLPKEVECTRSALESGNPTIPNRIKDCRSYPLYKFVREELGTGFLTGEKIVSPGEEFDKVFTAICNGKMIDPLLECLKEWNGALLPIC

SEQ ID NO: 8735 - protein, 325 aa, Brachypodium distachyon
MAVRGTRRERDAEAELNLPPGFRFHPTDDELVEHYLCRKAAGGRLPVPIIAEVDLYKFDPWALPDRALFGTKEWYFFTPRDRKYPNGSRPNRAAGNGYWKATGADKPVAPHGRTLGIKKALVFYAGKAPKGVKTDWIMHEYRLADAGRAAAAGAKKGSLRLDDWVLCRLYNKKNEWEKMQMQQQLVGAKEATKQESSDMVITSHSNNNNNSQQSHSWGEARTPESEIVDHDDPSSFPAAFQSPAAQEMLATMMVPKKEAADDAGAGAGRNDLFVDLSYDDIQSMYSGLDMMPPGDDLLYSTLFASPRVRGTNQAGAGVGGMPGPF

SEQ ID NO: 8736 - protein, 161 aa, Phaseolus coccineus
  misc_feature (23)..(23): Xaa can be any naturally occurring amino acid
  misc_feature (38)..(38): Xaa can be any naturally occurring amino acid
DVGCASQPESREWGRAEPARFLXWAREQDRYLPIANIXRIMKKGLPPNGKIAKDAKDTMQEASEKCQKEKRKTINGDDLLWAMATLGFEDYIEPLKVYLARYREAEGDTKGSARGGDGSARPDQVGLAGQNSQLVHQGSLNYISLQVQPQHMVLPSIQSHE

SEQ ID NO: 8737 - DNA, 277 bp, Artificial Sequence
  NOS terminator
gagctcgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattc

SEQ ID NO: 8738 - DNA, 2322 bp, Artificial Sequence
  Arabidopsis derived At6669 promoter
aagctttaagctccaagcccacatctatgcacttcaacatatctttttctagatgagttggtaaaagtagaaaaagatatgatgattttaaatttgtttctatttatatgtgttcatcgaaacttcattttttttagttttaatagagagtttatatgacttttaaaaattgatttaaaactgtgtcaaaaattaaaaggacaataaaaaatttgcatacaaccgaaaatacttatatttagacaagaaaaaataatacttgtgatgctgattttattttattatatatcatgaatcatgatcatccaattttccggataagccaaagtcaaaatgatgggttccccctaatcttttatgctgagaaatagatgtatattcttagatagtaatataaaattgggttaaagaatgatgattcgattatagcctcaactagaagatacgtgtagtgcaggtgtgtagttaactggtggtagtggcagacaaccagattaggagttaaataaagcctttagatttgagagattgaaatattcgattggaacctttctagatttttacagccatctaaaattagatgcagatcacctactaccattcaaaaatgaacaaaataatttcatttacattttcctagcataagatataataataaaatagtgctcattttaattactttttctaaatattttcgttattttaaattttgcttgtctatactctacagctcatttaataacggaaacaaaaataattgcagggatacggatgggtagctttcaaaacttacatcatcttctgtttcttgagatcaactatttttggagctttgtctcaatcgtaccaaaggataatggtcctacctccttttgcattcttaactttatcttctctacttatttcttttttgggatttttgggggtattattttatcttttgtagatatacacattgatttactacaaacgtatactactatccatcttcaactcttcggaatatgatttcgaaaaaactatgaagattaacgggtatcttaaacatgttaagatacaccggacaattttcatttagaagaattgatatgcaattaacaataaatagttgatgatcttttagttttgaagatgtgcgttaagacttaagcgtgtggtaacaaggtgggactcgggcaacgcaaagccttgtagagtccacttgctcaacttgtctttcttttatctcttttccaagtctcaagattcaatgaactccgtgtaacacaaacacgcccatagatgagctcatttttggtatttccaatattgccactccatgataatatcatctagggatggggttcatttattttgaaatctcaacaaatctcgtcgattctaacacacatgattgatttgtttacttacttgaaagttggcaactatctgggattaaaatttatctttttctactgctagctagaagcatctatatatgttagcctaatacgtggaagatgtcattgctaataatggctaaagatgtgtattaatttttcttcttttttccttgaatttttgttctttgacataaactatgctgtcaaaatgtgtagaatctttttacataaatcattccctgttacacactaaaaggttcacaacggacgattgtattggacttccagatcataaaccatgcaaaactgaaaaccacaagaataattagttctaactttagaacgttcgtacgtgtttcatgttcaaaaagcgtcaattataaaagttgggaaattacttttgagttttgacatttctaaggacagtcaaatatgacaacattgggatgcaacttaccttgtattaacttattttgttataaaaccatatattacatattttaaagggttgataaataatcaaatataccaaaacatagcttttcaatatatttgtaaaacacgtttggtctactagctaattatgagaacatttgttcaatgcatgattatctagtatctactagtggattatgaaaattagatattttcattgcatgattatcttccatatatagtgataacatcaaaagaatctacaccaattattgcattttttcattatataataagcactaaactgtaaaattatattcagccacccaaaccatgacaaatcaccttaaaggcttaaacacataacagccattacgagtcacaggtaagggtataatagtaaagaatcaatctatataatatacgacccaccctttctcattctttctggagagtaacatcgagacaaagaagaaaaactaaaaaagagaaccccaaaggatcc

SEQ ID NO: 8739 - DNA, 877 bp, Artificial Sequence
  Cauliflower mosaic virus 35S promoter
aagcttgcatgcctgcaggtccccagattagccttttcaatttcagaaagaatgctaacccacagatggttagagaggcttacgcagcaggtctcatcaagacgatctacccgagcaataatctccaggaaatcaaataccttcccaagaaggttaaagatgcagtcaaaagattcaggactaactgcatcaagaacacagagaaagatatatttctcaagatcagaagtactattccagtatggacgattcaaggcttgcttcacaaaccaaggcaagtaatagagattggagtctctaaaaaggtagttcccactgaatcaaaggccatggagtcaaagattcaaatagaggacctaacagaactcgccgtaaagactggcgaacagttcatacagagtctcttacgactcaatgacaagaagaaaatcttcgtcaacatggtggagcacgacacacttgtctactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagagaacacgggggactctagaggatcc

SEQ ID NO: 8740 - DNA, 1127 bp, Artificial Sequence
  Napin promoter
attgattcctttaaagacttatgtttcttatcttgcttctgaggcaagtattcagttaccagttaccacttatattctggactttctgactgcatcctcatttttccaacattttaaatttcactattggctgaatgcttcttctttgaggaagaaacaattcagatggcagaaatgtatcaaccaatgcatatatacaaatgtacctcttgttctcaaaacatctatcggatggttccatttgctttgtcatccaattagtgactactttatattattcactcctctttattactattttcatgcgaggttgccatgtacattatatttgtaaggattgacgctattgagcgtttttcttcaattttctttattttagacatgggtatgaaatgtgtgttagagttgggttgaatgagatatacgttcaagtgaagtggcataccgttgtcgagtaaggatgacctacccattcttgagacaaatgttacattttagtatcagagtaaaatgtgtacctataactcaaattcgattgacatgtatccattcaacataaaattaaaccagcctgcacctgcatccacatttcaagtattttcaaaccgttcggctcctatccaccgggtgtaacaagacggattccgaatttggaagattttgactcaaattcccaatttatattgaccgtgactaaatcaactttaacttctataattctgattaagctcccaatttatattcccaacggcactacctccaaaatttatagactctcatccccttttaaaccaacttagtaaacgctcttttttttaattttatgaagttaagtttttaccttgtttttaaaaagaatcgttcataagatgccatgccagaacattagctacacgttacacatagcatgcagccgcggagaattgtttttcttcgccacttgtcactcccttcaaacacctaagagcttctctctcacagcacacacatacaatcacatgcgtgcatgcattattacacgtgatcgccatgcaaatctcctttatagtctataaattaactcatccgcttcactctttactcaaaccaaaactcatcaatacaaacaagattaaaaacatacaccc

SEQ ID NO: 8741 - DNA, 2318 bp, Artificial Sequence
  Arabidopsis derived new At6669 promoter
aagctttaagctccaagcccacatctatgcacttcaacatatctttttctagatgagttggtaaaagtagaaaaagatatgatgattttaaatttgtttctatttatatgtgttcatcgaaacttcattttttttagttttaatagagagtttatatgacttttaaaaattgatttaaaactgtgtcaaaaattaaaaggacaataaaaaatttgcatacaaccgaaaatacttatatttagacaagaaaaaataatacttgtgatgctaattttattttattatatatcatgaatcatgatcatccaattttccggataagccaaagtcaaaatgatgggttccccctaatcttttatgctgagaaatagatgtatattcttagatagtaatataaaattgggttaaagaatgatgattcgattatagcctcaactagaagatacgtgtagtgcaggtgtgtagttaactggtggtagtggcggacaaccagattaggagttaaataaagcctttagatttgagagattgaaatattcgattggaacctttctagatttttacagccatctaaaattagatgcagatcacctactaccattcaaaaatgaacaaaataatttcatttacattttcctagcataagatataataataaaatagtgctcattttaattactttttctaaatattttcgttattttaaattttgcttgtctatactctacagctcatttaataacggaaacaaaaataattgcagggatacggatgggtagctttcaaaacttacatcatcttctgtttcttgagatcaactatttttggagctttgtctcaatcgtaccaaaggataatggtcctactcccttttgcattcttaactttatcttctctacttatttcttttttgggatttttgggggtattattttatcttttgtagatatacacattgatttactataaacgtatactactatccatcttcaactcttcggaatatgatttcgaaaaaactatgaagattaacgggtatcttaaacatgttaagatacaccggacaattttcatttagaagaattgatatgcaattaacaataaatagttgatgatcttttagttttgaagatgtgcgttaagacttaagcgtgtggtaacaaggtgggactcgggcaacgcaaagccttgtagagtccacttgctcaacttgtctttcttttatctcttttccaagtctcaagattcaatgaactccgtgtaacacaaacacgcccatagatgagctcatttttggtatttccaatattgccactccatgataatatcatctagggatggggttcatttattttgaaatctcaacaaatctcgtcgattctaacacacatgattgatttgtttacttacttgaaagttggcaactatctgggattaaaatttatctttttctactgctagctagaagcatctatatatgttagcctaatacgtggaagatgtcattgctaataatggctaaagatgtgtattaatttttcttcttttttccttgaatttttgttctttgacataaactatgctgtcaaaatgtgtagaatctttttacataaatcattccctgttacacactaaaaggttcacaacggacgattgtattggacttccagatcataaaccatgcaaaactgaaaaccacaagaataattagttctaactttagaacgttcgtacgtgtttcatgttcaaaaagcgtcaattataaaagttgggaaattacttttgagttttgacatttctaaggacagtcaaatatgacaacattgggatgcaacttaccttgtattaacttattttgttataaaaccatatattacatattttaaagggttgataaataatcaaatataccaaaacatagcttttcaatatatttgtaaaacacgtttggtctactagctaattatgagaacatttgttcaatgcatgattatctagtatctactagtggattatgaaaattagatattttcattgcatgattatcttccatatatagtgataacatcaaaagaatctacaccaattattgcattttttcattatataataagcactaaactgtaaaattatattcagccacccaaaccatgacaaatcaccttaaaggcttaaacacataacagccattacgagtcacaggtaagggtataatagtaaagaatcaatctatataatatacgacccaccctttctcattctttctggagagtaacatcgagacaaagaagaaagactaaaaaagagaaccccaaaga

SEQ ID NO: 8742 - DNA, 1096 bp, Artificial Sequence
  RootP promoter
tcagatgaagaaggcggcttttgcacgatttcataatggctacgtatttggcagataaagttattgtgtatgaaggagaaccttccgtggattgcacggcatcttctcctcagtctctacgtagtggaatgaatttgttcttgtctcgtttgaacatcactttcagacgagatcctacgaatttcagaccaagaatcaataaactcgattcgatgaaggatagtgaccagaagcttgcgggatgttattactacttggatgattaagagagagatgacattgagagaatctttcaccggagaaaacctgaagtagtgagaaactcacgttttgatctttcctagccccttcaatctattataagatctcttgaattttattagatccatctggagtttaatttttgagaatatattatggtgtttgaattcggtttgtttcaatcgttcccatatattagactagtttttttcttcacacatgagaatctcaaaccgattgcgtagaagaagaactcgcattcatctgtttttgtctttagttgagaatgaatgaccgttgtaatgtcatgggcttcttttggtttgggtctgaatcacttaagcccaacacaatctcttcttaggttgaaacactgttgtttttgctgttttgtctgacacaaggcatcggatgatgtcgattgtcgaatatgcttcctcattcggagtgttctcagacatcttgagcttctcattagttaggcggtgcgctcgaaagtcgaagccgtgttgacatatcaaaacattgggaccattcaattttgtacaaatgtccaaacattatttcggtttgataacaataaacaaataaagaaagagttttttattggattcacttggcaacagccaacaacgaatcaaataatctatatacataattatattagaagctgtgaatgtgcctccgagtagacaaaagcacatgcaccataaatgatcaaacccatgaaacttccatctctctttttcccctatataaactaatgtcacttacctcaatattccatcaacaatatacatctgagatatcaaaactcctagagagatctaataaa

SEQ ID NO: 8743 - DNA, 30 bp, Artificial Sequence
  Fwd External LAB101_EF_SalI
aaagtcgacgtgaacaccaggaggaagaag

SEQ ID NO: 8744 - DNA, 31 bp, Artificial Sequence
  Rev External LAB101_ER_XbaI
aaatctagatacgacgaccaaactcagacac

SEQ ID NO: 8745 - DNA, 28 bp, Artificial Sequence
  Fwd External LAB106_EF_BamHI
ataggatcctattgctttgcttgctcgc

SEQ ID NO: 8746 - DNA, 31 bp, Artificial Sequence
  Rev External LAB106_ER_KpnI
aaaggtacctcccaattagtacacacccgtc

SEQ ID NO: 8747 - DNA, 27 bp, Artificial Sequence
  Fwd Nested LAB107_NF_SalI
atagtcgacgattccttccgcctcatc

SEQ ID NO: 8748 - DNA, 32 bp, Artificial Sequence
  Rev Nested  LAB107_NR_SacI
aatgagctctcaaacacacttccaagaggcac

SEQ ID NO: 8749 - DNA, 29 bp, Artificial Sequence
  Fwd Nested LAB108_NF_SmaI
ttacccggggacgaggctctgcttctcag

SEQ ID NO: 8750 - DNA, 34 bp, Artificial Sequence
  Rev Nested  LAB108_NR_KpnI
taaggtacctcaggactggatgaagtgtcaagag

SEQ ID NO: 8751 - DNA, 26 bp, Artificial Sequence
  Fwd External LAB109_EF_BamHI
aaaggatccggctccgatcgaagctg

SEQ ID NO: 8752 - DNA, 32 bp, Artificial Sequence
  Rev External LAB109_ER_XhoI
tttctcgagcactaatccacagtccagagacg

SEQ ID NO: 8753 - DNA, 31 bp, Artificial Sequence
  Fwd Nested LAB110_NF_XhoI
tttctcgaggctgtgggtgatgttctggtac

SEQ ID NO: 8754 - DNA, 35 bp, Artificial Sequence
  Fwd External LAB110_EF_XhoI
tttctcgaggaacttggaagatattcttctcagcc

SEQ ID NO: 8755 - DNA, 33 bp, Artificial Sequence
  Rev Nested  LAB110_NR_SacI
aaagagctccctgtcgtgtatgctactctctcc

SEQ ID NO: 8756 - DNA, 33 bp, Artificial Sequence
  Rev External LAB110_ER_SacI
aaagagctcccttacacacatcgaagatcacac

SEQ ID NO: 8757 - DNA, 31 bp, Artificial Sequence
  Fwd Nested LAB113_NF_BamHI
aaaggatccttccttccttccaacttgtgtc

SEQ ID NO: 8758 - DNA, 33 bp, Artificial Sequence
  Fwd External LAB113_EF_BamHI
aaaggatccccacattcacatgaaatgtaaacc

SEQ ID NO: 8759 - DNA, 31 bp, Artificial Sequence
  Rev Nested  LAB113_NR_XhoI
aaactcgagctgactttgcattcattcaacc

SEQ ID NO: 8760 - DNA, 31 bp, Artificial Sequence
  Rev External LAB113_ER_XhoI
aaactcgagaggagctggttgattcactgac

SEQ ID NO: 8761 - DNA, 34 bp, Artificial Sequence
  Fwd External LAB115_EF_SalI
tttgtcgactgaatttgttttctctctgctatgg

SEQ ID NO: 8762 - DNA, 36 bp, Artificial Sequence
  Rev External LAB115_R_XbaI
ttatctagatcatcttgacatagattaagcacccac

SEQ ID NO: 8763 - DNA, 29 bp, Artificial Sequence
  Fwd External LAB117_EF_BamHI
aaaggatcccaccacagtttccctcgttc

SEQ ID NO: 8764 - DNA, 34 bp, Artificial Sequence
  Rev External LAB117_ER_KpnI
aaaggtaccgtggaatgaatattgatttgacatg

SEQ ID NO: 8765 - DNA, 34 bp, Artificial Sequence
  Fwd Nested LAB119_NR_EcoRV
agcgatatcttatcatcttgagaagagcttggtg

SEQ ID NO: 8766 - DNA, 37 bp, Artificial Sequence
  Fwd External LAB119_ER_EcoRV
aaagatatctctgtggagttcattcatatatatgagg

SEQ ID NO: 8767 - DNA, 33 bp, Artificial Sequence
  Rev Nested  LAB119_F_XhoI , Rev External LAB119_F_XhoI
tttctcgagcatacaatataatggggcttaggg

SEQ ID NO: 8768 - DNA, 30 bp, Artificial Sequence
  Fwd External LAB120_EF_XhoI
aaactcgagagaagagacgcagcaacattc

SEQ ID NO: 8769 - DNA, 31 bp, Artificial Sequence
  Rev External LAB120_ER_SacI
aaagagctccactcccacactgtacacaagg

SEQ ID NO: 8770 - DNA, 35 bp, Artificial Sequence
  Fwd Nested LAB121_NF_BamHI
aaaggatccaaactgaaagcaagtaaacacagaaa

SEQ ID NO: 8771 - DNA, 34 bp, Artificial Sequence
  Fwd External LAB121_EF_BamHI
aaaggatcctccaatccttatctatcaaccatca

SEQ ID NO: 8772 - DNA, 31 bp, Artificial Sequence
  Rev Nested  LAB121_NR_XhoI
aaactcgagcagagccgattcgaagacttta

SEQ ID NO: 8773 - DNA, 31 bp, Artificial Sequence
  Rev External LAB121_ER_XhoI
aaactcgaggccattaggtgagaaacagagc

SEQ ID NO: 8774 - DNA, 31 bp, Artificial Sequence
  Fwd External LAB122_EF_SalI
aaagtcgacattcttctgagcatttgcatcc

SEQ ID NO: 8775 - DNA, 31 bp, Artificial Sequence
  Rev External LAB122_ER_XbaI
aaatctagagaactttcagccatttaggcac

SEQ ID NO: 8776 - DNA, 32 bp, Artificial Sequence
  Fwd External LAB123_EF_BamHI
aaaggatcctcaactgtcaactactgccacag

SEQ ID NO: 8777 - DNA, 31 bp, Artificial Sequence
  Rev External LAB123_ER_XhoI
aaactcgagtgtccagtagacaaaggcactg

SEQ ID NO: 8778 - DNA, 21 bp, Artificial Sequence
  Fwd Nested LAB124_F , Fwd External LAB124_F
gccacgccccttatacagatg

SEQ ID NO: 8779 - DNA, 31 bp, Artificial Sequence
  Rev Nested  LAB124_NR_XhoI
aatctcgagttcaaacgactaaacccaggtc

SEQ ID NO: 8780 - DNA, 31 bp, Artificial Sequence
  Rev External LAB124_ER_XhoI
aatctcgagggtcttacctgcccattattcc

SEQ ID NO: 8781 - DNA, 29 bp, Artificial Sequence
  Fwd External LAB125_EF_SalI
aaagtcgacagcctgcaaagcacatcaac

SEQ ID NO: 8782 - DNA, 35 bp, Artificial Sequence
  Rev External LAB125_ER_XbaI
aaatctagactatgagagaacaacaatagcacctg

SEQ ID NO: 8783 - DNA, 35 bp, Artificial Sequence
  Fwd External LAB126_F_SalI
aaagtcgactctaacacatttctcagcaaaaatgg

SEQ ID NO: 8784 - DNA, 33 bp, Artificial Sequence
  Rev External LAB126_ER_XbaI
aaatctagactcatacttgtgcttctagcttcg

SEQ ID NO: 8785 - DNA, 33 bp, Artificial Sequence
  Fwd External LAB127_F_BamHI
aaaggatcccccatatcacaagtgttcaatttc

SEQ ID NO: 8786 - DNA, 31 bp, Artificial Sequence
  Rev External LAB127_ER_XhoI
aaactcgagtacaactcctagggctcgtttg

SEQ ID NO: 8787 - DNA, 31 bp, Artificial Sequence
  Fwd Nested LAB128_NF_SalI
aaagtcgacatcggagttgaaaggcttgtag

SEQ ID NO: 8788 - DNA, 31 bp, Artificial Sequence
  Fwd External LAB128_EF_SalI
aaagtcgactacattattcggcatttgcagg

SEQ ID NO: 8789 - DNA, 31 bp, Artificial Sequence
  Rev Nested  LAB128_NR_XbaI
aaatctagacactcagaggtaccaccctagc

SEQ ID NO: 8790 - DNA, 31 bp, Artificial Sequence
  Rev External LAB128_ER_XbaI
aaatctagattaacatgccacagtccaactc

SEQ ID NO: 8791 - DNA, 32 bp, Artificial Sequence
  Fwd Nested LAB129_F_BamHI , Fwd External LAB129_F_BamHI
aaaggatccttcttcttcttcctcaacaatgg

SEQ ID NO: 8792 - DNA, 31 bp, Artificial Sequence
  Rev Nested  LAB129_NR_XhoI
aaactcgagaataaactgcagctttcccaac

SEQ ID NO: 8793 - DNA, 31 bp, Artificial Sequence
  Rev External LAB129_ER_XhoI
aaactcgagtccaatctcgaaatccatcatc

SEQ ID NO: 8794 - DNA, 31 bp, Artificial Sequence
  Fwd Nested LAB130_NF_SalI
aaagtcgacgggaacttcatggcatttgtag

SEQ ID NO: 8795 - DNA, 31 bp, Artificial Sequence
  Fwd External LAB130_EF_SalI
aaagtcgactgatggtccgttactcaaacac

SEQ ID NO: 8796 - DNA, 34 bp, Artificial Sequence
  Rev Nested  LAB130_NR_XbaI
aaatctagactattggacatcctcagctacttcc

SEQ ID NO: 8797 - DNA, 33 bp, Artificial Sequence
  Rev External LAB130_ER_XbaI
aaatctagagcattcacaatagacaaatgcaac

SEQ ID NO: 8798 - DNA, 31 bp, Artificial Sequence
  Fwd External LAB131_EF_BamHI
aaaggatcctactgccgtctaccgatttcac

SEQ ID NO: 8799 - DNA, 32 bp, Artificial Sequence
  Rev External LAB131_ER_KpnI
aaaggtaccggtttcctagccagatgacaaac

SEQ ID NO: 8800 - DNA, 33 bp, Artificial Sequence
  Fwd Nested LAB133_NF_BamHI
aaaggatccggagtccattgtaaggtcaatctc

SEQ ID NO: 8801 - DNA, 30 bp, Artificial Sequence
  Rev Nested  LAB133_NR_XhoI
aaactcgagttcttgggctggcataatctc

SEQ ID NO: 8802 - DNA, 31 bp, Artificial Sequence
  Fwd External LAB137_EF_XhoI
aaactcgaggctctcgtagctagggtttgag

SEQ ID NO: 8803 - DNA, 31 bp, Artificial Sequence
  Rev External LAB137_ER_EcoRV
aaagatatctggtcactatggctgaaacatc

SEQ ID NO: 8804 - DNA, 27 bp, Artificial Sequence
  Fwd Nested LAB138_NF1_SalI
aaagtcgacgccgctcttctccaagtc

SEQ ID NO: 8805 - DNA, 30 bp, Artificial Sequence
  Rev Nested  LAB138_NR1_XbaI
aaatctagacacacgacggaggaagtaagc

SEQ ID NO: 8806 - DNA, 31 bp, Artificial Sequence
  Fwd Nested LAB145_NF_BamHI
aaaggatccttcatcaccaactcgatcagac

SEQ ID NO: 8807 - DNA, 32 bp, Artificial Sequence
  Fwd External LAB145_EF_BamHI
aaaggatcccatcagcttctttcatcaccaac

SEQ ID NO: 8808 - DNA, 32 bp, Artificial Sequence
  Rev Nested  LAB145_NR_XhoI
aaactcgagcccaggattgatgatttacacac

SEQ ID NO: 8809 - DNA, 31 bp, Artificial Sequence
  Rev External LAB145_ER_XhoI
aaactcgaggggttgcaagaacaagtttgag

SEQ ID NO: 8810 - DNA, 28 bp, Artificial Sequence
  Fwd Nested LAB152_F_BamHI
aaaggatccatcaccgggacctagcatc

SEQ ID NO: 8811 - DNA, 34 bp, Artificial Sequence
  Rev Nested  LAB152_NR_XhoI
aaactcgagctacaaggagtacactgcaacatgg

SEQ ID NO: 8812 - DNA, 31 bp, Artificial Sequence
  Fwd Nested LAB153_NF_SalI
aaagtcgacatccgctagggtttatctgctc

SEQ ID NO: 8813 - DNA, 31 bp, Artificial Sequence
  Fwd External LAB153_EF_SalI
aaagtcgaccttgctgtcctctgtgctatcc

SEQ ID NO: 8814 - DNA, 31 bp, Artificial Sequence
  Rev Nested  LAB153_NR_BamHI
aaaggatccgtcagacaagacgaccaagaag

SEQ ID NO: 8815 - DNA, 31 bp, Artificial Sequence
  Rev External LAB153_ER_BamHI
aaaggatcctctgaatgctcgcttattgttg

SEQ ID NO: 8816 - DNA, 31 bp, Artificial Sequence
  Fwd Nested LAB154_NF_BamHI
aaaggatcccacgcacacagagagaattcag

SEQ ID NO: 8817 - DNA, 30 bp, Artificial Sequence
  Fwd External LAB154_EF_BamHI
aaaggatcccagccatctgcaaggtacaag

SEQ ID NO: 8818 - DNA, 31 bp, Artificial Sequence
  Rev Nested  LAB154_NR_KpnI
aaaggtaccaggtccaatctccaatcgctac

SEQ ID NO: 8819 - DNA, 31 bp, Artificial Sequence
  Rev External LAB154_ER_KpnI
aaaggtaccttattattcagggcattcccac

SEQ ID NO: 8820 - DNA, 30 bp, Artificial Sequence
  Fwd Nested LAB156_NF_SalI
aaagtcgacagaagctcttgggactcgaac

SEQ ID NO: 8821 - DNA, 29 bp, Artificial Sequence
  Fwd External LAB156_EF_SalI
aaagtcgacgagcacgaatccagaagctc

SEQ ID NO: 8822 - DNA, 32 bp, Artificial Sequence
  Rev Nested  LAB156_R_SacI , Rev External LAB156_R_SacI
aaagagctcctattcagctggagaatggtcag

SEQ ID NO: 8823 - DNA, 31 bp, Artificial Sequence
  Fwd External LAB157_EF_BamHI
aaaggatccttcgtttcgccaactataaagc

SEQ ID NO: 8824 - DNA, 31 bp, Artificial Sequence
  Rev External LAB157_ER_XhoI
aaactcgagtctgtgtgctctgttcttccag

SEQ ID NO: 8825 - DNA, 28 bp, Artificial Sequence
  Fwd Nested LAB158_EF_BamHI
aaaggatcccaaccccacagcagctagg

SEQ ID NO: 8826 - DNA, 34 bp, Artificial Sequence
  Rev Nested  LAB158_NR_XhoI
tttctcgagctagctctacgcatatcggtactcc

SEQ ID NO: 8827 - DNA, 31 bp, Artificial Sequence
  Fwd Nested LAB159_NF_BamHI
aaaggatcctacctagcttgaggacgacacg

SEQ ID NO: 8828 - DNA, 29 bp, Artificial Sequence
  Fwd External LAB159_EF_BamHI
aaaggatccgtacgttggcagttgcactc

SEQ ID NO: 8829 - DNA, 31 bp, Artificial Sequence
  Rev Nested  LAB159_NR_KpnI
aaaggtaccctgataggcatgagattcgttg

SEQ ID NO: 8830 - DNA, 31 bp, Artificial Sequence
  Rev External LAB159_ER_KpnI
aaaggtaccacgctgtaaagcaaaccgtaac

SEQ ID NO: 8831 - DNA, 31 bp, Artificial Sequence
  Fwd Nested LAB160_NF_BamHI
aaaggatccgaagcaatcaagcaatgacaag

SEQ ID NO: 8832 - DNA, 33 bp, Artificial Sequence
  Rev Nested  LAB160_NR_XhoI
aaactcgagcaagttcaaatgcataacaagcac

SEQ ID NO: 8833 - DNA, 28 bp, Artificial Sequence
  Fwd External LAB161_F_BamHI
aaaggatccaagaagcctcgcgaagaca

SEQ ID NO: 8834 - DNA, 31 bp, Artificial Sequence
  Rev External LAB161_ER_XhoI
aaactcgagcacatatccatgctgaatgacc

SEQ ID NO: 8835 - DNA, 27 bp, Artificial Sequence
  Fwd Nested LAB162_F_SalI
aaagtcgacatcgaagcatccgccttc

SEQ ID NO: 8836 - DNA, 34 bp, Artificial Sequence
  Rev Nested  LAB162_NR_XbaI
aaatctagactaggatgaatgatgaccaagttcc

SEQ ID NO: 8837 - DNA, 30 bp, Artificial Sequence
  Fwd External LAB163_EF_BamHI
aaaggatccggaggtgacagagtttggagc

SEQ ID NO: 8838 - DNA, 31 bp, Artificial Sequence
  Rev External LAB163_ER_XhoI
aaactcgagaaacaaggccagagtttcagtg

SEQ ID NO: 8839 - DNA, 31 bp, Artificial Sequence
  Fwd External LAB164_EF_XhoI
aaactcgagcaacctcgaagctagtccaaac

SEQ ID NO: 8840 - DNA, 31 bp, Artificial Sequence
  Rev External LAB164_ER_EcoRV
aaagatatccaatacaataccagggcactcc

SEQ ID NO: 8841 - DNA, 26 bp, Artificial Sequence
  Fwd Nested LAB165_NF_SalI
aaagtcgaccactcgctccaaccgtc

SEQ ID NO: 8842 - DNA, 26 bp, Artificial Sequence
  Fwd External LAB165_EF_SalI
aaagtcgaccatccggatcatctgcg

SEQ ID NO: 8843 - DNA, 36 bp, Artificial Sequence
  Rev Nested  LAB165_R_XbaI , Rev External LAB165_R_XbaI
aaatctagatcaataaattcagctaggaacatcatt

SEQ ID NO: 8844 - DNA, 26 bp, Artificial Sequence
  Fwd External LAB166_F_EcoRV
tttgatatcagcttcgcgatgcagca

SEQ ID NO: 8845 - DNA, 27 bp, Artificial Sequence
  Rev External LAB166_ER_XhoI
aaactcgaggcagtcaggcaggcagag

SEQ ID NO: 8846 - DNA, 32 bp, Artificial Sequence
  Fwd External LAB167_EF_BamHI
aaaggatccgaagcaagatagcaataagcacc

SEQ ID NO: 8847 - DNA, 31 bp, Artificial Sequence
  Rev External LAB167_ER_XhoI
aaactcgagattcagttctggagcaaggaag

SEQ ID NO: 8848 - DNA, 31 bp, Artificial Sequence
  Fwd Nested LAB169_NF_BamHI
aaaggatccctcctctacagcaacttccacc

SEQ ID NO: 8849 - DNA, 30 bp, Artificial Sequence
  Fwd External LAB169_EF_BamHI
aaaggatccaaccaaagcacatggacagac

SEQ ID NO: 8850 - DNA, 31 bp, Artificial Sequence
  Rev Nested  LAB169_NR_XhoI
aaactcgagaaagatcagcagctccagtgtc

SEQ ID NO: 8851 - DNA, 31 bp, Artificial Sequence
  Rev External LAB169_ER_XhoI
aaactcgaggattaattccagccgtatgcac

SEQ ID NO: 8852 - DNA, 28 bp, Artificial Sequence
  Fwd Nested LAB170_NF_SalI
aaagtcgacgagccacttagcgagggag

SEQ ID NO: 8853 - DNA, 27 bp, Artificial Sequence
  Fwd External LAB170_EF_SalI
aaagtcgaccacaggcaaacgcaacac

SEQ ID NO: 8854 - DNA, 31 bp, Artificial Sequence
  Rev Nested  LAB170_NR_XbaI
aaatctagattacgacacctgtctttgttgc

SEQ ID NO: 8855 - DNA, 31 bp, Artificial Sequence
  Rev External LAB170_ER_XbaI
aaatctagaccgcagagagagtatcagttcc

SEQ ID NO: 8856 - DNA, 29 bp, Artificial Sequence
  Fwd External LAB171_EF_BamHI
aaaggatccaaaggcagagtggagcacac

SEQ ID NO: 8857 - DNA, 31 bp, Artificial Sequence
  Rev External LAB171_ER_XhoI
aaactcgagagcatcacctggaacaggatag

SEQ ID NO: 8858 - DNA, 28 bp, Artificial Sequence
  Fwd Nested LAB172_NF_BamHI
aaaggatccgtcgatcgggtctcatctg

SEQ ID NO: 8859 - DNA, 31 bp, Artificial Sequence
  Rev Nested  LAB172_NR_XhoI
aaactcgagagctgcatttggtctaacatcc

SEQ ID NO: 8860 - DNA, 29 bp, Artificial Sequence
  Fwd Nested LAB175_NF_StuI
aaaaggcctatcgaagcatagcagccaag

SEQ ID NO: 8861 - DNA, 28 bp, Artificial Sequence
  Fwd External LAB175_EF_StuI
aaaaggcctcgtccattcacatcgaagc

SEQ ID NO: 8862 - DNA, 31 bp, Artificial Sequence
  Rev Nested  LAB175_NR_SacI
aaagagctcctccacaagacgaacgtaatcc

SEQ ID NO: 8863 - DNA, 31 bp, Artificial Sequence
  Rev External LAB175_ER_SacI
aaagagctcacgtactacgcaccagaacctc

SEQ ID NO: 8864 - DNA, 28 bp, Artificial Sequence
  Fwd Nested LAB176_PCR_NF_BamHI
aaaggatcccccaaatctagcagctcgc

SEQ ID NO: 8865 - DNA, 28 bp, Artificial Sequence
  Fwd External LAB176_PCR_EF_BamHI
aaaggatcctaagtggtgctggaccgac

SEQ ID NO: 8866 - DNA, 31 bp, Artificial Sequence
  Rev Nested  LAB176_PCR_NR_KpnI
tttggtaccaagaacaaggcaatagacatgc

SEQ ID NO: 8867 - DNA, 32 bp, Artificial Sequence
  Rev External LAB176_PCR_ER_KpnI
tttggtaccacaatccatgggcatttagtacc

SEQ ID NO: 8868 - DNA, 27 bp, Artificial Sequence
  Fwd Nested LAB177_NF1_XhoI
aaactcgagcagcgactcccctcacac

SEQ ID NO: 8869 - DNA, 30 bp, Artificial Sequence
  Fwd External LAB177_EF1_XhoI
aaactcgagcgatacctttctcctggcttc

SEQ ID NO: 8870 - DNA, 28 bp, Artificial Sequence
  Rev Nested  LAB177_NR1_StuI
tttaggccttcaaggtgctcctagcgtg

SEQ ID NO: 8871 - DNA, 31 bp, Artificial Sequence
  Rev External LAB177_ER1_StuI
tttaggcctcaaagtgcaacttcatcacctc

SEQ ID NO: 8872 - DNA, 25 bp, Artificial Sequence
  Fwd Nested LAB178_F , Fwd External LAB178_F
caaattattgcactccagaggtttc

SEQ ID NO: 8873 - DNA, 40 bp, Artificial Sequence
  Rev Nested  LAB178_NR_BamHI
tttggatccctactattccctattaaggagaagtctttcc

SEQ ID NO: 8874 - DNA, 41 bp, Artificial Sequence
  Rev External LAB178_ER_BamHI
aaaggatcctcaatccaacaaatactattccctattaagga

SEQ ID NO: 8875 - DNA, 32 bp, Artificial Sequence
  Fwd Nested LAB179_F_BamHI , Fwd External LAB179_F_BamHI
aaaggatcccgatcagatcaagtcatgttcac

SEQ ID NO: 8876 - DNA, 31 bp, Artificial Sequence
  Rev Nested  LAB179_NR_XhoI
aaactcgagaccaatccatactgtggaaagc

SEQ ID NO: 8877 - DNA, 31 bp, Artificial Sequence
  Rev External LAB179_ER_XhoI
aaactcgagcatcaaagatggatggtcactg

SEQ ID NO: 8878 - DNA, 33 bp, Artificial Sequence
  Fwd Nested LAB181_NF_BamHI
aaaggatccgagaattctgcttcggacattaag

SEQ ID NO: 8879 - DNA, 31 bp, Artificial Sequence
  Fwd External LAB181_EF_BamHI
aaaggatccgaggctctctaatcgtcgtcag

SEQ ID NO: 8880 - DNA, 31 bp, Artificial Sequence
  Rev Nested  LAB181_NR_XhoI
aaactcgagacctaattgcttcccaagaacc

SEQ ID NO: 8881 - DNA, 31 bp, Artificial Sequence
  Rev External LAB181_ER_XhoI
aaactcgagttgtggattcttccattcttcg

SEQ ID NO: 8882 - DNA, 31 bp, Artificial Sequence
  Fwd xNested LAB182_NF_BamHI
aaaggatccaacaaccatgttctgaggaagg

SEQ ID NO: 8883 - DNA, 31 bp, Artificial Sequence
  Fwd External LAB182_EF_BamHI
aaaggatccccaatacccaatttgcagagac

SEQ ID NO: 8884 - DNA, 30 bp, Artificial Sequence
  Rev Nested  LAB182_NR_XhoI
aaactcgaggtctccggagtttagcctgag

SEQ ID NO: 8885 - DNA, 31 bp, Artificial Sequence
  Rev External LAB182_ER_XhoI
aaactcgagtgacttcccgtcatgtatcatc

SEQ ID NO: 8886 - DNA, 31 bp, Artificial Sequence
  Fwd Nested LAB183_NF_BamHI
aaaggatccaactctggcatgtctcaattcc

SEQ ID NO: 8887 - DNA, 31 bp, Artificial Sequence
  Fwd External LAB183_EF_BamHI
aaaggatcccacaggttcgtgctactactcc

SEQ ID NO: 8888 - DNA, 31 bp, Artificial Sequence
  Rev Nested  LAB183_NR_XhoI
aaactcgagtgtgctcatacagagttgcagg

SEQ ID NO: 8889 - DNA, 31 bp, Artificial Sequence
  Rev External LAB183_ER_XhoI
aaactcgagtggtaagatcccttgacagagc

SEQ ID NO: 8890 - DNA, 31 bp, Artificial Sequence
  Fwd Nested LAB185_NF_BamHI
aaaggatccttcttcttcttgaaatggcgac

SEQ ID NO: 8891 - DNA, 36 bp, Artificial Sequence
  Rev Nested  LAB185_NR_XhoI
aaactcgagaatttcgatttaagctcctcatatttc

SEQ ID NO: 8892 - DNA, 30 bp, Artificial Sequence
  Fwd External LAB186_EF_BamHI
tatggatcctcttgctctgtctccgatacc

SEQ ID NO: 8893 - DNA, 37 bp, Artificial Sequence
  Rev External LAB186_ER_KpnI
ttaggtaccttatctcctgagtgaaatctcataggtg

SEQ ID NO: 8894 - DNA, 34 bp, Artificial Sequence
  Fwd Nested LAB187_NF_SalI
aaagtcgactgttgaagaagactcataatcggag

SEQ ID NO: 8895 - DNA, 31 bp, Artificial Sequence
  Fwd External LAB187_EF_SalI
aaagtcgacattgcatttcctaacgctcaac

SEQ ID NO: 8896 - DNA, 32 bp, Artificial Sequence
  Rev Nested  LAB187_NR_EcoRV
aaagatatccccagcctgaattaagagctaac

SEQ ID NO: 8897 - DNA, 36 bp, Artificial Sequence
  Rev External LAB187_ER_EcoRV
aaagatatctggtaaatacgcataatctgttctttc

SEQ ID NO: 8898 - DNA, 29 bp, Artificial Sequence
  Fwd Nested LAB188_NF_SalI
ttagtcgacgcatacttgcacgcaatctc

SEQ ID NO: 8899 - DNA, 36 bp, Artificial Sequence
  Fwd External LAB188_EF_SalI
ttagtcgacttcatagtttctcgttacaagacaaca

SEQ ID NO: 8900 - DNA, 42 bp, Artificial Sequence
  Rev Nested  LAB188_R_XbaI  , Rev External LAB188_R_XbaI
taatctagactactactcgatttcagaatgtacataatctct

SEQ ID NO: 8901 - DNA, 31 bp, Artificial Sequence
  Fwd External LAB189_EF_BamHI
aaaggatccgctcatttcccagaaacctttg

SEQ ID NO: 8902 - DNA, 33 bp, Artificial Sequence
  Rev External LAB189_R_XhoI
taactcgagtcacattgaacaaagagacgattc

SEQ ID NO: 8903 - DNA, 33 bp, Artificial Sequence
  Fwd Nested LAB190_NF_BamHI
aaaggatcctggctctctttattatccttcctg

SEQ ID NO: 8904 - DNA, 31 bp, Artificial Sequence
  Rev Nested  LAB190_NR_KpnI
aaaggtaccattgagtttcctggtgaagctg

SEQ ID NO: 8905 - DNA, 31 bp, Artificial Sequence
  Fwd Nested LAB191_F_SalI , Fwd External LAB191_F_SalI
aaagtcgacttcgatttcgaatcattgatgg

SEQ ID NO: 8906 - DNA, 35 bp, Artificial Sequence
  Rev Nested  LAB191_NR_XbaI
aaatctagactagagagagatccacttcaccaatc

SEQ ID NO: 8907 - DNA, 33 bp, Artificial Sequence
  Rev External LAB191_ER_XbaI
aaatctagacaacaccaatgttcgttctatcac

SEQ ID NO: 8908 - DNA, 31 bp, Artificial Sequence
  Fwd Nested LAB197_NF_SalI
aaagtcgaccacagcttgaactgaaagcaag

SEQ ID NO: 8909 - DNA, 31 bp, Artificial Sequence
  Rev Nested  LAB197_NR_BamHI
aaaggatcccacgaatctaccaccaacagag

SEQ ID NO: 8910 - DNA, 29 bp, Artificial Sequence
  Fwd External LAB204_EF_BamHI
aaaggatccggctggatacgtgtgtcatc

SEQ ID NO: 8911 - DNA, 31 bp, Artificial Sequence
  Rev External LAB204_ER_XhoI
aaactcgagaaaccacagaggaatttgcatc

SEQ ID NO: 8912 - DNA, 29 bp, Artificial Sequence
  Fwd Nested LAB206_F_SalI , Fwd External LAB206_F_SalI
aaagtcgacctgtctgtcaccgtccattc

SEQ ID NO: 8913 - DNA, 34 bp, Artificial Sequence
  Rev Nested  LAB206_NR_XbaI
aaatctagactaaagattatccggagcaggagag

SEQ ID NO: 8914 - DNA, 32 bp, Artificial Sequence
  Rev External LAB206_ER_XbaI
aaatctagagagaaccatttgcactgaatagc

SEQ ID NO: 8915 - DNA, 20 bp, Artificial Sequence
  Fwd External LAB207_F
ccatcctgctgatgcttggg

SEQ ID NO: 8916 - DNA, 29 bp, Artificial Sequence
  Rev External LAB207_ER_XhoI
aaactcgagagcgaggtcgcagtacagac

SEQ ID NO: 8917 - DNA, 31 bp, Artificial Sequence
  Fwd Nested LAB210_NF_BamHI
aaaggatccggtctataggcgagatgagctg

SEQ ID NO: 8918 - DNA, 34 bp, Artificial Sequence
  Fwd External LAB210_EF_BamHI
aaaggatccagctagctaacggtctataggcgag

SEQ ID NO: 8919 - DNA, 34 bp, Artificial Sequence
  Rev Nested  LAB210_NR_XhoI
aaactcgagctatcctattcgtgggctacagaag

SEQ ID NO: 8920 - DNA, 31 bp, Artificial Sequence
  Rev External LAB210_ER_XhoI
aaactcgagtcaatctcggactaccaaatcc

SEQ ID NO: 8921 - DNA, 29 bp, Artificial Sequence
  Fwd Nested LAB212_NF_BamHI
aaaggatcccctgctcattatcggtccac

SEQ ID NO: 8922 - DNA, 29 bp, Artificial Sequence
  Fwd External LAB212_EF_BamHI
aaaggatcccgtcctgcctgctcattatc

SEQ ID NO: 8923 - DNA, 31 bp, Artificial Sequence
  Rev Nested  LAB212_NR_KpnI
aaaggtacctagcggttatacagggagcaac

SEQ ID NO: 8924 - DNA, 31 bp, Artificial Sequence
  Rev External LAB212_ER_KpnI
aaaggtacccgatcggttagcggttatacag

SEQ ID NO: 8925 - DNA, 30 bp, Artificial Sequence
  Fwd Nested LAB213_NF_XhoI
aaactcgagcccaaatagatcgatccaagc

SEQ ID NO: 8926 - DNA, 31 bp, Artificial Sequence
  Rev Nested  LAB213_NR_SacI
aaagagctctaaatagcaacctgctccctcc

SEQ ID NO: 8927 - DNA, 28 bp, Artificial Sequence
  Fwd External LAB217_F_BamHI
aaaggatcccctttcttctccagcgtcc

SEQ ID NO: 8928 - DNA, 31 bp, Artificial Sequence
  Rev External LAB217_ER_XhoI
aaactcgagcatgtgaaggatgatctgaacc

SEQ ID NO: 8929 - DNA, 30 bp, Artificial Sequence
  Fwd Nested LAB218_F_BamHI , Fwd External LAB218_F_BamHI
aaaggatccctaagcaaaacgtcgaaggac

SEQ ID NO: 8930 - DNA, 29 bp, Artificial Sequence
  Rev Nested  LAB218_NR_EcoRV
tttgatatccagtcacccagtttcaatgc

SEQ ID NO: 8931 - DNA, 30 bp, Artificial Sequence
  Rev External LAB218_ER_EcoRV
aaagatatcgcaaccaaactggagatgatg

SEQ ID NO: 8932 - DNA, 30 bp, Artificial Sequence
  Fwd Nested LAB221_F_BamHI , Fwd External LAB221_F_BamHI
aaaggatccgcatatatttggcagcaggag

SEQ ID NO: 8933 - DNA, 32 bp, Artificial Sequence
  Rev Nested  LAB221_NR_XhoI
aaactcgagaactcgaagctacatgtccattg

SEQ ID NO: 8934 - DNA, 32 bp, Artificial Sequence
  Rev External LAB221_ER_XhoI
aaactcgagctttgcatattcttcacgtttgg

SEQ ID NO: 8935 - DNA, 27 bp, Artificial Sequence
  Fwd Nested LAB222_NF_BamHI
aaaggatccaacagcgcaagtggagtg

SEQ ID NO: 8936 - DNA, 31 bp, Artificial Sequence
  Rev Nested  LAB222_NR_XhoI
aaactcgagaaagccagaaattaagccaagg

SEQ ID NO: 8937 - DNA, 33 bp, Artificial Sequence
  Fwd Nested LAB225_NF1_BamHI
tttggatccgacctgactgcattctgtagtgag

SEQ ID NO: 8938 - DNA, 31 bp, Artificial Sequence
  Rev Nested  LAB225_NR_XhoI
aaactcgaggtaaataacacccacgtcctgc

SEQ ID NO: 8939 - DNA, 31 bp, Artificial Sequence
  Fwd Nested LAB230_NF_BamHI
aaaggatcccgcttatctggcctatcatctg

SEQ ID NO: 8940 - DNA, 31 bp, Artificial Sequence
  Rev Nested  LAB230_NR_XhoI
aaactcgaggagaggagacatcgacgaattg

SEQ ID NO: 8941 - DNA, 26 bp, Artificial Sequence
  Fwd Nested LAB231_NF_SalI
ttagtcgacgcgcaatggagcagctg

SEQ ID NO: 8942 - DNA, 30 bp, Artificial Sequence
  Rev Nested  LAB231_NR_XbaI
taatctagagcaatcaagaccatcttggag

SEQ ID NO: 8943 - DNA, 28 bp, Artificial Sequence
  Fwd Nested LAB232_NF_BamHI
aaaggatccctgcttcccgtccaatctc

SEQ ID NO: 8944 - DNA, 31 bp, Artificial Sequence
  Rev Nested  LAB232_NR_XhoI
aaactcgaggggcacatttaggatgtgaatc

SEQ ID NO: 8945 - DNA, 31 bp, Artificial Sequence
  Fwd Nested LAB238_NF_BamHI
aaaggatccaggcataaagtgagagaccgtg

SEQ ID NO: 8946 - DNA, 31 bp, Artificial Sequence
  Fwd External LAB238_EF_BamHI
aaaggatcccaaactttcctcgaactcctcc

SEQ ID NO: 8947 - DNA, 34 bp, Artificial Sequence
  Rev Nested  LAB238_NR_KpnI
aaaggtaccctaaacaaggaggatcagacagacg

SEQ ID NO: 8948 - DNA, 31 bp, Artificial Sequence
  Rev External LAB238_ER_KpnI
aaaggtaccgacaaaccagtatgcaggacag

SEQ ID NO: 8949 - DNA, 31 bp, Artificial Sequence
  Fwd Nested LAB240_NF_BamHI
aaaggatccagtcctaacccgaatccatttc

SEQ ID NO: 8950 - DNA, 30 bp, Artificial Sequence
  Rev Nested  LAB240_NR_XhoI
aaactcgaggtacgcgacgctgattacaac

SEQ ID NO: 8951 - DNA, 31 bp, Artificial Sequence
  Fwd Nested LAB242_NF_BamHI
aaaggatccccgtgactgagaacaagagagg

SEQ ID NO: 8952 - DNA, 32 bp, Artificial Sequence
  Fwd External LAB242_EF_BamHI
aaaggatcccacttccatttattctcccaacc

SEQ ID NO: 8953 - DNA, 31 bp, Artificial Sequence
  Rev Nested  LAB242_NR_XhoI
aaactcgagggtgcaaagtaagcttcacgag

SEQ ID NO: 8954 - DNA, 31 bp, Artificial Sequence
  Rev External LAB242_ER_XhoI
aaactcgaggatctggacaccataacgaacc

SEQ ID NO: 8955 - DNA, 31 bp, Artificial Sequence
  Fwd External LAB243_EF_BamHI
aaaggatccgttacaatcagcacacgctctc

SEQ ID NO: 8956 - DNA, 32 bp, Artificial Sequence
  Rev External LAB243_ER_XhoI
aaactcgagtccttgctcatagtgccatttac

SEQ ID NO: 8957 - DNA, 29 bp, Artificial Sequence
  Fwd Nested LAB247_NF_SalI
aaagtcgacagggagtgagtgagcaatcg

SEQ ID NO: 8958 - DNA, 34 bp, Artificial Sequence
  Rev Nested  LAB247_NR_XbaI
aaatctagactattctgcttgtttgtcaagatgg

SEQ ID NO: 8959 - DNA, 29 bp, Artificial Sequence
  Fwd External LAB249_EF_BamHI
aaaggatccagccagtgcaaatctgatcg

SEQ ID NO: 8960 - DNA, 31 bp, Artificial Sequence
  Rev External LAB249_ER_XhoI
aaactcgagacacagacgagaaactctgacg

SEQ ID NO: 8961 - DNA, 28 bp, Artificial Sequence
  Fwd Nested LAB250_NF_XhoI
aaactcgagagatccgcccatgagtagg

SEQ ID NO: 8962 - DNA, 31 bp, Artificial Sequence
  Rev Nested  LAB250_NR_SacI
aaagagctcagatttgggagtctgtaccgtg

SEQ ID NO: 8963 - DNA, 20 bp, Artificial Sequence
  Fwd External LAB254_F
gctcttgcgctcaagtacag

SEQ ID NO: 8964 - DNA, 31 bp, Artificial Sequence
  Rev External LAB254_ER_XhoI
aaactcgagacataacatggtagctgggcat

SEQ ID NO: 8965 - DNA, 30 bp, Artificial Sequence
  Fwd Nested LAB255_NF_SalI
aaagtcgacaaattccgctcctaaaccctc

SEQ ID NO: 8966 - DNA, 31 bp, Artificial Sequence
  Fwd External LAB255_EF_SalI
aaagtcgacgttgtttcacactcccaacctc

SEQ ID NO: 8967 - DNA, 31 bp, Artificial Sequence
  Rev Nested  LAB255_NR_EcoRV
aaagatatcatgttcaggcagagtatggtcc

SEQ ID NO: 8968 - DNA, 31 bp, Artificial Sequence
  Rev External LAB255_ER_EcoRV
aaagatatcgcaaaggtggagaaactgtagg

SEQ ID NO: 8969 - DNA, 31 bp, Artificial Sequence
  Fwd External LAB258_EF_BamHI
aaaggatcccagcaagaacgaagctaaggac

SEQ ID NO: 8970 - DNA, 32 bp, Artificial Sequence
  Rev External LAB258_ER_XhoI
aaactcgagttatttgctcggaatgagacaac

SEQ ID NO: 8971 - DNA, 31 bp, Artificial Sequence
  Fwd External LAB259_EF_BamHI
aaaggatccagatctccggttggaagttagg

SEQ ID NO: 8972 - DNA, 33 bp, Artificial Sequence
  Rev External LAB259_ER_XhoI
aaactcgagaccagtacaagatgagaaacatgg

SEQ ID NO: 8973 - DNA, 31 bp, Artificial Sequence
  Fwd External LAB261_EF_SmaI
ttacccgggcattggaggaggagatctctcc

SEQ ID NO: 8974 - DNA, 31 bp, Artificial Sequence
  Rev External LAB261_ER_KpnI
taaggtaccgtaatgcagagcattcccattg

SEQ ID NO: 8975 - DNA, 30 bp, Artificial Sequence
  Fwd Nested LAB262_NF_XhoI
aaactcgagtcgtagcggcgaaggatatag

SEQ ID NO: 8976 - DNA, 31 bp, Artificial Sequence
  Rev Nested  LAB262_NR_SacI
aaagagctcatgcgatacaatcatcttgacg

SEQ ID NO: 8977 - DNA, 29 bp, Artificial Sequence
  Fwd External LAB263_EF_XhoI
aaactcgaggtcgcgagccttactgaaac

SEQ ID NO: 8978 - DNA, 31 bp, Artificial Sequence
  Rev External LAB263_ER_SacI
aaagagctcagttccatcctgtcaaagggag

SEQ ID NO: 8979 - DNA, 31 bp, Artificial Sequence
  Fwd External LAB265_EF_BamHI
aaaggatcctgcaagctcctgtctctcctac

SEQ ID NO: 8980 - DNA, 31 bp, Artificial Sequence
  Rev External LAB265_ER_KpnI
aaaggtaccaaagaaactgagcagaccgaac

SEQ ID NO: 8981 - DNA, 35 bp, Artificial Sequence
  Fwd Nested LAB267_NF_SmaI
tttcccgggcgttgtagtagattgtgaggagtagc

SEQ ID NO: 8982 - DNA, 32 bp, Artificial Sequence
  Rev Nested  LAB267_NR_KpnI
aaaggtacccacgttcacgacttatctacacg

SEQ ID NO: 8983 - DNA, 26 bp, Artificial Sequence
  Fwd External LAB268_EF_SalI
aaagtcgacaccgcaaccggaaaatc

SEQ ID NO: 8984 - DNA, 30 bp, Artificial Sequence
  Rev External LAB268_ER_XbaI
aaatctagacacaactgacaacttgcgaac

SEQ ID NO: 8985 - DNA, 27 bp, Artificial Sequence
  Fwd Nested LAB269_F_SalI , Fwd External LAB269_F_SalI
aaagtcgactcgcatccacagcctctc

SEQ ID NO: 8986 - DNA, 31 bp, Artificial Sequence
  Rev Nested  LAB269_NR_XbaI
aaatctagaaccgtgccatctacagacctac

SEQ ID NO: 8987 - DNA, 31 bp, Artificial Sequence
  Rev External LAB269_ER_XbaI
aaatctagactaagcagttccaacaacaacg

SEQ ID NO: 8988 - DNA, 26 bp, Artificial Sequence
  Fwd External LAB270_EF_SalI
aaagtcgacgtcatcccagtccacgc

SEQ ID NO: 8989 - DNA, 32 bp, Artificial Sequence
  Rev External LAB270_ER_KpnI
tttggtaccgcaggttacaacagtcatgtcag

SEQ ID NO: 8990 - DNA, 30 bp, Artificial Sequence
  Fwd External LAB271_EF_BamHI
aaaggatcctcttcctcccattagcagcag

SEQ ID NO: 8991 - DNA, 31 bp, Artificial Sequence
  Rev External LAB271_ER_XhoI
aaactcgagcttcaacgtgtggttcacaaac

SEQ ID NO: 8992 - DNA, 28 bp, Artificial Sequence
  Fwd Nested LAB272_NF_SmaI
aaacccgggcacgaaagcacacgagtcc

SEQ ID NO: 8993 - DNA, 27 bp, Artificial Sequence
  Rev Nested  LAB272_NR_SmaI
aaacccgggggatgagcatgagccagc

SEQ ID NO: 8994 - DNA, 31 bp, Artificial Sequence
  Fwd External LAB274_EF_BamHI
aaaggatccacatcttcgatcgtcttccatg

SEQ ID NO: 8995 - DNA, 32 bp, Artificial Sequence
  Rev External LAB274_ER_XhoI
tttctcgagcagtaaccgtaaagacatgcctg

SEQ ID NO: 8996 - DNA, 30 bp, Artificial Sequence
  Fwd Nested LAB275_NF_EcoRV
ttagatatcgcaagaatcagcatagcatgg

SEQ ID NO: 8997 - DNA, 30 bp, Artificial Sequence
  Rev Nested  LAB275_NR_KpnI
aaaggtacctcacacttgatgcagccatcc

SEQ ID NO: 8998 - DNA, 27 bp, Artificial Sequence
  Fwd Nested LAB277_NF_SalI , Fwd External LAB277_NF_SalI
aaagtcgaccgcgtaacgaaacccaac

SEQ ID NO: 8999 - DNA, 31 bp, Artificial Sequence
  Rev Nested  LAB277_NR_XbaI , Rev External LAB277_NR_XbaI
aaatctagaaccagtagcaaccaaatcaagc

SEQ ID NO: 9000 - DNA, 31 bp, Artificial Sequence
  Fwd Nested LAB278_NF_SalI
aaagtcgaccaatccgatcccatagaaactc

SEQ ID NO: 9001 - DNA, 32 bp, Artificial Sequence
  Fwd External LAB278_EF_SalI
aaagtcgacacaacaatctggtcgatctctcc

SEQ ID NO: 9002 - DNA, 34 bp, Artificial Sequence
  Rev Nested  LAB278_NR_XbaI
aaatctagactatacacaatcaaatccatcgcag

SEQ ID NO: 9003 - DNA, 34 bp, Artificial Sequence
  Rev External LAB278_ER_XbaI
aaatctagactatagactgaaatggaagcagcac

SEQ ID NO: 9004 - DNA, 31 bp, Artificial Sequence
  Fwd External LAB279_EF_SalI
aaagtcgacgtcatcgtccagaccatttacc

SEQ ID NO: 9005 - DNA, 31 bp, Artificial Sequence
  Rev External LAB279_ER_XbaI
aaatctagaaacgttgataacaggcagttgg

SEQ ID NO: 9006 - DNA, 27 bp, Artificial Sequence
  Fwd Nested LAB280_NF_SalI
aaagtcgaccaaattgctcccgcattc

SEQ ID NO: 9007 - DNA, 33 bp, Artificial Sequence
  Fwd External LAB280_EF_SalI
aaagtcgacactaaactagtgccaaattgctcc

SEQ ID NO: 9008 - DNA, 31 bp, Artificial Sequence
  Rev Nested  LAB280_NR_XbaI
aaatctagaacaaatgagaaaggcacaggac

SEQ ID NO: 9009 - DNA, 32 bp, Artificial Sequence
  Rev External LAB280_ER_XbaI
aaatctagatccaaagttacaaggcacaagag

SEQ ID NO: 9010 - DNA, 30 bp, Artificial Sequence
  Fwd External LAB281_EF_SalI
aaagtcgaccgagcttctttacacagcagg

SEQ ID NO: 9011 - DNA, 31 bp, Artificial Sequence
  Rev External LAB281_ER_XbaI
aaatctagaaatttcgtcggttctgttgaag

SEQ ID NO: 9012 - DNA, 31 bp, Artificial Sequence
  Fwd External LAB282_EF_BamHI
aaaggatccagttcgactcagtcatccaacc

SEQ ID NO: 9013 - DNA, 32 bp, Artificial Sequence
  Rev External LAB282_R_KpnI
aaaggtaccctaatccagtttgggaggttctg

SEQ ID NO: 9014 - DNA, 27 bp, Artificial Sequence
  Fwd External LAB283_F_SalI
aaagtcgaccggtcctcctcactgctc

SEQ ID NO: 9015 - DNA, 31 bp, Artificial Sequence
  Rev External LAB283_ER_XbaI
aaatctagataactgaatgcgactcgaacac

SEQ ID NO: 9016 - DNA, 27 bp, Artificial Sequence
  Fwd External LAB284_F_BamHI
aaaggatccaacgctttgtctgcgacg

SEQ ID NO: 9017 - DNA, 31 bp, Artificial Sequence
  Rev External LAB284_ER_XhoI
aaactcgagaagccatctgaaagttgacacc

SEQ ID NO: 9018 - DNA, 31 bp, Artificial Sequence
  Fwd Nested LAB286_NF_BamHI
aaaggatcctcgagctcactcagacatcaac

SEQ ID NO: 9019 - DNA, 31 bp, Artificial Sequence
  Fwd External LAB286_EF_BamHI
aaaggatcctccgtacttctttcgagctcac

SEQ ID NO: 9020 - DNA, 34 bp, Artificial Sequence
  Rev Nested  LAB286_NR_XhoI
aaactcgagctataaactttcctcgtgctccaag

SEQ ID NO: 9021 - DNA, 32 bp, Artificial Sequence
  Rev External LAB286_ER_XhoI
aaactcgaggggacacgtgcatgaagtattag

SEQ ID NO: 9022 - DNA, 28 bp, Artificial Sequence
  Fwd Nested LAB289_NF_SalI
aaagtcgaccgaactccgcttcttcctc

SEQ ID NO: 9023 - DNA, 28 bp, Artificial Sequence
  Fwd External LAB289_EF_SalI
aaagtcgacaattcgaaagcctccctcc

SEQ ID NO: 9024 - DNA, 31 bp, Artificial Sequence
  Rev Nested  LAB289_NR_EcoRV
aaagatatcgaaattgacaatgaatggctcc

SEQ ID NO: 9025 - DNA, 31 bp, Artificial Sequence
  Rev External LAB289_ER_EcoRV
aaagatatctctataacaacatgccaccacg

SEQ ID NO: 9026 - DNA, 27 bp, Artificial Sequence
  Fwd External LAB291_EF_SalI
aaagtcgacccctctccacacccgaac

SEQ ID NO: 9027 - DNA, 31 bp, Artificial Sequence
  Rev External LAB291_ER_StuI
tttaggcctacagtcaagcacatgtgattgc

SEQ ID NO: 9028 - DNA, 30 bp, Artificial Sequence
  Fwd Nested LAB292_NF_SalI
aaagtcgacgaaacaatgctctccatgacc

SEQ ID NO: 9029 - DNA, 33 bp, Artificial Sequence
  Rev Nested  LAB292_NR1_XbaI
aaatctagactacaccttcaccgtctacacgag

SEQ ID NO: 9030 - DNA, 31 bp, Artificial Sequence
  Fwd Nested LAB293_NF_BamHI
aaaggatcccctccgtccaagctatataacc

SEQ ID NO: 9031 - DNA, 33 bp, Artificial Sequence
  Rev Nested  LAB293_NR_XhoI
tttctcgagagaattccgtagttccatatgtgc

SEQ ID NO: 9032 - DNA, 28 bp, Artificial Sequence
  Fwd External LAB294_EF_BamHI
aaaggatccagtcagcaccgcatctgtc

SEQ ID NO: 9033 - DNA, 30 bp, Artificial Sequence
  Rev External LAB294_ER_KpnI
aaaggtaccattgcgctttcatgctacaac

SEQ ID NO: 9034 - DNA, 21 bp, Artificial Sequence
  Fwd Nested LAB295_NF_SalI , Fwd External LAB295_NF_SalI
aaagtcgactagcaggcaaca

SEQ ID NO: 9035 - DNA, 29 bp, Artificial Sequence
  Rev Nested  LAB295_NR_XbaI , Rev External LAB295_NR_XbaI
tattctagaaatggcacatcactgacacg

SEQ ID NO: 9036 - DNA, 31 bp, Artificial Sequence
  Fwd Nested LAB296_NF_SalI
aaagtcgacttcctggcttgagctatctttg

SEQ ID NO: 9037 - DNA, 34 bp, Artificial Sequence
  Rev Nested  LAB296_NR_XbaI
aaatctagactagcagtatgtgcagctccctaac

SEQ ID NO: 9038 - DNA, 26 bp, Artificial Sequence
  Fwd Nested LAB297_F_SalI
aaagtcgactacccaaccgccggtca

SEQ ID NO: 9039 - DNA, 34 bp, Artificial Sequence
  Rev Nested  LAB297_NR_XbaI
aaatctagacatcagtcagctccgaacctatctc

SEQ ID NO: 9040 - DNA, 32 bp, Artificial Sequence
  Fwd Nested LAB298_NF_SalI
atagtcgacctctccctctctttctcttcacc

SEQ ID NO: 9041 - DNA, 32 bp, Artificial Sequence
  Fwd External LAB298_EF_SalI
aaagtcgaccgattctccatatatagcaagcc

SEQ ID NO: 9042 - DNA, 33 bp, Artificial Sequence
  Rev Nested  LAB298_NR_XbaI
ttttctagacctccttttcttcctaaattctgg

SEQ ID NO: 9043 - DNA, 33 bp, Artificial Sequence
  Rev External LAB298_ER_XbaI
ttatctagacatgaacagagcaatgaagttgac

SEQ ID NO: 9044 - DNA, 31 bp, Artificial Sequence
  Fwd External LAB299_EF_BamHI
aaaggatccaagcacatgcgtgttgatttag

SEQ ID NO: 9045 - DNA, 32 bp, Artificial Sequence
  Rev External LAB299_ER_XhoI
aaactcgagcatcacattgcacaagaaatagg

SEQ ID NO: 9046 - DNA, 31 bp, Artificial Sequence
  Fwd Nested LAB300_NF_BamHI
aaaggatccgattcgatctgagaaacgttgg

SEQ ID NO: 9047 - DNA, 31 bp, Artificial Sequence
  Fwd External LAB300_EF_BamHI
aaaggatccgcagtgacattgattcgatctg

SEQ ID NO: 9048 - DNA, 31 bp, Artificial Sequence
  Rev Nested  LAB300_NR_XhoI
aaactcgagccaatatccatttcattcatgc

SEQ ID NO: 9049 - DNA, 31 bp, Artificial Sequence
  Rev External LAB300_ER_XhoI
aaactcgaggtggcatcacaaactcacaaac

SEQ ID NO: 9050 - DNA, 31 bp, Artificial Sequence
  Fwd External LAB302_EF_BamHI
aaaggatccgtttctggaggtaccaagcatc

SEQ ID NO: 9051 - DNA, 31 bp, Artificial Sequence
  Rev External LAB302_ER_XhoI
aaactcgagtcgagccataatgaggctactg

SEQ ID NO: 9052 - DNA, 31 bp, Artificial Sequence
  Fwd Nested LAB303_NF_SalI
aaagtcgactagctagatcagccattgatcg

SEQ ID NO: 9053 - DNA, 31 bp, Artificial Sequence
  Rev Nested  LAB303_NR_XbaI
aaatctagagccaattgagtgaggacaaatc

SEQ ID NO: 9054 - DNA, 34 bp, Artificial Sequence
  Fwd External LAB306_EF_SalI
aaagtcgacacaaatcctagagtttctcctttgg

SEQ ID NO: 9055 - DNA, 42 bp, Artificial Sequence
  Rev External LAB306_ER_SacI
aaagagctcaatgtagtggatagaagtagttatcatgtaatg

SEQ ID NO: 9056 - DNA, 32 bp, Artificial Sequence
  Fwd External LAB307_EF_BamHI
aaaggatcccatagttggtgtagctagcgagg

SEQ ID NO: 9057 - DNA, 32 bp, Artificial Sequence
  Rev External LAB307_ER_KpnI
aaaggtaccaaggtccaaatacaccttccatc

SEQ ID NO: 9058 - DNA, 26 bp, Artificial Sequence
  Fwd Nested LAB308_NF_SalI
tttgtcgaccattgatggcgctccct

SEQ ID NO: 9059 - DNA, 35 bp, Artificial Sequence
  Fwd External LAB308_EF_SalI
atagtcgactcaaaccttaacaccttacgaaaatc

SEQ ID NO: 9060 - DNA, 32 bp, Artificial Sequence
  Rev Nested  LAB308_NR_EcoRV
aaagatatcctatgcttaatcgatttccgcat

SEQ ID NO: 9061 - DNA, 35 bp, Artificial Sequence
  Rev External LAB308_ER_EcoRV
aaagatatcctaactagttgaagttcctttggagg

SEQ ID NO: 9062 - DNA, 32 bp, Artificial Sequence
  Fwd External LAB309_F_SalI
aaagtcgacttcatcaaacaaacaaagccttc

SEQ ID NO: 9063 - DNA, 31 bp, Artificial Sequence
  Rev External LAB309_ER_SacI
aaagagctcttgaagcaaggaaattcaacag

SEQ ID NO: 9064 - DNA, 31 bp, Artificial Sequence
  Fwd External LAB310_EF_SalI
aaagtcgacttggtttgtgtaggatgctttg

SEQ ID NO: 9065 - DNA, 32 bp, Artificial Sequence
  Rev External LAB310_R_XbaI
aaatctagatgctgacactcaagcatgtattc

SEQ ID NO: 9066 - DNA, 32 bp, Artificial Sequence
  Fwd External LAB311_EF_SalI
aaagtcgactcagttgtagtttcggtttcagc

SEQ ID NO: 9067 - DNA, 33 bp, Artificial Sequence
  Rev External LAB311_ER_XbaI
aaatctagaggaagcaacaacaccataaatagg

SEQ ID NO: 9068 - DNA, 35 bp, Artificial Sequence
  Fwd External LAB312_EF_BamHI
aaaggatcctgttcccacgtatattcttgagattg

SEQ ID NO: 9069 - DNA, 31 bp, Artificial Sequence
  Rev External LAB312_ER_XhoI
aaactcgagcaagccaaagttgaagctatgc

SEQ ID NO: 9070 - DNA, 34 bp, Artificial Sequence
  Fwd Nested LAB314_NF_BamHI
aaaggatcctcttgaatgatcactttgtttgaag

SEQ ID NO: 9071 - DNA, 33 bp, Artificial Sequence
  Rev Nested  LAB314_NR_XhoI
aaactcgagctacagtttatggatgtgctgctg

SEQ ID NO: 9072 - DNA, 39 bp, Artificial Sequence
  Fwd External LAB315_EF_SalI
tttgtcgacgctaaagaagagaatagatccaactatgtc

SEQ ID NO: 9073 - DNA, 40 bp, Artificial Sequence
  Rev External LAB315_R_XbaI
aaatctagacaagttgtcctagttactaacaatatcttcg

SEQ ID NO: 9074 - DNA, 32 bp, Artificial Sequence
  Fwd Nested LAB316_F_BamHI ,Fwd External LAB316_F_BamHI
aaaggatcccccattcagtacgtagcacacag

SEQ ID NO: 9075 - DNA, 31 bp, Artificial Sequence
  Rev Nested  LAB316_NR_XhoI
aaactcgagcggatgtcaacccagagataac

SEQ ID NO: 9076 - DNA, 31 bp, Artificial Sequence
  Rev External LAB316_ER_XhoI
aaactcgagaatcttggcaataacacggatg

SEQ ID NO: 9077 - DNA, 29 bp, Artificial Sequence
  Fwd External LAB317_EF_SalI
aaagtcgacagccatggtgaacaaaaagc

SEQ ID NO: 9078 - DNA, 36 bp, Artificial Sequence
  Rev External LAB317_R_XbaI
ttttctagatcacattcattttagcagttcggaaac

SEQ ID NO: 9079 - DNA, 33 bp, Artificial Sequence
  Fwd Nested LAB318_NF_BamHI
aaaggatcccagtttctgaagttgtcttgcttg

SEQ ID NO: 9080 - DNA, 30 bp, Artificial Sequence
  Fwd External LAB318_EF_BamHI
aaaggatcccggcaatggttctgtaaactg

SEQ ID NO: 9081 - DNA, 33 bp, Artificial Sequence
  Rev Nested  LAB318_NR_XhoI
aaactcgagtccaatttcaaccgtctaaagaac

SEQ ID NO: 9082 - DNA, 32 bp, Artificial Sequence
  Rev External LAB318_ER_XhoI
aaactcgagggcatttggaaacttgataattg

SEQ ID NO: 9083 - DNA, 36 bp, Artificial Sequence
  Fwd Nested LAB319_NF SalI
tttgtcgacccaccactttttctctatgatacacac

SEQ ID NO: 9084 - DNA, 33 bp, Artificial Sequence
  Fwd External LAB319_EF_SalI
aaagtcgacgaagaacacagtgaaaaatccctc

SEQ ID NO: 9085 - DNA, 30 bp, Artificial Sequence
  Rev Nested  LAB319_NR_XbaI
taatctagattacgacgcaagagacggaac

SEQ ID NO: 9086 - DNA, 32 bp, Artificial Sequence
  Rev External LAB319_ER_XbaI
aaatctagattacaagccaagaatgaattgcc

SEQ ID NO: 9087 - DNA, 31 bp, Artificial Sequence
  Fwd Nested LAB320_NF_XhoI
aaactcgagtgacatggctgctactaaatgg

SEQ ID NO: 9088 - DNA, 31 bp, Artificial Sequence
  Fwd External LAB320_EF_XhoI
aaactcgagtctctccctctgcttgaaattg

SEQ ID NO: 9089 - DNA, 31 bp, Artificial Sequence
  Rev Nested  LAB320_NR_EcoRV
aaagatatcctgacctctttctcaagccaag

SEQ ID NO: 9090 - DNA, 31 bp, Artificial Sequence
  Rev External LAB320_ER_EcoRV
aaagatatctaacgctaagccaaggatgaac

SEQ ID NO: 9091 - DNA, 36 bp, Artificial Sequence
  Fwd Nested LAB323_NF_SalI
aaagtcgaccttcctcgtaaaagctttgtatatacg

SEQ ID NO: 9092 - DNA, 32 bp, Artificial Sequence
  Fwd External LAB323_EF_SalI
tttgtcgacgctttctcttcctcgtaaaagct

SEQ ID NO: 9093 - DNA, 36 bp, Artificial Sequence
  Rev Nested  LAB323_NR_XbaI
ttttctagagaattgaattggttacaataggacacc

SEQ ID NO: 9094 - DNA, 31 bp, Artificial Sequence
  Rev External LAB323_ER_XbaI
aaatctagagaagagaagttggcattgcttc

SEQ ID NO: 9095 - DNA, 35 bp, Artificial Sequence
  Fwd External LAB324_EF_SalI
tttgtcgacgtgcttttgtaagtttgagaaagagg

SEQ ID NO: 9096 - DNA, 30 bp, Artificial Sequence
  Rev External LAB324_ER_XbaI
aaatctagaccgttaggtccaggatgaaac

SEQ ID NO: 9097 - DNA, 33 bp, Artificial Sequence
  Fwd External LAB325_F_BamHI
aaaggatccttcttgaagacaaagtaatggtgg

SEQ ID NO: 9098 - DNA, 31 bp, Artificial Sequence
  Rev External LAB325_ER_XhoI
aaactcgagaattcctacaaatcatcggcac

SEQ ID NO: 9099 - DNA, 29 bp, Artificial Sequence
  Fwd External LAB326_F_SalI
aaagtcgacgttggtccaatggcatcatc

SEQ ID NO: 9100 - DNA, 35 bp, Artificial Sequence
  Rev External LAB326_ER_SacI
tttgagctcttgaatagacataagcacactgtcac

SEQ ID NO: 9101 - DNA, 31 bp, Artificial Sequence
  Fwd Nested LAB327_NF_BamHI
aaaggatccttaccgtcgacgttcctaattt

SEQ ID NO: 9102 - DNA, 35 bp, Artificial Sequence
  Fwd External LAB327_EF_BamHI
aaaggatccgctcattctcactttcttatacaacg

SEQ ID NO: 9103 - DNA, 32 bp, Artificial Sequence
  Rev Nested  LAB327_R_KpnI , Rev External LAB327_R_KpnI
aaaggtaccttcttagcaacattaatgccagg

SEQ ID NO: 9104 - DNA, 28 bp, Artificial Sequence
  Fwd External LAB335_EF_BamHI
aaaggatcctccaacagaggctgggaac

SEQ ID NO: 9105 - DNA, 31 bp, Artificial Sequence
  Rev External LAB335_ER_XhoI
aaactcgagtacttgcaccacgagaactcac

SEQ ID NO: 9106 - DNA, 33 bp, Artificial Sequence
  Fwd Nested LAB336_F_BamHI , Fwd External LAB336_F_BamHI
aaaggatccgcagtgaaagagaagaggctaatc

SEQ ID NO: 9107 - DNA, 31 bp, Artificial Sequence
  Rev Nested  LAB336_NR_KpnI
aaaggtaccaaccaaacgaatccattcaaag

SEQ ID NO: 9108 - DNA, 31 bp, Artificial Sequence
  Rev External LAB336_ER_KpnI
aaaggtaccgagatgccatagaaaccaaacg

SEQ ID NO: 9109 - DNA, 31 bp, Artificial Sequence
  Fwd Nested LAB337_NF_BamHI
aaaggatccacatccttcagctagccaaatc

SEQ ID NO: 9110 - DNA, 34 bp, Artificial Sequence
  Fwd External LAB337_EF_BamHI
aaaggatccgctctctctagctacatccttcagc

SEQ ID NO: 9111 - DNA, 31 bp, Artificial Sequence
  Rev Nested  LAB337_NR_XhoI
aaactcgagtcacaccagtctctctttcctg

SEQ ID NO: 9112 - DNA, 31 bp, Artificial Sequence
  Rev External LAB337_ER_XhoI
aaactcgagtatctcgctcatctcacaccag

SEQ ID NO: 9113 - DNA, 29 bp, Artificial Sequence
  Fwd Nested LAB339_NF_BamHI
aaaggatccacagccatcggaatcaacag

SEQ ID NO: 9114 - DNA, 31 bp, Artificial Sequence
  Rev Nested  LAB339_NR_XhoI
aaactcgagagaaagagctacatccgcattg

SEQ ID NO: 9115 - DNA, 31 bp, Artificial Sequence
  Fwd Nested LAB343_NF_SmaI
aaacccgggttcggaaacaaacttctcaagg

SEQ ID NO: 9116 - DNA, 36 bp, Artificial Sequence
  Rev Nested  LAB343_NR1_SacI
aaagagctccacaacttctactgacaacacatcatc

SEQ ID NO: 9117 - DNA, 30 bp, Artificial Sequence
  Fwd Nested LAB345_NF_SalI
aaagtcgacactagtccactccctcgcttc

SEQ ID NO: 9118 - DNA, 31 bp, Artificial Sequence
  Rev Nested  LAB345_NR_XbaI
aaatctagaaacggtgacgacagtaacacac

SEQ ID NO: 9119 - DNA, 32 bp, Artificial Sequence
  Fwd Nested LAB346_NF_BamHI
aaaggatcccactggactagagacagcaatgg

SEQ ID NO: 9120 - DNA, 34 bp, Artificial Sequence
  Rev Nested  LAB346_NR_XhoI
aaactcgagctacgctataaataattgtgccacg

SEQ ID NO: 9121 - DNA, 27 bp, Artificial Sequence
  Fwd Nested LAB348_NF_EcoRV
aaagatatccacgctcatgccagtgac

SEQ ID NO: 9122 - DNA, 27 bp, Artificial Sequence
  Fwd External LAB348_EF_EcoRV
aaagatatcgccacggcactccaaatc

SEQ ID NO: 9123 - DNA, 31 bp, Artificial Sequence
  Rev Nested  LAB348_NR_EcoRV
tatgatatcttacaaccggtgtcagaactcc

SEQ ID NO: 9124 - DNA, 34 bp, Artificial Sequence
  Rev External LAB348_ER_EcoRV
tttgatatcttatgagctagcacaaatgtcgagc

SEQ ID NO: 9125 - DNA, 33 bp, Artificial Sequence
  Fwd Nested LAB349_F_BamHI , Fwd Nested LAB349_F_BamHI
aaaggatccaagtgagtgtaacaatggctgaga

SEQ ID NO: 9126 - DNA, 32 bp, Artificial Sequence
  Rev Nested  LAB349_NR_XhoI
tttctcgagcttaaacaagcacactttggcac

SEQ ID NO: 9127 - DNA, 35 bp, Artificial Sequence
  Rev External LAB349_ER_XhoI
tttctcgagcctatgaaccaacattgatcctctag

SEQ ID NO: 9128 - DNA, 30 bp, Artificial Sequence
  Fwd Nested LAB352_NF_BamHI
aaaggatccgggaattgcttgctctctctc

SEQ ID NO: 9129 - DNA, 32 bp, Artificial Sequence
  Rev Nested  LAB352_NR_KpnI
aaaggtaccaggccgctaaacataatacactg

SEQ ID NO: 9130 - DNA, 27 bp, Artificial Sequence
  Fwd External LAB353_EF_EcoRV
aaagatatcacccagcagcaactcgtc

SEQ ID NO: 9131 - DNA, 36 bp, Artificial Sequence
  Rev External LAB353_ER_XhoI
aaactcgagctaaagaacaatgaacaaatgggtctc

SEQ ID NO: 9132 - DNA, 28 bp, Artificial Sequence
  Fwd Nested LAB355_NF1_SalI
aaagtcgacagcgaatggagcccaaatc

SEQ ID NO: 9133 - DNA, 28 bp, Artificial Sequence
  Fwd External LAB355_NF_SalI
aaagtcgacaatcgagcctcactcgctc

SEQ ID NO: 9134 - DNA, 33 bp, Artificial Sequence
  Rev Nested  LAB355_NR1_XbaI
aaatctagactaaaacaacagcacgatctgaac

SEQ ID NO: 9135 - DNA, 31 bp, Artificial Sequence
  Rev External LAB355_NR_XbaI
aaatctagaggcgaacaaacaaacataggag

SEQ ID NO: 9136 - DNA, 30 bp, Artificial Sequence
  Fwd Nested LAB367_NF_BamHI
aaaggatccctaacgaatcccaattccgag

SEQ ID NO: 9137 - DNA, 31 bp, Artificial Sequence
  Fwd External LAB367_EF_BamHI
aaaggatccgtcactgcgaattgtctaaagc

SEQ ID NO: 9138 - DNA, 32 bp, Artificial Sequence
  Rev Nested  LAB367_NR_XhoI
aaactcgagttgtcaaacaccacactgatctc

SEQ ID NO: 9139 - DNA, 31 bp, Artificial Sequence
  Rev External LAB367_ER_XhoI
aaactcgagcaacctcctcttgcttacttgg

SEQ ID NO: 9140 - DNA, 28 bp, Artificial Sequence
  Fwd Nested LAB381_NF_SalI
aaagtcgaccaactctcgcgccaaatac

SEQ ID NO: 9141 - DNA, 35 bp, Artificial Sequence
  Fwd External LAB381_EF_SalI
aaagtcgacccagcaaatcacaaactactatctcc

SEQ ID NO: 9142 - DNA, 30 bp, Artificial Sequence
  Rev Nested  LAB381_NR_XbaI
aaatctagaagatgctccaagaaaccatcc

SEQ ID NO: 9143 - DNA, 31 bp, Artificial Sequence
  Rev External LAB381_ER_XbaI
aaatctagagaggtatgctttcagatgctcc

SEQ ID NO: 9144 - DNA, 35 bp, Artificial Sequence
  Fwd Nested LAB383_NF_BamHI
aaaggatccttctcttactgactctctttgtcacc

SEQ ID NO: 9145 - DNA, 28 bp, Artificial Sequence
  Fwd External LAB383_EF_BamHI
aaaggatccgccgatccaaccaatcatc

SEQ ID NO: 9146 - DNA, 31 bp, Artificial Sequence
  Rev Nested  LAB383_NR_XhoI
tttctcgagctagtttccacccattccatgc

SEQ ID NO: 9147 - DNA, 36 bp, Artificial Sequence
  Rev External LAB383_ER_XhoI
aaactcgagtcattaagagagaagcaaactgtatgg

SEQ ID NO: 9148 - DNA, 29 bp, Artificial Sequence
  Fwd External LAB53_EF_BamHI
aaaggatccctcagcgttaacaggccaag

SEQ ID NO: 9149 - DNA, 31 bp, Artificial Sequence
  Rev External LAB53_ER_XhoI
aaactcgaggaaccgataaccaacacaaagg

SEQ ID NO: 9150 - DNA, 30 bp, Artificial Sequence
  Fwd External LAB54_EF_BamHI
aaaggatcctcacgctttcggttcctaatc

SEQ ID NO: 9151 - DNA, 31 bp, Artificial Sequence
  Rev External LAB54_ER_XhoI
aaactcgagttcaaatacagtgcccaactcc

SEQ ID NO: 9152 - DNA, 29 bp, Artificial Sequence
  Fwd Nested LAB55_NF_XhoI
aaactcgagataagctagcaagccgctcc

SEQ ID NO: 9153 - DNA, 32 bp, Artificial Sequence
  Fwd External LAB55_EF_XhoI
aaactcgagcccaagtttgcagaggagataag

SEQ ID NO: 9154 - DNA, 31 bp, Artificial Sequence
  Rev Nested  LAB55_NR_EcoRV
aaagatatcttcatcttccttagcatggctc

SEQ ID NO: 9155 - DNA, 31 bp, Artificial Sequence
  Rev External LAB55_ER_EcoRV
aaagatatcggctgaaccaagtcatcaactc

SEQ ID NO: 9156 - DNA, 32 bp, Artificial Sequence
  Fwd Nested LAB58_NF_BamHI
aaaggatcccagctcgagcaagaaagaagtag

SEQ ID NO: 9157 - DNA, 31 bp, Artificial Sequence
  Fwd External LAB58_EF_BamHI
aaaggatcctcctctcctgtcgtctccatag

SEQ ID NO: 9158 - DNA, 31 bp, Artificial Sequence
  Rev Nested  LAB58_NR_KpnI
aaaggtacccaagcaaacaaccgtatgtgtc

SEQ ID NO: 9159 - DNA, 31 bp, Artificial Sequence
  Rev External LAB58_ER_KpnI
aaaggtaccagtcgtcttattcctcccatcg

SEQ ID NO: 9160 - DNA, 32 bp, Artificial Sequence
  Fwd Nested LAB64_NF_SalI
aaagtcgactgtagatattcccgagtgagagg

SEQ ID NO: 9161 - DNA, 31 bp, Artificial Sequence
  Fwd External LAB64_EF_SalI
aaagtcgaccgcttgtagatattcccgagtg

SEQ ID NO: 9162 - DNA, 31 bp, Artificial Sequence
  Rev Nested  LAB64_NR_XbaI
aaatctagactaggtgaatgtgcatacggtg

SEQ ID NO: 9163 - DNA, 31 bp, Artificial Sequence
  Rev External LAB64_ER_XbaI
aaatctagataagccaagatacattcgctcc

SEQ ID NO: 9164 - DNA, 31 bp, Artificial Sequence
  Fwd Nested LAB65_NF_BamHI
aaaggatcctctctgcttcacgatcttctcc

SEQ ID NO: 9165 - DNA, 31 bp, Artificial Sequence
  Fwd External LAB65_EF_BamHI
aaaggatccctctcaagcctcaagagctcac

SEQ ID NO: 9166 - DNA, 34 bp, Artificial Sequence
  Rev Nested  LAB65_NR_XhoI
aaactcgagctaacagatcgcctgaaactgaaac

SEQ ID NO: 9167 - DNA, 31 bp, Artificial Sequence
  Rev External LAB65_ER_XhoI
aaactcgagctaccctacagagacggattgg

SEQ ID NO: 9168 - DNA, 31 bp, Artificial Sequence
  Fwd External LAB67_EF_BamHI
aaaggatccgattctcgatccattccaatcc

SEQ ID NO: 9169 - DNA, 32 bp, Artificial Sequence
  Rev External LAB67_ER_Xho1
atactcgagtgactgtatatcgtccatggtcg

SEQ ID NO: 9170 - DNA, 29 bp, Artificial Sequence
  Fwd Nested LAB68_NF_SalI
aaagtcgacgaagaacgtacggctcgaag

SEQ ID NO: 9171 - DNA, 29 bp, Artificial Sequence
  Fwd External LAB68_EF_SalI
aaagtcgaccatcgaatcggaggaagaac

SEQ ID NO: 9172 - DNA, 31 bp, Artificial Sequence
  Rev Nested  LAB68_NR_XbaI
aaatctagacatttgccttgacttcgtgttc

SEQ ID NO: 9173 - DNA, 31 bp, Artificial Sequence
  Rev External LAB68_ER_XbaI
aaatctagactttctagtgtttctgcccgtg

SEQ ID NO: 9174 - DNA, 33 bp, Artificial Sequence
  Fwd Nested LAB69_NF_SalI
aaagtcgacgcttcttctactttgtggtgaagg

SEQ ID NO: 9175 - DNA, 31 bp, Artificial Sequence
  Fwd External LAB69_EF_SalI
aaagtcgaccatatataaggcctggacgtgg

SEQ ID NO: 9176 - DNA, 31 bp, Artificial Sequence
  Rev Nested  LAB69_NR_XbaI
aaatctagaccttgaggctataacacccatc

SEQ ID NO: 9177 - DNA, 34 bp, Artificial Sequence
  Rev External LAB69_ER_XbaI
aaatctagaccttaaataggatttcaaatggcac

SEQ ID NO: 9178 - DNA, 30 bp, Artificial Sequence
  Fwd External LAB70_F_BamHI
aaaggatccttggcctcttcgtctttgttt

SEQ ID NO: 9179 - DNA, 31 bp, Artificial Sequence
  Rev External LAB70_ER_XhoI
aaactcgagttcattgcgtattcacatttgg

SEQ ID NO: 9180 - DNA, 28 bp, Artificial Sequence
  Fwd External LAB73_F_BamHI
aaaggatccaatacagcgattgcggagc

SEQ ID NO: 9181 - DNA, 32 bp, Artificial Sequence
  Rev External LAB73_ER_KpnI
aaaggtaccaatttacacgcaagaaagcacac

SEQ ID NO: 9182 - DNA, 30 bp, Artificial Sequence
  Fwd Nested LAB74_NF_XhoI
aaactcgagtgcctttggtttattgtcagc

SEQ ID NO: 9183 - DNA, 34 bp, Artificial Sequence
  Rev Nested  LAB74_NR_EcoRV
aaagatatcctactgagtgtgggtcatcattgtg

SEQ ID NO: 9184 - DNA, 31 bp, Artificial Sequence
  Fwd Nested LAB80_EF_SalI , Fwd External LAB80_EF_SalI
aaagtcgacttacacatcgcaccactctctc

SEQ ID NO: 9185 - DNA, 29 bp, Artificial Sequence
  Rev Nested  LAB80_ER_XbaI , Rev External LAB80_ER_XbaI
aaatctagattcttcttaccgccaccttc

SEQ ID NO: 9186 - DNA, 27 bp, Artificial Sequence
  Fwd External LAB81_EF_BamHI
aaaggatccagcgagaagcatccatcg

SEQ ID NO: 9187 - DNA, 34 bp, Artificial Sequence
  Rev External LAB81_ER_KpnI
aaaggtaccctatgaaccaataggaacagcagtg

SEQ ID NO: 9188 - DNA, 31 bp, Artificial Sequence
  Fwd Nested LAB82_NF_StuI , Fwd External LAB82_NF_StuI
aaaaggcctctatttatatccggcctcgtcc

SEQ ID NO: 9189 - DNA, 31 bp, Artificial Sequence
  Rev Nested  LAB82_NR_SacI , Rev External LAB82_NR_SacI
aaagagctccactggatggccagagaataag

SEQ ID NO: 9190 - DNA, 31 bp, Artificial Sequence
  Fwd Nested LAB83_NF_XhoI
aaactcgagaattgtgcatcgtgtgatgttc

SEQ ID NO: 9191 - DNA, 31 bp, Artificial Sequence
  Rev Nested  LAB83_NR_SacI
aaagagctctccctaaactggccataatcag

SEQ ID NO: 9192 - DNA, 31 bp, Artificial Sequence
  Fwd External LAB84_EF_BamHI
aaaggatccttccaaattccaattgctcatc

SEQ ID NO: 9193 - DNA, 34 bp, Artificial Sequence
  Rev External LAB84_ER_XhoI
aaactcgagctagtacatctgccgaaagaaatcc

SEQ ID NO: 9194 - DNA, 31 bp, Artificial Sequence
  Fwd Nested LAB86_NF_XhoI
aaactcgagctgtcaatacaaccagctgcac

SEQ ID NO: 9195 - DNA, 31 bp, Artificial Sequence
  Fwd External LAB86_EF_XhoI
aaactcgaggtggtcgtcatgaaactctcag

SEQ ID NO: 9196 - DNA, 31 bp, Artificial Sequence
  Rev Nested  LAB86_NR_SacI
aaagagctcgaatggcatacagaatgctgag

SEQ ID NO: 9197 - DNA, 32 bp, Artificial Sequence
  Rev External LAB86_ER_SacI
aaagagctcggatggaaggataacgagttcac

SEQ ID NO: 9198 - DNA, 32 bp, Artificial Sequence
  Fwd Nested LAB88_NF_SalI , Fwd External LAB88_NF_SalI
aaagtcgactgtgatacctggactttgagagc

SEQ ID NO: 9199 - DNA, 31 bp, Artificial Sequence
  Rev Nested  LAB88_NR_XbaI , Rev External LAB88_NR_XbaI
aaatctagaatacctacacggctacacctgg

SEQ ID NO: 9200 - DNA, 30 bp, Artificial Sequence
  Fwd External LAB89_EF_BamHI
aaaggatcccgtttccacttcaccattcac

SEQ ID NO: 9201 - DNA, 32 bp, Artificial Sequence
  Rev External LAB89_ER_KpnI
aaaggtacccgaatctcaagatcgctaatcac

SEQ ID NO: 9202 - DNA, 31 bp, Artificial Sequence
  Fwd Nested LAB92_NF_BamHI
aaaggatccaccaaagacgacgagttagagg

SEQ ID NO: 9203 - DNA, 31 bp, Artificial Sequence
  Rev Nested  LAB92_NR_XhoI
aaactcgagttctctgttacggcttaccacc

SEQ ID NO: 9204 - DNA, 28 bp, Artificial Sequence
  Fwd External LAB93_F_XhoI
aaactcgagatcacagagctcacgcacc

SEQ ID NO: 9205 - DNA, 31 bp, Artificial Sequence
  Rev External LAB93_ER_EcoRV
aaagatatccgggactctacagttcacaacc

SEQ ID NO: 9206 - DNA, 30 bp, Artificial Sequence
  Fwd External LAB94_EF_BamHI
aaaggatcccactgctgctgttctcagctc

SEQ ID NO: 9207 - DNA, 31 bp, Artificial Sequence
  Rev External LAB94_ER_KpnI
aaaggtacccagcagttcagagaagcaaatg

SEQ ID NO: 9208 - DNA, 29 bp, Artificial Sequence
  Fwd Nested LAB97_NF_SalI
aaagtcgacgactcgagacgcaggagaag

SEQ ID NO: 9209 - DNA, 30 bp, Artificial Sequence
  Fwd External LAB97_EF_SalI
aaagtcgactctggccatcggaaagtaaag

SEQ ID NO: 9210 - DNA, 31 bp, Artificial Sequence
  Rev Nested  LAB97_NR_XbaI
aaatctagatccatgctgttctcaagttcac

SEQ ID NO: 9211 - DNA, 31 bp, Artificial Sequence
  Rev External LAB97_ER_XbaI
aaatctagaccaagaacgaaccaacaatagc
